United States Patent 9,828,416 (MODIFIED POLYNUCLEOTIDES FOR THE PRODUCTION OF SECRETED PROTEINS) - sequence listing, part 7

SEQ ID NO: 13994 - RNA, 1965 nt, Artificial Sequence
  Description of Artificial Sequence: Synthetic coding sequence
augucacuugcugccuauugugucauuuguugucggcggauuggcacuuccacaucacccccuaagucagggacccauuggagggauauaagaaauauuaucaaguucacugggagucuaauacuaggagguuccuuguuccuuacuuacgaggugcucgcacucaagaaggcugucacucucgacacacaagugguggaaagagaaaagaugaagucuuacauuuacgugcauacgguuucuuuagauaagggcgaaaaccauggcauugccuggcaggccagaaaagagcugcauaaggcagugcguaagguccuggccacauccgccaaaauucuccggaacccuuucgcugauccuuuuuccaccguugacaucgaagaccacgaaugcgcaguguggcugcuccuaagaaaaucuaaauccgaugacaaaaccaccagacucgaggcugugagggagaugagcgaaacccaccacuggcacgacuaccaauaucggaucaucgcucaagcaugcgaucccaagacacucauaggcuuggcucgaagcgaagaaagcgaccuucguuuuuuuuuguuaccuccgccuuugccaucccucaaagaggauucauccaccgaggaagaguugcggcaguuacuagccucucugccacagaccgaacuggacgaaugcauccaauauuucacuucucucgcgcucagcgaaucuucucagucccuggcugcccaaaaaggaggucucugguguuucgggggaaacggacugccuuacgcggaguccuuuggcgaggugcccagugccacaguagaaauguuuugucuagaggcaauuguuaagcauagugaaaucucuacccacugcgacaaaaucgaagcaaacggggguuugcagcucuuacaaagacuguaucgcuugcacaaggacugucccaagguucagagaaauaucaugcgugucauaggcaauauggccuuaaaugaacaccuccauuccuccauuguucgaucaggcugggugucaauuauggccgaagcaaugaaaucaccgcauauuauggaaaguagucaugcugcccgcauucuagcuaaccuagaucgggaaacaguacaggaaaaguaccaggacggaguguauguccugcauccucaauaucgcaccagccagcccaucaaggcggaugugcuguucauucacggacugaugggugcggccuucaagacguggcgacaacaggauagcgaacaagccgugauugagaaaccaauggaggacgaggauagauacacaaccuguuggccaaagacauggcuugcuaaagauugccccgcccugcgaauaauuucaguugaguacgauacuucucucuccgacuggcgugcuagauguccaauggagcgaaaauccauagcauuuagaaguaaugagcuacugagaaaguugagagcagccgggguuggagaucguccugugguauggaucucccacagcaugggugguuuauugguuaagaaaaugcuccuggaagccagcacuaagccagagaugucuacaguuaucaauaacacaagaggaaucaucuuuuacuccgucccucaccauggaucuaggcucgcagaguauagcguuaauaucagguaucugcuauuuccaucacuggaggucaaagaacucuccaaggacagccccgcacuuaaaacucuacaagacgauuuucucgaauuugccaaagacaagaacuuccagguccugaacuucguugaaacgcucccaacauauauaggcuccaugauuaagcugcauguaguuccaguggaaucugcugaccucggaaucggagaccuuauccccguggacgucaaccaucugaauauuugcaaaccuaaaaagaaggaugcuuuuuuauaccagagaacucuccaauuuauacgcgaagcccuggcuaaagaucuggaaaacuag

SEQ ID NO: 13995 - RNA, 1509 nt, Artificial Sequence
  Description of Artificial Sequence: Synthetic coding sequence
auggcccagcgcugcgugugcguccuggcucuuguagcaaugcugcugcuuguguuccccaccgucucaagaaguauggguccgagauccggagaacaucaacgcgcaucucgcauccccagucaguucagcaaggaagagcgaguagcuaugaaagaggcucugaagggugccauccagaucccaaccgucacauuuagcuccgaaaaauccaacacuaccgccuuggcagaguuuggaaaguacauacauaaaguguucccgaccguggugucaacuucuuuuauacagcacgaaguugucgaggaguauucccaucuguuuacuauccagggaucugaccccucguuacagccuuaccugcuaauggcucacuuugaugucgucccugccccugaggaaggcugggaggugccucccuucaguggacuggaaagggauggaauaauauauggcagaggcacucucgaugauaaaaacucagugauggcacugcugcaggcccuugaauugcuccucaucagaaaguacauucccaggcgcagcuuuuuuauuucccuuggccaugaugaagaaucauccggcacgggugcacaacggauuagugcccuguuacaaucccgugguguacaacuugcuuuuaucgucgacgagggggguuuuauuuuggaugacuuuauccccaacuuuaaaaaacccauagcacugaucgcugucagcgagaaggguagcaugaaccugaugcugcaagugaacaugacuucuggacauucaucugccccacccaaggaaaccucgauagguauccuggcagcagcaguuagccggcuugagcagacuccaaugccgauaaucuucggaucuggcaccguggugaccguacuacaacagcuagccaaugaguuccccuuccccgucaacauuauucugucaaaucccuggcuauucgaaccacucauuagccguuuuauggagcgcaacccccugaccaaugccauuauucgaaccacaaccgcucugacgaucuuuaaagccggcguaaaauucaauguuaucccaccaguagcccaggcaaccgucaacuuucggauucaucccggucagacagugcaggaaguccuugagcugacaaaaaacauuguugcugacaaucgcgugcaguuccaugugcucucugccuucgauccucuuccuguuagcccaagugacgacaaagcacucgguuaucaacuacuacgccagaccguccaaucaguuuucccugaggucaacaucaccgcaccagugacgagcaucgggaauacagauaguagauuuuuuaccaaccuaacuaccgggaucuauagauuuuacccaauauauauucagccagaggauuuuaagcggauucacggcgugaaugagaagauuagcguccaagccuacgagacccaagugaaguuuauauucgagcucauccagaaugccgauaccgaucaagaaccugugucacaucuucauaaguuguag

SEQ ID NO: 13996 - RNA, 999 nt, Artificial Sequence
  Description of Artificial Sequence: Synthetic coding sequence
augcggcugcucgccuuuuuaucacuacuggcacuuguuuuacaggagacgggaaccgccucacugcccaggaaagaaaggaaacgccgggaggaacagaugccuagggagggugauucauucgagguacugccgcuccguaacgauguucugaacccugauaauuacggagaagugauugacuuaagcaauuaugaagaacucacagacuauggggaccagcucccggaagucaaagugacgagccucgcaccugcaacaucuaucaguccagcgaaaucgaccacagcccccgguacuccaagcucaaacccuacaaugacccgcccuaccacugcagguuuacuccugagcagccaacccaaucacggccucccuacuugucucgucugcgucugcuugggaucgaguguguacugcgacgacauugacuuagaagauaucccuccccugccccgucggacggccuaucucuacgccagguuuaacaggauaucccgcaucagagcagaagauuucaaaggacuuaccaaguugaaacgcauugaucuguccaacaaucucaucucuuccaucgacaaugaugcuuuccggcuucuccacgcucugcaggaccuuauucuucccgaaaaucagcuggaagccuugcccguauuaccgaguggcauugaguucuuggauguaagacucaaucgguuacaaucuucaggaauccaacccgccgccuucagggccauggagaaacuucaauuuuuguaccucagugacaaucugcuagauuccauucccgguccucucccccuuucuuugcggagcguacaccuccaaaacaaucucaucgagacaaugcaacgcgaugucuuuugugaccccgaagagcauaagcauaccagacggcagcuugaagauauccgucucgacgguaacccaauaaauuuaagccuuuuccccucggccuacuucugccugccuagauuaccuaucggaagguuuacuuag

SEQ ID NO: 13997 - RNA, 1401 nt, Artificial Sequence
  Description of Artificial Sequence: Synthetic coding sequence
auggugcguucuguggcgugggcaggauucaugguacuguuaaugauuccguggggcucagcagccaaauuggugugcuacuuuacgaacugggcucaguaucgccagggcgaggcucgcuuucucccaaaagaccuugauccaucacuguguacucaucugauauacgcuuucgcaggaaugaccaaucaccaacuuucuaccaccgaauggaaugacgaaacccuuuaccaagaguucaacggauugaagaagaugaacccaaagcucaaaacacuucuagcaauaggaggguggaauuucggaacccagaaauucacugauaugguagcuacagcaaacaauaggcagaccuucgugaacagcgcaauaagguuucucagaaaauacuccuucgauggucucgaucucgacugggaauacccagggucacaggguuccccagcugucgacaaggaacgauuuacaacacucguucaggaucucgcgaaugccuuccaacaggaggcacaaaccucagggaaggaacgacuccugcuuucugccgcagugcccgccggccagacuuacguggacgcuggcuacgaaguugacaaaauagcccagaaccuggacuucguaaaucugauggccuacgacuuucacggauccugggaaaaggucacaggacacaacucuccucuguacaaaaggcaagaagaauccggagccgccgccucccucaacguugacgcagcaguccagcaguggcuucagaaagggaccccugccucuaagcucauccucgguaugccaacuuacggacgcucauucacucuggcauccaguucugacacucguguuggggcacccgcuaccgggucagguacuccagggcccuucacaaaagaagggggcaugcuugcguacuaugaagucuguaguuggaaaggugcuacaaaacagagaauccaagaucagaaagucccauacauuuuccgugauaaucagugggugggcuucgacgacguggagucauucaagacaaaggucucauaucugaagcaaaagggacucgggggugcaaugguaugggcacuggauuuagacgauuucgccggcuuuagcugcaaucagggccgauauccguugauucagacucugcgccaggagcugucacugccuuacuugccaagcgggaccccagaauuggaggugcccaaaccgggacagccuagcgagcccgaacacggaccuagccccggacaggacacuuuuugucagggaaaagcagauggccuuuauccuaacccccgggaacgcucuaguuuuuacucgugugcugcaggacgccuuuuccagcaauccuguccaaccggucuuguuuuuagcaacucguguaaaugcugcacuuggaauuag

SEQ ID NO: 13998 - RNA, 1596 nt, Artificial Sequence
  Description of Artificial Sequence: Synthetic coding sequence
augagguuaugucuuggaagaccccauccucggggccauucucgaguaggaaaauccgaacguggucguggagcgaggggcuuggcccgacagcgcacccuggaggacgaagaggagcaggagagggaacggaggagaaggcaucggaaucuuucaucaaccacggacgaugaggccccuagacuuagccagaauggcgacagacaagcuagcgccucugaaagacugcccagcguggaggaagcugagguuccaaagccauugccaccagccuccaaggacgaagaugaagauauucagaguauuuuacggacuagacaagaacgacgacagagaaggcagguaguugaggccgcucaggcccccauccaggagagacuagaagcagaggaagggcgaaauucucucagcccagugcaagcuacucaaaaaccacuggucuccaaaaaggaguuagagauuccgccucgaagacgacuuaguagggaacagcgggguccuugggcccucgaagaagaaucacuggucggccgugagccagaagagaggaagaaaggugugccagagaaaagcccagugcuggaaaaaucgagcaugccaaagaaaacagcucccgagaagagccuugucuccgauaagacaucuauaagugagaaggugcuggcguccgagaaaacaucuuuauccgaaaagauugcagucuccgaaaaacgcaauagcagcgagaagaagucgguuuuagaaaagacaaguguuagugaaaaaagucucgcaccaggaauggcucuggggagcggcagacggcucgugucagaaaaagcaaguauuuucgagaaggcacuagcuucagagaagucaccgacagccgacgcgaaaccagccccuaagcgcgcaacagcuuccgaacagccacuagcucaagaaccaccugcaagcggcggaucuccugcaacuaccaaggaacaacggggucgcgcucucccugggaagaaucugccuucucucgcaaagcagggcgcuuccgauccuccaacagucgccuccagguugccacccgugacuuugcaagugaagaucccuuccaaagaggaggaagccgauaugaguaguccaacacagagaacauacagcagcagccugaagcggucuagcccuaggacuauaaguuuccgaaugaaacccaaaaaagagaacagcgagacuaccuugacacgguccgcuucuaugaaauugccugacaauacggucaaacugggcgagaagcuggagagauaccacaccgccauccgucgcagcgaaucuguuaaaucaagggguuugccaugcacagaacuauucguggcaccugucgggguugcguccaaaagacaucuauucgaaaaggaauuggcaggacagagcagagcugagccagcuucaagcaggaaagaaaaucuaagauugagugggguggucacaagccgguuaaacuuauggaucuccagaacccaagagucuggagaccaagauccucaggaagcacagaaagccaguucagcuacggagagaacccaguggggacagaaaagcgacuccagccuggaugcagaaguguag

SEQ ID NO: 13999 - RNA, 1782 nt, Artificial Sequence
  Description of Artificial Sequence: Synthetic coding sequence
augaaagccgaccucaaacaacaccaccaccacugguccauuuuuagcuacauccggcugcgccuuccuucaaugcugcucuuauuuucuguuauacucauaagcuggguguccaccguggggggggaagguacucuaugcgauuuuccuaagauucaucacggauucuuguacgacgaggaggacuauaauccauucucacagguaccaacaggcgagguguuuuacuauaguugcgaauacaacuuuguauccccaagcaaaagcuucuggacucggaucacuuguaccgaggaaggauggucucccacccccaaaugccucaggauguguagcuucccauuuguaaaaaauggucacucagaauccagcggucuuauacacuuggagggcgacaccgugcaaaucaucuguaacacuggauacucgcuccagaacaacgagaagaacaucucuuguguugaacgcgguuggucaaccccgcccaucuguaguuucaccaaaggcgaaugccacgucccaauacuagaggcuaacguagacgcucagccuaaaaaagaaucuuacaaaguaggcgauguccugaaguucucaugucgaaaaaaccuuauccguguaggcagcgacagugugcaauguuaccaguucggauggucaccaaacuucccaacaugcaaaggccaggugaggucaugcggcccucccccacaguugagcaauggugaggugaaagaaauuaggaaagaggaguacgggcacaacgaaguaguggaguaugacugcaauccaaacuucaucaucaacggaccgaagaaaauacagugcguggacggagaguggacuacacuaccuaccuguguggaacaagugaagacuugcggcuacauaccggaacucgaauauggguacguccagccuucagucccucccuaccagcacggaguuucuguggaagugaauugccgcaaugaauacgccaugaucgggaacaauaugaucacuugcaucaacgguauuuggacagagcugccaauguguguggccacccaucaguugaaacguuguaaaaucgcaggagucaacauuaaaacacucuugaaacuaucaggcaaggaauuuaaccauaauagucgcauuagauaucgcuguuccgacauuuuucgguaucggcacuccguaugcauaaauggaaaauggaacccagaaguggauuguacagagaagagagaacaguuuugccccccgcccccacagauuccuaacgcucagaacaugaccacgaccgugaacuaccaggacggagagaaagucgccgugcugugcaaagagaauuaccugcuccccgaggcgaaagagaucguauguaaagacggacgauggcagucacuuccaagauguguugaaaguacggcuuacugugggcccccaccaucuaucaauaauggcgauacaacaaguuucccgcuguccguguauccucccgggagcaccguuaccuaucguugucaaaguuucuacaaacugcaggguagcgucaccgugacaugucggaacaaacaguggucugagcccccuaggugccuggacccuugcguagucucggaagagaacaugaacaaaaacaacauccagcugaaguggaggaacgacggaaaacucuaugcaaaaacaggagacgccguggaauuucagugcaaguuuccacacaaagcuaugaucuccagcccaccauucagggcuauuugucaggaaggaaaauucgaauauccaaucugugaauag

SEQ ID NO: 14000 - RNA, 2301 nt, Artificial Sequence
  Description of Artificial Sequence: Synthetic coding sequence
augaucuggcgauccagggcgggagcugaacuuuuuucguuaauggcguugugggaauggauugcacuuucucuccacugcugggugcuugccguggccgccguuucagaccagcacgcgacuucccccuucgauuggcuccuuucagacaagggcccauuccacaggucucaggaguacacagauuucgucgaccggucuaggcaaggguucucaaccagguauaaaaucuaucgcgaguuuggucgcuggaaagugaauaaucuggcaguugagcgcaggaacuuuuugggaucaccccucccccucgcuccagaauuuuuccguaacauccgauuauugggccgccgaccuacccugcagcagaucaccgaaaaucucauaaagaaauauggaacccauuuucuccuuagcgcuacccucggcggcgaagagagccucacuauauucguggacaaacggaaacuuucaaaacgagccgaagggucugauucaaccacuaacucaagcagcgugacacuagaaacccugcaccagcuggccgcuaguuauuucauagaccgcgacuccacauugaggcgacuucaucauauucagauagccagcacagcaauuaaaguuacugagacccgaaccgguccauuaggauguuccaauuacgauaaccuggacagcgugucuuccguucugguacagagucccgagaacaaaauccaguuacaagggcuucagguucuguuaccggacuauuugcaggaacgauucgugcaggccgcccucagcuauauagcuuguaacucagaaggugaguuuauuuguaaagagaacgauuguuggugucauugcgguccgaaauuucccgaauguaauugcccuucuauggacauccaggcaauggaggagaaucuccuuaggauuacagaaacauggaaggcuuacaauuccgauuucgaagaauccgaugaguucaagcuguucaugaaacgucugccaaugaacuacuuucugaacaccucuaccauaaugcaccuauggacgauggauuccaacuuccagcgcagauaugagcaauuggagaauucaaugaaacaguuauuccugaaagcccagaagauugugcacaaguuauucucccuuuccaagcgaugccacaagcaaccccucauuuccuuaccccgccaacgaacuucaacauacuggcuuacgaggauccaauccuuccuauauuguaaugagaauggccuguugggcuccuucagcgaagaaacucauagcugcaccugcccuaacgaucaaguagugugcacugccuuccuucccugcacugugggagaugcuucagccugccuuacaugcgcccccgacaacagaacccgguguggaacuuguaauacuggcuacaugcuuucccaaggccucugcaagccugaaguagcugaguccacugaccauuacauugguuucgaaaccgaucugcaagaucuagaaaugaaguaccuguugcagaaaacagaccgucgcauugaaguccacgccaucuuuaucucuaaugauaugaggcuaaauuccugguucgauccaagcuggcgaaagcgaaugcuacuuacacucaaaucuaauaaauacaaaucuucucuggugcauaugauucuaggacugagccugcagauaugucucacuaaaaauucuacccuggaaccugugcucgcuguguacgugaauccuuuuggcggcucacacucugaguccugguuuaugccugugaacgagaauucauucccagacugggagcgaaccaagcucgaccucccacugcaguguuacaacuggacccucacucuaggaaauaaauggaaaaccuucuuugagacaguccauaucuaccucagaagcagaaucaaaagcaacggcccaaacggaaacgaguccauuuacuacgaaccucuugaguuuaucgauccuucucggaaccucgguuauaugaaaauaaacaacauucaaguauuuggauauucuaugcauuuugacccagaggcaauucgggaucuuauccuucagcuugacuacccauauacucaagggucacaggauucagcccuguugcaacuguuggaaauucgggaccgcgugaauaaauuaagcccccccggucagcgcagacucgaucucuuuucaugcuuacuacggcauaggcuaaaacuuucuaccucggaaguggugcgcauacagagcgcccugcaggcauucaaugcaaaacugccuaacaccauggauuacgacaccacuaagcucugcucauag

SEQ ID NO: 14001 - RNA, 1815 nt, Artificial Sequence
  Description of Artificial Sequence: Synthetic coding sequence
augagaagauguaauucagggucagguccaccuccuagcuuacuucucuugcugcuguggcuccucgccgugcccggcgccaaugcugcgccgcggucugcccuguacucucccucagauccguuaacccuucugcaagcugacacgguccggggagcuguuuugggaucucgcagcgccugggcuguggaguuuuuugcauccugguguggacacugcauugcauucgccccuacauggaaagcacuagcugaggacgucaaagccuggcgucccgcguuauaccuugcugcacuggauugugcggaggaaacaaauucagcaguguguagagacuucaauauccccggguuuccaacgguacgguucuucaaagcuuucaccaagaauggcaguggcgcggucuucccuguugcgggcgcggauguccagacccugcgggagcgccuuauagacgcacucgaaucccaucaugauacuuggccaccugccuguccuccgcuugaaccagcuaaacuggaggaaauugauggguuuuuugccaggaauaaugaagaguaccuugcacuuauuuuugagaagggcgggucuuaucucggccgcgagguagcucuugaccuuagccaacacaaggguguggcugucagaagggugcuaaauacugaggcuaacguggucagaaaauuuggaguuacugauuucccaaguugcuacuuauuauuucggaacggcagcgugucccgugucccaguucuuauggagucgagaucuuucuauacagcguaucuccagcgauuauccggguugacccgcgaggccgcgcagacaacuguggccccgacaacugcaaacaaaaucgcuccuaccguuuggaagcuggcagacaggucaaaaauuuacauggcggaucucgaaagcgcucugcacuauauccugagaauugaagugggacguuuuccaguacuggagggucagcgcuugguggcuuuaaagaaguucguggcgguccuagcgaaauacuucccuggaaggccuuugguacagaauuucuuacacagcgugaacgaaugguuaaaacgacagaaacgcaauaagauaccauauucuuuuuuuaaaacagcccuagacgaucggaaggaaggagcuguccuagcaaagaagguuaauuggauugggugucaggggagugaaccacacuuccgaggauuucccuguuccuuaugggugcucuuucacuuuuugaccguccaggccgcccgacagaacgucgaccacagucaagaggcugccaaggcuaaggaaguacugccagcuaucagaggguacguccauuauuuuuuuggaugcagagacugcgcaagucauuucgaacagauggccgccgccuccaugcaccgcguaggaucuccaaaugccgccguccucuggcuuuggaguagccauaaccgcgugaacgcuagacuugcgggcgcccccagcgaagauccccaauuccccaagguucaguggccuccacgcgagcugugcucugccugccauaaugaaagauuagacgugcccgucugggauguggaagcgacucugaauuuccugaaagcccacuucucuccguccaacauuauccucgauuuccccgccgccggcucagccgcccgccgcgaugugcagaauguggcugccgcaccagagcuagcuaugggagcacuggaacucgagagcagaaauuccacccuggaucccgggaagcccgaaaugaugaaaucuccuacaaauacaacuccucacguccccgcggaagguccggaacucaucuag

SEQ ID NO: 14002 - RNA, 2244 nt, Artificial Sequence
  Description of Artificial Sequence: Synthetic coding sequence
augaggagaugcaauucggguagcggcccucccccuuccuuacugcuccuguuguuauggcuucucgcaguuccuggagccaacgcugccccccgcucagcguuguauuccccauccgaucccuuaacccuguugcaggccgacacagugcgcggugccguccugggcuccagaucugcuugggccgucgaguuuuucgccaguuggugcggccauugcauagccuucgcuccuacuuggaaggcccucgcagaagacgucaaggcuuggaggcccgcccucuauuuagcugcacuugauugcgcagaagagacaaacucugcuguaugcagagauuucaauauccccggcuuuccaaccguccgguuuuuuaaggcguucaccaagaacggcaguggcgcuguauucccuguagccggagcugacgugcagacucugcgagagaggcuuaucgaugcuuuagaaucccaccacgauacauggccccccgccugcccuccacuagaaccagcuaaauuagaagagaucgauggguuuuuugcccggaauaacgaagaauaccuggcucugauuuuugaaaaagguggaucauaccugggccgugagguggcccuggaucuuagccagcacaagggcguugcaguaagaagggugcugaauacugaagcuaauguggugagaaaauucgguguuacugacuuuccuagcugcuauuuauuguuucgaaauggaagugucagccgcguccccgucuuaauggaaucaagauccuuuuacaccgccuaccugcaacgacucagcggacuaacacgagaagcugcacaaaccacuguggccccaacaacagcaaauaagauagcucccaccguguggaagcuggccgauaggucaaagaucuauauggcagacuuagagagcgcccugcacuauauccugagaauagaaguaggacgguuuccagugcuggaaggacaaagauuagucgcccuaaagaaguuuguggcagugcucgcuaaguauuucccaggccgcccccuggugcagaauuuccuccacagcguuaacgaauggcucaagaggcaaaagcgaaauaaaauaccuuacucauuuuucaagacagcacucgacgacagaaaggagggcgccguacuugccaaaaaaguuaauuggaucggcugucaggguuccgagccucacuuuagagguuuuccuugcucucuauggguacuuuuucacuuucuuaccgugcaggcagcucggcagaauguggaucacagucaggaagccgccaaggcuaaagagguacuuccagccauccgaggcuacguucacuacuuuuucgggugucgugauugcgccucucacuucgagcagauggccgcggcaaguaugcacagagugggaaguccaaacgcggccgugcucugguuauggucaagucacaaccgaguuaacgcacgccuagcgggggcaccuuccgaagauccccaguuuccuaaagugcaguggccgcccagagaauuguguagugcaugucacaaugagcgucuugauguaccugugugggauguggaagccacccuuaacuuuuuaaaggcacauuucagucccucaaauaucauccuggacuucccugccgcuggaucugcggcuaggcgcgauguucagaaugucgcugcggcaccagaacuugcuaugggagcacuggaacuggaaucucgcaacucgacauuggauccuggcaagccugaaaugaugaaauccccgacuaauacaaccccucaugugccagccgaaggucccgaggccagcagaccuccaaaacuucauccuggauuacgggcugcaccagggcaggaaccacccgagcacauggcagaguuacaacggaaugagcaggagcagccauuaggccaguggcaccugucuaaaagagauacaggcgcugcucugcuggcugagucuagagccgagaaaaauagguugugggguccucuggaaguccggagagucggaagguccagcaaacagcuugucgacauucccgaaggccaauuggaagcgcgggcugggaggggccggggacaguggcugcaggugcuuggcgggggauucucuuaucuggacaucucacugugugucggucuguauucucugucuuuuaugggccugcucgccauguacaccuauuuccaagccaagauucgagcccugaagggacacgccggacacccagcugccuag

SEQ ID NO: 14003 - RNA, 1476 nt, Artificial Sequence
  Description of Artificial Sequence: Synthetic coding sequence
augaagaccuucacuuggacacuugggguacucuuuuuccuguugguggacacgggucacugcaggggcggccaauucaaaauuaagaaaaucaaucagcggcguuauccuagagcaacagaugguaaagaagaagcaaaaaaaugugccuauaccuuccucgucccagagcagagaaucacuggccccauauguguuaacaccaaagggcaagaugcaagcaccaucaaggacaugauuacccgaauggaucuggagaaccuuaaggaugugcucagcagacaaaagcgagagauugauguucugcaacucgugguggaugucgacggaaauauugugaaugaagugaaacuucuccggaaagaaagucgaaauaugaauagucgugugacacaacucuauaugcagcuauugcaugagaucauucgaaaacgcgacaauagucuggaacugucucaauuagaaaacaaaauccuaaaugucaccacggaaauguugaaaauggcaacaagguaccgagaacucgaagugaaauaugccuccuugaccgacuuaguaaacaaucagucagucaugaucacucuucuggaggagcagugccucagaaucuucucacggcaggauacccaugucagccccccacucguccagguagucccacaacacauucccaauucccagcaauacacgccaggcuugcuuggcggaaaugagauccaacgcgaucccggguacccaagagauuuaaugccacccccagaucuggccacaagcccuacuaaaagccccuuuaagauaccaccugugaccuuuauuaacgagggcccauucaaggacugccagcaggcuaaagaggcaggacacagcguguccggcaucuacaugaucaagcccgaaaacucuaacggaccaaugcaacuguggugugagaauagccuggauccuggcggguggaccgugauucagaaacguacugauggaagugugaacuuuuuucgaaauugggagaacuauaaaaaggguuucggcaauaucgauggggaauacuggcuggggcuugagaacaucuauaugcuauccaaccaagauaacuauaaguugcugauugaauuagaggacugguccgauaaaaaaguguacgcagaauacaguagcuuuagacuugaaccagaaucggaauuuuauagacugcgacugggaaccuaccagggcaaugcaggagauucaaugauguggcauaacggcaagcaguucacgacauuagauagagauaaggauauguaugcugggaauugcgcucacuuucauaagggcggcuggugguacaaugccugugcccacucuaaccuuaacggggucugguaccgggggggacacuauaggaguaagcaucaggacggaauauuuugggcagaauaucggggcggaucguacagccugagagcggugcaaaugaugaucaagcccaucgacuag

SEQ ID NO: 14004 - RNA, 2484 nt, Artificial Sequence
  Description of Artificial Sequence: Synthetic coding sequence
augaugugccuuaaaauucuucggauuucguuagccauccucgccggcugggcuuuauguagcgcaaauuccgagcuuggcuggacaagaaagaaaucgcuaguugaacgcgagcacuugaaccaaguucugcuggaaggcgaacgauguugguuaggggccaagguccgccggcccagggcuucuccucagcaccaucuauuuggcguguauccaucuagagcuggaaauuaccugcgcccuuaccccgucggugaacaagagauccaucacaccggcagaagcaaacccgauacagaaggcaacgcagugucauuagugccuccugauuuaaccgaaaaucccgcuggccugaggggcgcuguggaagagccagcugcuccauggguaggugauagcccuauaggccagagcgaauugcuuggcgacgacgaugcuuaccuugguaaccagaggagcaaggaaagccugggugaggcgggaauccagaaaggcucugcaauggcggccacuacaacuacagccaucuucacgacucucaacgagccuaaaccagaaacccaacgcagaggaugggcaaaaagccgucagcgacgacagguauggaagcguagagcugaggacgggcagggggacagcggaaucucaucacauuuucagccauggcccaaacauagccuaaaacauagagucaagaaaagucccccugaagagaguaaucagaauggcggcgagggaucauaucgggaagcugaaacguucaacucccaggugggucucccgauucuuuacuuuuccggacgcagggagaggcuccuccuaagaccagaggugcuggcagaaauaccccgggaggcguucacggucgaggccugggugaaaccagaagggggacagaauaacccugcaaucaucgcuggcguauucgacaauuguucccacacugugagugauaagggaugggccuuaggaaucagauccgguaaggauaagggaaagagagacgcgcgauucuucuucuccuuaugcacugacagaguaaagaaggccaccauucuuauaagccacucccgauaccaacccggcacuuggacucacguggccgcaacauacgacggccggcacauggcacucuaugucgacgggacacaggucgcuuccucucuugaccaaagcggcccacugaacuccccauuuauggccucuugucgcagucugcuccuggggggcgauucaucagaggacgggcacuauuuucgaggccaucuugggacccuuguuuucuggaguacagcucugccccaaucucauuuccagcauucuagccagcauagcuccggggaggaggaggccaccgaucuuguguugaccgcaucuuuugaaccugugaauacugaaugggugccauucagagaugagaaauauccacgacuugaaguguuacagggguucgaaccagaacccgagauuuugucuccacuccaaccuccccuuugugggcagaccgugugcgauaaugucgaacuuaucucucaauacaacggguauuggccacuccgaggcgagaaagugaucagguaccagguagucaacauaugcgacgaugaaggccugaaucccaucguuuccgaagaacagauccgucuccaacacgaagcucuuaacgaggcuuuuagucgcuauaauauaucauggcaauugagugugcaccaaguccauaacuccacgcugaggcacagagucgugcuggugaauugugaaccuagcaagauuggaaacgaccacugugacccugaaugugaacauccauugacugguuacgacggaggcgacuguagacuccaggggcgcuguuacagcuggaaccgccgcgacggacuuugucacguggaguguaacaacaugcugaaugacuuugacgacggugauugcugcgacccccaaguggcagacgugaggaagacuuguuuugauccggauucuccaaaaagagcuuacauguccgugaaggagcugaaggaggccuugcaauuaaacucaacacacuuuuuaaacaucuacuucgcuuccagcguucgagaagaucucgccggagcagccaccuggccaugggauaaagaugcggucacucaccuuggaggcauugugcuuucuccagcauacuacggaaugcccggacauacagauacaaugauucacgagguaggucaugugcucggucuguaucauguauucaagggugucuccgagagagaauccuguaacgacccuuguaaagaaacaguccccucgauggagacuggggaccuuugugccgacaccgccccaaccccuaaaucagagcucugcagagaaccagagccaacaucagacacuugcgguuucacacgguucccuggggcuccauucacaaauuauaugucuuauaccggaaucacaaccgugcucuucugcuuccuucuucgcauccacggcggauuguag

SEQ ID NO: 14005 - RNA, 5376 nt, Artificial Sequence
  Description of Artificial Sequence: Synthetic coding sequence
augaugugccugaaaauccugcguauuaguuuggccauuuuggcagggugggcacuguguucggcaaauagugaacucgguuggacaagaaagaagucccuggucgaacgagagcaccugaaucaaguccugcuggagggggagcgauguuggcucggcgcgaaggugagaagaccgcgggccucaccucaacaucaccuuuucgggguguauccuagccgagcuggaaauuaccugcggccauaucccgugggggagcaagaaauacaucacacuggaaggagcaaacccgacaccgaggggaacgccgucucccucgugccgccugaucucacugaaaauccagccggccugagaggagcggucgaggagccagccgcaccguggguaggcgauuccccgaucggacagagugagcuccugggugaugaugacgcuuaucuugguaaccagcgaucaaaggaauccuuaggcgaagcuggaauacaaaagggcucugcaauggccgccaccaccaccaccgccauuuucaccacucugaacgaacccaagccagaaacacaaagaaggggaugggcaaaaagucgccagcguagacaaguauggaaacgucgggcagaggacggacaaggcgauucugggauaagcucacauuuucaaccuuggcccaagcacucacugaagcaccgaguaaagaaguccccuccagaagaauccaaucaaaaugggggagagggaaguuacagagaagcagagacuuucaacagccaagucgggcuccccauccuauacuucuccggcaggagagagagauuguugcugcggccugaaguacuugcagagauaccucgggaggcauucaccguugaggcaugggugaaaccagagggaggacaaaauaacccugccaucaucgcugggguauucgauaauugcucacacacaguauccgacaaggguugggcccuaggcauucgaagcgguaaggauaagggaaaacgagaugcuagguuuuucuuuucucuuuguacugaucgcguuaagaaggcuacaauccucaucucgcauucgcgcuaccaaccaggaacauggacccacguugccgccacauacgacggccggcacauggcccuguacguugacggaacucagguggccaguucccucgaucaaagcgguccuuuaaacagcccauuuauggccaguugcagauccuuguuacuaggcggcgacaguuccgaggacggacauuauuuuagaggccaucuuggcacauugguuuuuuggagcacugcucuaccacagucccacuuucaacauagcucacagcauagcagcggagaagaggaagcaaccgaccuggugcugacagccucuuucgaaccuguuaauacggagugggucccauuucgugacgaaaaguaccccagacucgagguucugcaggguuucgaacccgagcccgagauccugagcccuuuacagcccccucucugcggacagaccgugugugacaacguggaacuuaucucacaguauaacggauacuggccucugagaggugaaaaaguaauuagauaccaaguggugaacauaugcgacgacgaaggauugaauccgauaguaucagaggagcagauuagacuucagcaugaggcucugaaugaggcuuucucccgcuauaacaucagcuggcaauuaucaguucaucaggugcacaacagcacauuaagacaccgaguugugcucgucaacugcgaacccaguaaaaucgggaacgaccacugugacccagaaugugaacauccauuaacaggguaugacgggggagacugucgcuugcaggguagaugcuauuccuggaauagaagagacgguuugugccacguugaauguaacaauaugcugaacgacuucgacgacggcgauuguugugauccacagguagcagaugugcguaagacuugcuuugauccggacagucccaaacgagccuauaugagcgugaaagaacucaaagaggcacuccagcucaauuccacucacuuuuugaauaucuauuucgcuuccucaguucgggaggaucucgcuggggcagcaacauggccuugggacaaggacgcagucacacaccugggaggaaucgugcugagucccgcauauuaugguaugccuggucacacagacaccaugauacacgaaguaggacauguccuggggcuguaccacguguuuaaaggugugagcgagcgagagaguugcaaugacccuugcaaggagaccguaccaucaauggagaccggagaucugugcgccgauacugccccuaccccuaaguccgagcuguguagagagcccgagccaacuagugacacaugcggauucacuagauuuccaggcgccccuuucacaaauuacaugucuuacacagaugacaacuguaccgacaacuuuaccccuaaccaggucgccaggaugcauuguuaucuugaccucgucuaucagcaguggacggaaucacgcaaaccuaccccaauuccaaucccacccaugguuauuggccagaccaauaaaucccuaacaauucacuggcugccuccaauuucaggugucguguacgauagagccucuggcucccuuuguggugccugcacugaggacggaacuuuuagacaauauguacauacagcuucuuccaggagagugugcgacucuaguggcuacuggaccccugaagaagccgugggcccccccgacguggaccagcccugcgaaccuagucuucaagccuggucucccgaagugcaucuguaccauaugaacaugaccgugccaugcccuaccgaggggugcagccucgaacugcuguuccagcacccagugcaagccgauacucugaccuuaugggugacaucauucuucauggaaaguucacagguacuuuucgauacagaaauccuucuggagaacaaagaguccgugcaccuuggcccccucgacaccuuuugugacauaccacuuaccauuaaauuacacgucgaugguaaagucucaggcgugaaaguguauacauucgacgagcguauugagaucgacgcugcccuccugacaagucagccccacaguccacuuuguuccggcugccgccccguuagauaccaagugcugcgagaccccccauuugccagcggacuuccugugguugugacacacucucaccggaaauuuacagacguagaagugacccccggucaaauguaccaguaccagguacuagcugaagcuggaggagagcugggcgaagccagucccccccugaaccacauucacggcgcccccuauuguggugacggcaaggucagugagcgacugggugaagaaugugaugauggugauuugguuucaggagauggcugcagcaaagucugugaacuugaagaagguuuuaacugcgucggagaaccaagucucugcuauauguaugagggagaugguauuugugaaccauucgaaagaaaaaccuccaucgucgauuguggaaucuacaccccaaaggguuaucuugaucaaugggcaacccgugccuacaguucacaugaagauaagaaaaagugccccgucagucuugugacaggagaaccucauagucuaauuuguaccuccuaccaccccgaccugccaaaccaucgcccucugaccggcugguuuccuugugucgccagcgagaaugagacccaggaugauaggucugaacagccagaagguucucucaaaaaagaagacgagguguggcuuaaaguuugcuucaaucgccccggugaggcucgagcuaucuucauuuuccugacaaccgacggacugguccccggcgagcaccaacaacccaccgucacccucuacuugaccgaugugcgugguucaaaucacucgcugggcacauauggccuuucaugucagcauaauccauugaucauuaauguuacccaccaccagaacguccucuuucaccacacuacaucuguucugcugaacuuuucauccccucgagucgguaucuccgccgucgcccuacgaacuuccuccagaauuggucuuucagcaccaucaaacugcauaucugaggaugagggacagaaucaccagggucagucaugcauacacagacccuguggcaagcaagacucuuguccaagccuccugcuugaccaugccgacguuguuaauuguacuuccaucgguccaggacuuaugaaaugcgcaaucacaugccagaggggauuugcgcuucaggccaguucuggccaguauauccgcccuaugcaaaaagaaauccuucucaccugcagcuccggacacugggaccagaaugugaguugccucccugucgacugcggaguucccgacccaaguuugguaaacuacgcgaacuucagcugcuccgagggaacuaaguuucugaagcgaugcucaauuuccugcguaccucccgccaagcugcagggcuuguccccguggcucacgugccuggaggacggcuuguggagccugccagaaguguacugcaaacucgaaugugaugcaccgccuaucauccugaaugcuaaucuucuguuaccccauugccugcaggacaaucaugacguugggacuauaugcaaauacgagugcaagccagguuauuaugucgccgaauccgcugaagguaaaguccgcaauaaacuccugaaaauccaguguuuagaaggggguauaugggaacaagggagcuguauacccguugugugcgaaccuccuccacccguuuucgaaggcauguaugaguguaccaauggcuucucccucgauagccagugcguuuugaacugcaaccaggagcgcgaaaaauuaccuauucuaugcaccaaagagggacucuggacgcaagaguucaagcugugugagaaucugcagggagaguguccuccuccucccucugaacugaauucuguggaguacaagugugagcagggguacggaauaggcgcagucugcucccccuuguguguuauuccuccaagugaccccguaauguuaccugaaaauaucaccgccgauacacuggagcacuggauggagccugucaaaguacagucuauaguguguacaggcaggagacaauggcacccggauccgguucucguccacuguauucaaagcugcgagccauuccaagccgacggauggugcgauacaaucaauaaccgggcauacugccauuacgacgguggggacuguugcagcucgacccucaguucaaaaaaggugauacccuuugccgcagacugcgaucuugacgaauguacguguagagacccuaaggcagaagagaaccaauag

SEQ ID NO: 14006 - RNA, 702 nt, Artificial Sequence
  Description of Artificial Sequence: Synthetic coding sequence
augaaagauccacuggcaaaagacgaacgcauuuacgucacaaacuacuauuacgggaauacacugguugaguuucggaaucuggagaauuuuaaacaggguagguggucaaacucguacaaguuaccuuacagcuggauuggaaccgggcacgugguuuacaacggggccuucuacuacaaccgcgccuucacacgaaacauaauuaaauacgacuuaaagcagcgcuauguugccgcaugggcuaugcuccaugauguggccuacgaggaagcgacacccuggcguuggcaggggcacagcgacguggauuuugcuguugacgaaaauggacucuggcuaauuuacccagcacuggacgacgaaggauucagccaagagguaauugugcugagcaaauuaaacgcugcugaccuaucuacacagaaggagaccacauggaggacuggcuugcguagaaauuucuaugggaauugcuucgugauuugcgguguccuguaugccguagauucuuauaaccagcgaaacgcuaauauuucuuaugcauucgauacacauacaaacacucagauugucccccgccugcuguuugagaacgaguauagcuauaccacacaaaucgacuauaauccaaaagacagacuauuguacgccugggauaacggccaccaagucacauaccaugucaucuuugcauauuag

SEQ ID NO: 14007 - RNA, 579 nt, Artificial Sequence
  Description of Artificial Sequence: Synthetic coding sequence
augcuaaaaaaaaucagugucggaguugcuggagaccucaacaccguuacaaugaagcuaggguguguauugauggcaugggcccuguaccugucuuuaggcguauugugggucgcucagaugcuucucgccgccaguuucgaaacccuucaaugugagggucccgugugcaccgaagagucuucuugccauacagaggaugaccuuacggacgccagagaggcuggcuuucagguuaaagcguauacuuuuagcgaaccuuuucaucucauaguuucuuacggagcaaguaguagugcagcaccuccaacucucaaccccgcgccucaaaaaucugcggcccccggaaccgccccagaagaagcuccgggcccccuaccacccccucccacuccaucuagugaagaucccggguuuucaucuccacucggcaugcccgauccucaccuguaucaccagaugggcuuacugcugaagcacaugcaagaugucagaguccugcuuggacaccugcugauggaguuaagagaauuaucgggacaucggaaaccugguaccacaaaggcgacagccgaauag

SEQ ID NO: 14008 - RNA, 459 nt, Artificial Sequence
  Description of Artificial Sequence: Synthetic coding sequence
augcugcuugccgcuagcuucgaaacacugcaaugcgaggguccagucugcaccgaagaguccucaugucacaccgaagacgacuugaccgacgcaagagaggcaggcuuucagguuaaagcguacaccuucuccgagccuuuucaucuuaucguauccuacggagccagcaguagugcagcaccuccaacucucaaucccgcuccccagaagagcgcagcaccaggcaccgcccccgaagaagccccaggaccccuuccgcccccuccaacuccaaguuccgaagauccaggauuuuccucaccacugggcaugccagauccucacuuauaccaccagauggggcugcugcugaaacacaugcaagacguuagggugcuucuaggacaucugcucauggaguugagagagcuuaguggccacagaaaaccaggcacuacuaaggccacggcagaauag

SEQ ID NO: 14009 - RNA, 1098 nt, Artificial Sequence
  Description of Artificial Sequence: Synthetic coding sequence
augaagcuuggaugcguacucauggccugggcucuuuacuugucacucgguguccucuggguugcacagauguuacuggccgcaggaugccaugccgccgccucuuuugagacacuccagugugaaggccccguguguaccgaggaaaguucaugccauaccgaagacgaucuaacugacgcacgagaggccggcuuccaagugaaggccuacacuuucagugagccuuuccaccuuauugugaguuaugauuggcugauacugcagggaccugcgaaaccuguguucgaaggcgaccugcugguucugaggugucaggccuggcaggauuggccccuuacacaagucaccuucuaucgggacgguagcgcacuuggucccccugggccgaaucgggaguuuaguaucacgguaguccagaaagcugacucaggacacuaccacugcaguggcaucuuccagagccccggacccggaaucccugaaaccgccagugucguagccauuacaguccaggaacuguuuccagcacccauuuuacgugcugugccaagcgccgaaccacaggccgggagcccaaugacgcugaguugucagacaaaauuaccuuuacagagaucugccgccagacuccuguucucuuuuuacaaagacggaaggauuguacagucacgcggccugagcuccgaauuccagaucccuacagccagcgaagaccacaguggaagcuacuggugcgaagcagcaaccgaggauaaucagguguggaaacagagcccacaacuagagauucggguccagggcgccagcagcuccgcagccccccccacccuaaaucccgccccccagaaaucggcagcaccaggcacagcuccugaggaggccccaggaccucucccuccacccccaacuccauccucagaagaucccggauuuucuuccccucugggcaugccugacccucaucuuuaccaccaaauggggcuguugcugaaacacaugcaggacguuagaguccuucugggucaccuccucauggaguuacgagaacuaucuggacacagaaagcccggaaccaccaaggccaccgcagaguag

SEQ ID NO: 14010 - RNA, 711 nt, Artificial Sequence
  Description of Artificial Sequence: Synthetic coding sequence
augcuuaaaaagaucucugucggaguugccggggaucucaacaccgugacuaugaaacuuggaugcguucuuauggccugggccuuguaucugucucuugggguacugugggucgcccagauguuguuagagcuguucccugcccccauacuucgcgccgucccguccgccgagccucaagcagggagucccaugacucuuucaugucagaccaaacugccccuccaacgcucugccgcacggcugcuguucuccuucuauaaagacggacgcaucguccaaucaagaggacuuagcucagaauuucaaauuccuacugccagugaggaccauucagggaguuacuggugcgaggccgcaacugaagauaaucagguguggaaacaguccccucagcucgaaaucagagugcaaggcgcgucauccagcgccgcuccaccuacucucaaccccgccccccaaaaaagcgcugccccgggaacagcuccagaggaagcccccgguccacuuccccccccaccuacaccaucaucagaggauccaggauucucuagcccucuuggaaugcccgacccacauuuauaccaucagaugggccugcuuuugaaacauaugcaagacguuaggguccuauugggacaccuucugauggaacugcgcgaguugagcggucauaggaaaccaggaacuacaaaggccacugcggaguag

SEQ ID NO: 14011 - RNA, 1149 nt, Artificial Sequence
  Description of Artificial Sequence: Synthetic coding sequence
augcuuaagaaaaucuccguaggaguggccggggaucugaacacugugacaaugaagcugggcugcguccugauggcaugggcacuuuauuugucccuuggcgugcuguggguagcucagaugcuacucgcugcgggaugucacgcugcugccucauucgagacucugcagugugaaggacccguauguaccgaagaaaguuccugucauaccgaagaugacuugaccgacgcuagagaagccgguuuccagguuaaagcuuacacguucuccgaacccuuucauuuaaucgucaguuaugauuggcucauacuccagggucccgcaaaacccguguuugagggcgaccugcuugugcugcggugccaggcuuggcaggacuggcccuuaacccaggugacauucuacagagacggaagugcacucgggccaccaggcccaaaucgcgaauucucuaucacaguaguacagaaggccgauucaggccacuaccauuguuccggaauauuucagagcccaggacccggcauaccagaaaccgcaucuguugucgcuaucacaguccaggagcuguuuccugcuccaauccuucgcgcuguccccucugcagaaccccaagcuggaaguccaaugaccuuaagcugccaaacaaaacugccacugcaaagguccgcugcccgccugcuguuuucguuuuauaaggauggucgcauuguccagucucggggacucucaucagaauuucagauaccaacagccucugaggaucauuccgggaguuauuggugcgaggccgcaacagaggacaaccaagucuggaaacagaguccccaacuagagauacgcguucaaggcgccaguaguucagcggccccuccuacacucaacccagccccacagaagagcgcagcaccuggcacugcaccugaagaagccccuggcccccuuccacccccacccacacccucgucugaagauccaggauuuucgagcccucucgguaugccagacccgcaccuuuaccaccaaauggguuugcugcugaaacacaugcaagauguuagggugcuucugggccaccugcuuauggaguuacgagaacugucuggucacaggaagccugguaccacuaaagcaaccgcggaauag

SEQ ID NO: 14012 - RNA, 738 nt, Artificial Sequence
  Description of Artificial Sequence: Synthetic coding sequence
augucgcgacuccgcgccuugcugggcuugggccuauuagucgcugggucccgggucccgaggauuaaaagucagacgaucgccuguagguccggccccacaugguggggaccccagagacugaauagcgggggcagaugggauuccgaggucauggcaucuacaguggugaaauacuugucacaagaagaggcucaagcggucgaucaagaguuguuuaacgaguaccaguuuucgguggaucagcugauggaauuggcaggauugucuugugcuaccgccauagccaaagcuuaccccccuacaucuaugaguaggaguccuccaacuguccuagugauaugcggucccggcaacaauggaggugacggccuggugugcgcuagacaccucaagcuguucggauaugaaccuacaauauauuaccccaagagacccaacaagccccuguuuaccgcacuaguuacucaaugucagaagauggauauucccuuccucggcgaaaugcccgcugaaccuaugaccaucgaugaacucuacgaacucgugguugaugcaaucuuuggauuuuccuucaagggggaugugagagagcccuuccacaguauuuuaucugugcuuaaaggccuuacuguaccuauagcuucuaucgacauuccaaguggugccggaauccagaagguagguugggguagacugggaccauauccgccagacucuuguccucaucaagucuag

SEQ ID NO: 14013 - RNA, 783 nt, Artificial Sequence
  Description of Artificial Sequence: Synthetic coding sequence
augagccgccugagagcccuauuaggacuaggccuguuaguggcuggaagcagagugcccagaauuaagucacagacuauugcaugucgaagugggccuaccugguggggaccccaacgacuuaauucagggggaagaugggauagugagguuauggcaucaacagucgugaaauaucucucgcaggaagaggcccaggcaguggaccaggaacuguuuaaugaguaccaguucaguguugaucaauugauggaacuggccggcuugaguugcgcgacagcaaucgcuaaagcuuauccuccuacaagcaugucuaggucccccccaacuguccuugucauauguggucccgguaacaauggaggagauggccucgugugcgcccggcaucuuaaauuauucggcuaugaacccacgauuuauuacccaaagcggcccaacaagccauuguucacagcccuugugacccagugccaaaaaauggauauaccuuuucugggagaaaugccagccgagcugcaaggcagauguagcgggacaguuccucagcaucccgagugucccgagggaacccauugcgcacauugccagcacagacacaguuugcgcaugggacgaggcgaagggaaauguuggcgcgacccggcccgccuugcacacaucccccacucuccccagaaaaucugcaaucccguguaccgaagccugccacugccugggggcucuuuuugugcuacaugcuccggugaagaaguuccugccgaaccugcaacccuuccuuag

SEQ ID NO: 14014 - RNA, 867 nt, Artificial Sequence
  Description of Artificial Sequence: Synthetic coding sequence
auguccagacugagggcuuugcucgggcugggccuucuuguggcaggcucccgcgucccacgcaucaaaagccaaaccauagcaugcaggucaggucccaccuggugggggccacaacgucucaacuccggcggacgaugggacagcgaaguaauggccucaacgguuguaaaguaccuaagucaggaagaagcccaggcuguugaucaggaacuguuuaaugaguaccaguuuagugucgaucaacugauggaacuggcuggcuugucaugugcaacugcuauagcgaaagcauacccuccaacaucuaugucaagaucuccacccaccguccuagugaucuguggcccugguaauaauggaggcgauggcuuggucugcgcaaggcaccugaaacuguucggauaugaaccaacgaucuauuauccuaaaagaccaaacaaaccacucuucaccgcgcuggugacucaaugucagaagauggauaucccguuucugggcgaaaugcccgccgaaccuaugaccaucgacgagcuuuacgaauugguagucgaugcaauauucggauucucuuucaaaggcgacguuagggaaccauuccauaguauucuguccgugcucaaaggacugacggucccaauagcguccauugacaucccuucggggugggauguugaaaaagguaacgcaggagggauacagccugaucugcugauuucacuuacagcuccuaagaaaagcgcuacccaguuuacaggccgcuaucauuaccugggaggacguuucgugcccccagcuuuagaaaagaaauaucaauuaaaccugccccccuacccagauaccgaauguguauaccgccuacaauag

SEQ ID NO: 14015 - RNA, 879 nt, Artificial Sequence
  Description of Artificial Sequence: Synthetic coding sequence
augcaccugcgguuaauauccuggcuguucaucaucuugaacuuuauggaguacauugggagccaaaaugcaaguagggguagacgucagagacgcaugcacccaaacguuucccagggcugccaaggcggaugugcaaccuguagcgacuauaauggcugucugucgugcaaaccaagauuguucuucgcccuugaaagaauaggcaugaaacagauaggugugugccugagcaguugcccgucggguuauuacggaaccagauacccugauaucaauaaguguacaaaauguaaagccgacugugauaccugcuucaacaaaaauuucuguacgaaauguaagucuggguuuuaucugcauuuagguaagugcuuagauaauuguccggagggacuggaggcuaacaaccauacuauggagugcgucagcaucgugcauugcgaagugagcgaauggaauccuuggagcccaugcacuaagaaagguaagacauguggauuuaaaagagguaccgagacacgcguuagggaaauuauucaacauccauccgcuaaggggaaucuaugucccccuaccaacgagaccaggaaauguaccguucagcggaaaaagugucagaaaggagagcgcgguaagaaaggccgagagagaaagaggaagaaaccuaauaaaggggaauccaaggaggccaucccggacucuaaaucacuggaaagcagcaaagaaaucccagagcaaagagaaaacaagcaacagcaaaaaaagcgaaagguccaagacaagcagaagucuggcauagagguaacccuggccgaaggguuaacaucuguuagucaacgcacacagccuacacccugccggcgcagauaccuauag

SEQ ID NO: 14016 - RNA, 2871 nt, Artificial Sequence
  Description of Artificial Sequence: Synthetic coding sequence
auggagacucaggaacuacggggcgcacuggcucucuugcuccucugcuuuuucaccuccgccucucaagacuugcaaguuaucgaccuucuuacagugggagaaagcaggcagaugguagccgucgccgagaaaaucagaaccgccuugcucacagccggggauauauaucuguuaagcaccuuuagacugccccccaagcagggcggcguguuauucgggcuguacucuaggcaggauaauacuaggugguuagaggcgagcguagugggcaaaaucaauaaaguucuagugcgguaucagagggaagacggaaaaguacacgcagucaaucuccagcaggcaggccuugcugacggccguacgcacacuguacuguugaggcuuagagguccaucacggccuagcccagcucuucaccuguauguggacugcaaacuaggcgaucaacacgccggucuuccugcucuggccccuaucccacccgccgaaguagauggauuagaaauuagaacgggacaaaaagcauaccuccggaugcagggcuucguggagagcaugaaaauuauucuaggcggcaguauggcucgagugggagcauuaagcgaaugcccuuuccaaggugacgaaucaauacacagcgccguuacuaacgcacuucauucaauccugggcgagcaaaccaaggcccucguaacccaguugacgcucuuuaaccaaauccucguggagcugagagacgauauccgagaucaaguuaaagagaugagcuugauacggaacacaauuauggaaugucagguuugcggguuccaugagcagaggagccacuguucaccaaauccaugcuucagagguguagauuguauggaaguuuacgaguacccaggcuacaggugcgggcccugucccccuggccuucaaggaaaugguacucacugcagugauauuaacgaaugcgcccacgccgauccaugcuuuccagguaguaguuguaucaacaccaugccugguuuccauugcgaagcuuguccgcgaggcuacaagggcacacaagucuccgggguggggauugacuacgcgagagcaucaaagcaggucugcaaugauaucgaugaguguaaugacgguaacaauggcgguugcgaucccaauagcauaugcaccaacacagucggcuccuuuaaauguggaccaugucgacugggguuucuuggcaaucagucgcaagguugccugcccgcccgcaccugucacucaccagcucacucuccuugucacauccacgcccauugucucuuugagagaaacggugccguuuccugccaauguaacgucggaugggccgggaaugggaacgugugcgguacagacacagauaucgacgguuaccccgaccaagccuuaccuugcauggacaacaauaagcauugcaaacaggauaauugucugcucacuccgaacucuggccaggaagacgccgauaaugaugguguaggugaccaaugcgacgaugacgcugacggcgaugggauaaagaacguagaagauaacugccgauuguuuccaaauaaagaccagcagaauucggacacugacagcuuuggcgaugccugcgacaacugcccuaacguuccaaacaacgaucagaaagauacugaugggaacggagaaggagaugcgugcgacaacgauguggauggugacgguauucccaauggucuggauaacugcccgaagguaccgaacccacuacagacagaccgugacgaggacggggugggcgaugcgugugauucgugccccgaaaugagcaacccgacucagacagacgccgacucggaccucgugggcgacguuugcgauacgaaugaagacagcgacggcgauggccaccaggauacuaaagacaacugcccucagcugcccaacucaagccaacucgacagugauaaugacggacugggugacgaaugugacggugaugaugauaaugauggaauuccagacuacgugccgccaggacccgauaacugucgacuaguaccaaacccuaaucagaaagauagugauggcaacggagugggagaugugugcgaagacgauuuugauaacgaugccguaguugauccacuggauguuugucccgagagugcagaaguuacucuuacagacuuccgggccuaucagacagucguauuggauccagagggggaugcacaaauugaucccaacugggucguuuugaaucagggaauggaaaucgugcagacuaugaacagugacccaggacuugcaguagguuacacugcuuuuaauggcguugacuuugagggcacauuucaugugaacaccguuacagacgaugacuacgccgguuuuuuguuuagcuaccaggauucagguagauuuuacguugugauguggaaacagacugaacagacguauuggcaggcgaccccuuucagagcaguggcccagccaggguugcaguugaaagccgugacuagcguaaguggcccuggggagcaccuaagaaaugcucuguggcauacuggacacaccccugaucagguaagacuccuguggacagacccucguaaugucggguggagggauaagaccucuuaucgauggcaacuccuucauagaccccagguaggguacauuagggugaagcuuuacgaaggaccccaacucguggcugauucggguguaaucauugauacgagcaugcgggguggccgacuuggaguuuuuugcuucucucaggaaaacaucauaugguccaaucuucaguaccgcugcaaugacaccgugccagaagauuucgagccuuucaggcgccaacuacugcagggaagaguuuag

SEQ ID NO: 14017 - RNA, 1110 nt, Artificial Sequence
  Description of Artificial Sequence: Synthetic coding sequence
augcugccauggcuccucguuuucucagcacucgggauacaggccuggggugacaguagcuggaauaagacacaggcaaaacagguauccgaaggccugcaguaccuguucgaaaauaucucucaguuaaccgagaaggacguaucaaccacugucaguagaaaggccuggggugccgaggccgugggaugcucuauacaguuaacaaccccagucaacguauuaguaauucaucacguacccggauuagaaugccaugaccaaacaguguguucccagagacucagggaacugcaggcccaucacgugcacaacaacuccggaugcgauguugcuuauaauuuccucgugggagacgacggcagaguuuaugagggcguaggauggaauauucagggcgugcacacacagggcuacaacaacauuucacugggguucgcauucuuuggaacuaaaaaggggcauagcccuagucccgccgcauuaagcgccauggaaaaccugauaaccuaugcuguacagaagggacaucuuuccucuuccuacguucagccgcuccugggcaaaggagaaaacugucuagcccccagacaaaaaacuucacucaagaaagccuguccugguguggugccacgcucgguuuggggagcaagagagacacacugcccgcggaugacacuccccgcaaaauauggcauuauaauucacacagcggggcgaaccuguaauaucucugaugagugucgccugcuuguccgugacauucaaaguuuuuacauagaccgacugaaauccugcgauauuggcuauaauuuucuggugggacaggauggugccauuuacgaaggagugggcuggaacguccaaggcucuaguacacccggcuacgacgauauagcacuugggauaaccuucaugggaaccuucacaggaaucccucccaacgccgcugcacuggaagcugcucaagaucugauucagugcgccaugguuaagggcuaucugaccccgaauuauuuacuggucggccacuccgaugucgcccggacucugucacccggccaggccuuguauaacauaaucuccaccuggccccauuucaaacauuag

SEQ ID NO: 14018 - RNA, 675 nt, Artificial Sequence
  Description of Artificial Sequence: Synthetic coding sequence
auggagaaaauaccuuucgucuuaggaggcaaccugcagggcggagaacuagugguggcuuaucccuacgaucuuguacgaagccccuggaaaacucaagagcauacaccuacccccgaugaccacguguuccgauggcuagccuacuccuaugccagcacccaucgccucaugacagacgcccggagaagaguuugccauacugaggacuuucagaaagaggaagggacugugaauggcgccagcuggcacacaguggccggaucucugaaugauuuuagcuaucugcauacuaauugcuuugaguuaucuauuuacgucggaugugauaaauacccacacgagucacagcuuccugaagaaugggaaaauaauagagagagccugaucguguuuauggaacagguccaccgugggaucaaaggcuugguucgugacucacacgggaaggggauaccuaacgcuaucaucagcgucgagggaauuaaccacgauaucaggaccggcagagucagccugcaaaaauuaucacuggcaugucgccgcguaagaugcgcuuuugcccuuagcaguaguagcaccaugaucguacgacccccgcagcccuacggcacagucccucacucaucacccgacccaguuacaaccaagauuucuccucugcgcaacuucuag

SEQ ID NO: 14019 - RNA, 285 nt, Artificial Sequence; identical to SEQ ID NO: 12380
  Description of Artificial Sequence: Synthetic coding sequence

SEQ ID NO: 14020 - RNA, 285 nt, Artificial Sequence; identical to SEQ ID NO: 12381
  Description of Artificial Sequence: Synthetic coding sequence

SEQ ID NO: 14021 - RNA, 1026 nt, Artificial Sequence
  Description of Artificial Sequence: Synthetic coding sequence
augguuccagccgccggggcccugcuguggguucugcuccucaauuugggcccccgcgcggcuggcgcucagggucuuacacagacucccaccgagaugcagagaguaucgcucagguuugggggcccuaugacccgaucguaccgcucaaccgcccguacaggccugccaagaaaaacuagaauuaucuuagaagacgagaacgacgcuauggccgacgcagaucgccuggccggaccagccgccgccgaauugcuagcugcuacagucaguaccggguucagucguucaucugcuauuaaugaagaagacggaaguagcgaagaagguguggugaucaacgcagguaaagacucaaccucuagggaauugccuucagccacaccuaauacugcgggcagcucuuccaccagauuuauugcaaauagccaagaacccgaaauccgucugacaagcagcuugcccaggagccccgggagauccacugaggacuugcccggaagccaggccacucuaucacaauggagcacccccgguucuacacccagccguuggccaucucccagccccacagcaaugccuucgcccgaagaucuaagacuuguacuuaugccuugggguccuuggcauugccauuguaaauccggaacgaugucacggucccggucuggaaagcuccacgggcugucagguagacuacgcgugggagcccugagucaacugagaacagaacacaagccauguaccuaccagcaauguccgugcaaccgacugagagaggaaugcccgcuggacaccucacuguguacggauaccaacugugcgucacagucaaccaccucaacccguacuacaacuacuccuuuuccuacaauucaucugcgcaguagcccuucuuugccuccggccagccccugcccugcucuugccuuuuggaagcguguaagaaucggcuuggaggacauuuggaauagucugucgucuguguucaccgaaaugcaacccaucgaucguaaucaacgcuag

SEQ ID NO: 14022 - RNA, 366 nt, Artificial Sequence
  Description of Artificial Sequence: Synthetic coding sequence
auggaugucuuguuuguagccauauuugcuguaccauugauccugggacaagaguaugaggaugaggaaagacucggagaggaugaauacuaccagguaguguacuauuacaccguaacaccuagcuaugacgauuuuuccgccgacuucacaaucgauuauagcauuuuugaaucugaggacagauugaacagacuagauaaggacaucaccgaagcgauugaaaccacuauaucccuggaaacggcccgggccgaccacccaaagccugucacuguuaagcccguuaccaccgaaccaguggaggaaggauguuacgauucuuuggauggcucauuggcgcgcggaaacuggaaaauuaaauag

SEQ ID NO: 14023 - RNA, 396 nt, Artificial Sequence
  Description of Artificial Sequence: Synthetic coding sequence
auggauguguuguucguugcuauuuuugccgugccauuaauuuuagggcaggaguaugaagacgaagaaagacuuggcgaggacgaauauuaucaaguugucuacuacuacaccgucacuccuucauacgacgauuucagugccgauuucaccauagacuacucaaucuucgagagugaggaucgccucaaccgguuggacaaggacauuaccgaagcaauugaaacuacuaucaguuuggaaacagcuagagcggaucaccccaaaccaguuacugucaaacccgugacaaccgaaccuagucccgaccugaaugacgcuguaucauccuuacguucccccauuccucucuugcugucuugcgcuuuuguucaagugggcauguacuuuauguag

SEQ ID NO: 14024 - RNA, 396 nt, Artificial Sequence
  Description of Artificial Sequence: Synthetic coding sequence
auggacguuuuauuuguggcuauuuucgcugugccuuuaauacuaggacaggaguacgaggaugaggaaagacugggugaggaugaguacuaccaggucguguauuacuauacugugacccccuccuacgaugauuucuccgccgauuuuacuaucgacuacucuauauucgaaagcgaggaucgccuaaaucgucuugacaaggauauuacugaagccaucgaaacaacaauuucucucgagaccgcacgcgccgaucauccuaagccugugacugucaagccagugaccacggagccguccccggaucuaaaugaugcugucucaagccuccgcucucccauuccucuccuacugucaugugccuucguucagguuggaauguacuuuauguag

SEQ ID NO: 14025 - RNA, 312 nt, Artificial Sequence
  Description of Artificial Sequence: Synthetic coding sequence
augagugggagagggaagggagggaagggucuuggaaagggaggagcuaaacggcauaggaagguacugcgggauaauauacaaggaauaaccaagccugccauacguagacuugcgcggcggggaggcgucaagcggauaaguggccugauuuacgaggagacuaggggcgugcugaaaguguuccucgagaacgucauuagggacgcaguaacauacacggagcacgccaagagaaagacugucacugcuauggacguaguguacgcucugaaaagacaggguagaacuuuguacggcuucgggggguag

SEQ ID NO: 14026 - RNA, 312 nt, Artificial Sequence
  Description of Artificial Sequence: Synthetic coding sequence
augucugguaggggcaaggggggaaaagggcugggaaagggaggagccaagaggcaccggaaagugcugagagacaacauucaagggauuaccaaaccagccauucgcagacucgcgcgccgcggaggaguaaagagaauuagcggacucaucuacgaggaaacaaggggggugcucaagguguuccucgaaaaugucauucgggaugcugucacauauacagagcaugcaaaaagaaaaaccguuacagccauggacguggucuaugcacucaagagacagggacgaacacuguacggauucgguggguag

SEQ ID NO: 14027 - RNA, 1404 nt, Artificial Sequence
  Description of Artificial Sequence: Synthetic coding sequence
auguuagguauauggaucguugcuuuccuguucuucgguaccucccgcgggaaagagguauguuaugaacgccuaggaugcuuuaaagacggacugcccuggaccaggacauucuccaccgaacucgugggcuugccuuggagcccugaaaagauuaacacccgguuucugcuauacacgauacauaaccccaaugcauaccaggagaucuccgcugugaauaguucaaccauacaggcuagcuacuucggcacugauaaaaucacgcguauuaacauugcaggauggaaaacagaugggaaguggcagagagauauguguaaugugcuguuacaacucgaggacaucaacuguauuaaccucgauuggauuaauggcagccgagaauacauccaugccguaaauaaucuccgcguagugggugcugagguggcuuacuucaucgauguacugaugaagaaauucgaauacaguccaagcaaggugcaccugaucggacacucccuuggagcucauuuggcaggugaagcuggaagccggauacccggguuagguagaauaaccggauuggaccccgcuggacccuuuuuucauaauacaccuaaggaagugcgacuagacccauccgaugccaauuuugucgauguuauucauacaaacgcagcccgcaucuuauuugaauuaggcgucggaacuaucgacgcguguggacaucuggauuucuacccgaauggcggcaagcauaugcccggaugugaagaucuaaucaccccauuauuaaaguuuaauuuuaacgcguacaaaaaagagauggcuucauuuuuugacugcaaucaugcucgcucuuaccaguucuaugccgaaucgauccucaaccccgaugcuuuuaucgcuuacccgugcagaucuuauacaaguuucaaagccgguaacugcuuuuuuuguucaaaagaggguugucccacaaugggccauuucgcugauagguuucauuuuaagaacaugaaaacuaauggcagccauuauuuccucaacacugguucucuuagcccuuuugcacgguggcgccauaaacugagcgucaaguugucgggcagcgaaguuacacaggggacaguuuuccugagaguggggggggcugugcgaaaaacuggugaauucgcuauuguuuccggcaagcucgagcccggaaugaccuauacuaaacucaucgacgccgacguaaauguaggcaacaucacgaguguccaguucauuuggaaaaagcaucucuucgaagauagucagaacaaacuuggagcggaaauggucaucaauaccuccgguaaauauggauauaaguccacuuucuguagccaggacauuaugggcccuaacauucuccagaaccugaaacccugcuag

SEQ ID NO: 14028 - RNA, 1287 nt, Artificial Sequence
  Description of Artificial Sequence: Synthetic coding sequence
augauuaccgguguuuucagcaugagauuauggacucccgugggcguacuaacuucacuugccuauugccuucaucaaagaagaguagcucuagcagagcuucaggaagcugacggacagugcccugucgaucguagucuacugaaauuaaagauggugcaggugguguuuaggcacggggcgaggaguccccugaaaccgcucccccucgaagagcaaguagaguggaacccgcagcugcuggaagugcccccacagacgcaguuugauuacacagugacaaaccuggcaggcggcccuaaacccuacuccccauacgacagccaauaccaugagacaacucucaaaggaggaauguucgccggccaacucacuaaagucggaaugcagcagauguucgcccuuggagaacggcugaggaagaauuacgucgaggauauuccauuucugucuccuaccuucaauccucaagaaguuuuuauuagauccacaaacauuuuccggaauuuagaaucaacccggugccuccuagcaggguuguuccagugucaaaaagaagguccuaucauuauccauaccgaugaagccgacuccgaaguccucuauccaaacuaccagucuugcuggagucuaagacaaagaacuaggggucgcaggcaaacugcaagccuucagcccggcauuuccgaggaucucaaaaaggugaaggauaggauggggauagauagcucggacaaggucgacuuuuucauacuguuggacaacguugcugcggaacaagcccauaaccuucccuccugccccaugcugaagcgauucgcgcgaaugauugaacaacgagcuguggauacauccuuguauauccuuccaaaagaagaccgcgagucucugcaaauggcggucgggccuuuucuccauauacucgaaucuaaucuccugaaggcuguggacucggcuaccgcaccagauaaaaucagaaaacuauaccuuuacgcugcucacgacguuaccuuuaucccccuccucaugaccuuggguauuuuugaccauaaguggccaccuuucgcggucgauuugacaauggaacucuaccaacaucuugagucaaaagaaugguucguacaacuguauuaccacgguaaggaacaggucccccgcggaugucccgacggacuaugcccccuggauauguuucugaaugccaugagcguauacacacuuucgccagagaaauaccacgcccuguguucccaaacucaagugauggaagucggaaaugaggaauag

SEQ ID NO: 14029 - RNA, 711 nt, Artificial Sequence
  Description of Artificial Sequence: Synthetic coding sequence
augugcguaacauaccacaauggaacuggauacugcaagugccccgaaggauuucucggcgaauauugucagcauagagacccgugcgagaaaaauagaugucagaauggcgggaccugcguggcucaggcaaugcuugggaaagccacuuguaggugugcuuccggguucacaggggaagauugccaguacucuacuucacacccauguuuugucucuagacccugucugaauggaggaaccugccacaugcucucgcgagacacauacgaaugcacaugccagguuggauucaccggaaaggagugucaguggacagaugcaugucuaagccacccuugcgccaauggcuccaccuguacaaccguugcgaaucaauucucuuguaaaugccucaccggguucacaggccaaaaaugcgaaaccgaugugaaugagugcgauaucccaggacauugucagcauggcggaaccuguuuaaaccucccuggaucauaucagugucagugccuccaaggauucacuggucaauacugcgacagucuguacgugccaugugcaccgagucccugcgugaacggcgguacaugcagacagacgggagauuucacuuuugaauguaauuguuugccugaaacaguuaggcggggaacagagcugugggaaagggauagggaaguguggaacggaaaagaacaugaugaaaacuag

SEQ ID NO: 14030 - RNA, 990 nt, Artificial Sequence
  Description of Artificial Sequence: Synthetic coding sequence
auggugaccaaagcauuugugcuccucgcaauauuugcagaagccucagcuaaaucaugcgccccaaauaaagccgauguuauucuuguguuuuguuacccuaagacaaucaucaccaaaauuccggaguguccauacggcugggaaguccaccaguuggcccucggcggauuguguuauaacggaguucacgaaggcggcuauuaccaguucgugaucccggaucugucuccaaagaauaagucauacugugggacucagucugaguauaagccuccaauuuaccauuuuuacucacauauagugaguaacgauaccacagucauagugaaaaaccagcccguuaacuacucuuucuccuguacuuaucauucgacauacuugguaaaucaagcugccuuugaucagagaguugcuacugugcacgugaagaaugggagcauggggaccuuugaaucucaacucagccugaauuucuacacaaacgcaaaguucuccaucaaaaaggaagccccuuucguacuagaggccucagaaaucgguucggaccuauucgccggcguggaagccaagggacugagcauucguuucaaaguaguauugaauuccugcugggccacacccucugcugauuucauguacccacugcaguggcagcuaauuaacaaaggauguccuacagacgagaccgugcugguacacgagaaugggagagaccauagagccaccuuucaguucaaugcuuucagauuccagaacaucccgaaacuuucuaagguuuggcugcauugugaaaccuucaucugugauagcgaaaaacuuucgugccccgugacaugcgauaaaaggaagcggcuucuuagagaucaaacuggaggaguuuuggucgucgagcuuucccucagaucccgagguuuuucuucgcuguauucuuuuuccgaugugcuacaccaccuuaucaugaugcugggcaucugcgcuguccucuag

SEQ ID NO: 14031 - RNA, 1161 nt, Artificial Sequence
  Description of Artificial Sequence: Synthetic coding sequence
auggcacaauggcacuguucgcagcgaacccaagcugggggccacggagucggagagagacuggcgcaaugccaagaucaguccuccaggcacgccgcagaacugcgggacuuuaaaaauaaaauguugccccugcuggagguggccgaaaaggaacgugaagcgcugaggaccgaggcugauacaauuuccgguagaguggauaggcuggaacgggagguggacuaucuagagacacagaacccugcucuaccaugcguugaauuugaugaaaagguuaccggcgggcccggaacuaagggcaagggaagacgcaacgagaaauacgauaugguuaccgauuguggcuacacuauuucccaaguuagaucuaugaaaauauugaaaagguuuggcggaccugccggccuguggacaaaagacccgcucggccagaccgagaagaucuacguccuggauggcacacaaaacgauacagcuuucguguuuccaagacuacgcgauuucacucuggccauggcagcgagaaaagcaagcagaguucggguaccauuuccuuggguggggacuggccagcugguguacggcggcuuccucuauuuugcacgccggcccccaggcagacccggaggaggcggagagauggaaaauacccugcagcuaaucaaauuccaccuggccaaucggacaguugucgauucgucuguguuucccgcagagggcuuaauaccaccauacggacugacggccgauacauauauagacuuagccgcggaugaggaaggacugugggccguuuacgcuaccagggaggacgauagacaucuaugccucgccaaauuggacccacagacccuggauaccgagcagcaaugggacacacccuguccgcgggaaaacgcagaagccgcauuuguuaucugcgguacccuguaugucguguacaacacccgccccgcuagucgggccagaauacaauguuccuuugaugcuuccggcacccuuacacccgagcgggccgcccuucccuauuucccccgaagauauggagcgcacgcuucauuaagauauaacccccgugaaagacagcuguaugcaugggacgacggauaccagaucguguacaagcuagaaaugagaaagaaagaagaggagguguag

SEQ ID NO: 14032 - RNA, 510 nt, Artificial Sequence
  Description of Artificial Sequence: Synthetic coding sequence
auguccgaacgcguggaaagaaacugguccacaggaggcuggcuucucgcgcugugccuggccuggcuguggacucaccugacacuggccgcccuccagccaccgacagccaccguauugguccagcaaggaaccugugaaguuauugccgcucaccguuguuguaaccggaaucgaauugaggagagaucccagaccgugaaauguaguugcuucagcggucagguugcugguacaacucgcgcuaagcccaguuguguggaugaccugcuguuggccgcccauugcgcuaggagagacccucgggcugccuuaaggcuccugcucccacaaccccccuccucuugccgcgacggaggugugagguggucuccugcuugccgcggcagaucgguacgcugcucaaggacauguagagacggagccgccgcuguugauacaaaauccaaaccccccagaucacacgauuccaguuggggcucuagaccuggccaggaaaggcuggauuag

SEQ ID NO: 14033 - RNA, 693 nt, Artificial Sequence
  Description of Artificial Sequence: Synthetic coding sequence
augcguuuggcugguccacuacguauagugguucucguaguuaguguagguguuacguggaucguugucaguauccugcuugguggacccgguagcggauucccucggauccaacaguuguucaccucuccagagucaagcgugacggcagcgcccagagcuagaaaauauaaauguggccugccacagccuugcccagaagaacaucuugcuuucagagugguuuccggagcagcuaaugucaucgggccgaagauuuguuuggaggauaaaaugcucaugagcucaguuaaggacaauguaggaagaggacucaacauugcuuuggugaaugguguaucaggugaguugauagaggcaagagccuuugauaugugggcaggagacguuaacgaucugcuuaaauuuauuaggccacugcaugaaggcacacuggucuuuguugcgagcuacgaugacccagcaacuaagaugaaugaagaaacgagaaagcuguuuagcgaacucgggagcagaaacgccaaagagcuggcauuuagggacucauggguuuuuguuggagccaaaggugugcagaacaagucaccguucgaacagcacgugaagaauucgaaacacucaaacaaguaugagggcuggccagaggcucuggaaauggaaggaugcauaccaagacgaucuaccgcuaguuag

SEQ ID NO: 14034 - RNA, 1176 nt, Artificial Sequence
  Description of Artificial Sequence: Synthetic coding sequence
augcuucggcccgguggagccgaggaggccgcccagcuuccucugcgaagggccuccgcuccagugccagugccuaguccggccgcaccagacggauccagagccuccgcuagacuuggacucgcuugcuugcuguuacuccuuuugcuaacgcugccugcacgagucgauacuucuuggugguauaucggcgccuuaggagcucgugugaucugcgacaacaucccuggauuagugagucgucagcgccagcugugucagcguuacccagacauuaugcgcucugucggcgaaggagccagggaauggauccgggaaugccagcaccaguuuagacaccaccgauggaauugcaccacacuagacagggaccacaccguuuuugggcgcguaaugcugagaaguucucgggaagcugcuuucguguaugcaaucaguucagcuggcgucgugcaugcuaucacccgagcuugcagccagggcgaauuaucuguuugcuccugugaucccuacacuagaggaagacaccacgaccagagaggagacuucgauuggggaggcugcagugacaacauccacuacggcguucgcuuugccaaagcguucguagaugccaaggagaaaagacuaaaagacgccagagccuugaugaaucuacacaauaacagaugcgggaggacagcaguuaggagauuucugaaguuggaaugcaaaugccacggcgucagugggucuugcacccugagaacuuguuggcgagcucucagcgacuuucguagaacuggugauuaucuuagaagacguuacgauggagcugugcaggucauggcuacccaagauggugcaaauuuuacagccgcuagacagggcuaccggcgcgcuacaagaaccgaccugguguauuucgacaacuccccugacuauugcguacuagauaaggcugcuggcucucuggguacggcuggcagaguguguuccaagaccucuaagggcacagacggaugugagaucauguguugcggacggggcuaugacacuacuagagugacucgugugacccaaugcgagugcaaguuccauugguguugugcugugagguguaaggaauguaggaacacaguagacgugcacaccugcaaggcgccgaagaaggcugaauggcuugaucagaccuag

SEQ ID NO: 14035 - RNA, 1119 nt, Artificial Sequence
  Description of Artificial Sequence: Synthetic coding sequence
augcucgaugggcucgguguuguggcuauuucaauuuuugguauucaauuaaagacggagggauccuugagaacugcugucccagguauuccaacucagucugccuuuaauaagugucuacagagauacauuggcgcccuaggagcucgagucaucugugauaauauuccuggccuugugucucgccaacgccaacugugccaacguuauccagauauuaugagaucagucggcgaaggagcaagggaauggaucagagagugucagcaucaauuucgucaucaucgcuggaauugcaccacacuugacagggaccacaccguuuucggccgugugaugcugcgcagcucacgagaagccgcguucguguacgcaauuuccucugccggagugguacacgcgauaacccgcgccuguucccaaggagaacucagugucugcucaugugaucccuacacucgggggcgacaucacgaucagcguggggacuuugacuggggagguuguucugacaacauccacuacggagugcgauucgccaaagcauucguggacgccaaggagaagcgacugaaagaugcacgcgcucuuaugaaucugcauaacaacagaugcggaaggacggcugugcgucguuuccugaaacuggagugcaagugccacggagucucaggaucuuguacucuacggacuugcuggagagcccugucagacuucagacgcacgggggacuacuuacguagacgauaugauggcgcaguucaggugauggccacacaagacggagcuaacuuuaccgcugccaggcaaggcuaucgcagagcuacucgcaccgacuuaguauacuucgauaacucuccugacuacugcgugcuggauaaggcagcaggcucacugggaaccgcagggaggguuuguaguaaaacuagcaaagguaccgauggaugcgaaaucaugugcugcggaagaggauaugacacuacuagaguaacucgggugacgcaaugcgagugcaaguuccacuggugcugcgcagugagaugcaaggaauguagaaacaccguggaugugcauacuuguaaagcaccuaagaaagccgaguggcuggaucaaacauag

SEQ ID NO: 14036 - RNA, 1242 nt, Artificial Sequence
  Description of Artificial Sequence: Synthetic coding sequence
auggaaaauaugcuauuguggcugaucuucuuuaccccugguuggacgcugaucgacggcucugaaauggaaugggauuucauguggcaccugaggaaagugccuaggaucguuucagagcgaacguuucaucucaccucuccugcuuucgaagccgacgcuaaaaugauggucaauacagucugugggauagaaugccaaaaggaguuacccaccccaagucucucggagcuugaggacuaucuuucguacgagacaguauucgagaauggaacccgaacucuuaccagagucaaagugcaagaccucgugcuggagccaacccagaacauuacaaccaaaggaguuagcgugagacgcaagaggcaaguguauggaacagacucacgauuuucuauccuugacaaacgauuccugacgaauuuuccguuuucuacugcugugaaacuuucaaccggcugcuccgguauucuuauaucaccccagcacguguugaccgccgcccacugcguucacgacggcaaagauuauguuaaagggucaaaaaagcugcgcgugggacugcugaagaugaggaacaaaucugguggcaaaaagagaaggggcaguaaacggucccgucgggaagcaagcggaggcgaucaaagagaaggaaccagagaacauuuacgagagcgggcaaagggggggcggaggaggaaaaaauccggacgaggccagagaauugcagaaggacgcccuagcuuccaguggacucgggugaagaacacacauauuccaaagggaugggcccgugggggaaugggcgaugcgacccuugauuaugauuaugcacuguuggaacuaaaacgggcacauaagaaaaaguauauggaacugggcaucagucccacuaucaaaaaaaugccugguggaaugauacacuucagcgguuucgauaacgacagggcugaucagcuaguguauagguuuugcuccguuuccgaugagucuaacgaucuccuguaccaauauugugaugccgagucgggcucaacuggcaguggcgucuaccuacgccucaaggauccagacaaaaaaaauuggaagagaaaaauaauagcaguguauagcgggcaccaguggguugauguacauggagugcaaaaagacuacaacgucgcggugaggaucaccccccugaaguaugcccaaauuugucucuggauccaugguaacgacgccaauugugcuuacggcuag

SEQ ID NO: 14037 - RNA, 1143 nt, Artificial Sequence
  Description of Artificial Sequence: Synthetic coding sequence
augggcgccaccacuauggaucagaaaucacucugggcuggaagugccuacaaacucguaugcuauuuuacuaacuggucacaagaucgacaggaacccggcaaguuuacacccgagaacaucgacccuuucuuaugcucccaccugaucuacagcuuugcuuccauagaaaacaauaaggugauuauuaaagacaagucagaaguaaugcucuaccagacuauuaauagccuuaaaacuaagaauccaaaacucaaaauucuccugucaauuggaggauaccuauucgggaguaagggauuucacccuaugguggacucaaguacaagucgccucgaguuuauuaacagcaucauacuuuuucugcgcaaucacaauuucgaugguuuagacguguccuggaucuauccugaccaaaaggagaauacccauuucacaguccuuauucaugaauuagcugaagcauuccagaaggauuucacuaagagcacaaaggaacgccucuuauuaacugcuggaguauccgccgggcggcagaugaucgauaacagcuaccagguggagaaauuggcaaaagauuuagacuucauuaacuuacugaguuucgauuuccacggcucaugggaaaaaccucugauuacgggacauaauucuccccuuagcaaaggauggcaagaccgcggacccucuucauauuauaauguugaguacgcuguuggcuacuggauacauaagggcaugccaucugagaaggucgucauggggaucccaaccuauggucacucauucacccuggcgucugcagaaacuacugugggggcuccagcaaguggaccaggcgcugcgggaccaaucacggagucgucuggguucuuggccuacuacgaaauaugucaguuccugaagggcgcuaaaaucaccagacuacaagaucagcaagugccuuaugcuguuaaagggaaucagugggucggauacgacgaugugaagagcauggagacaaaaguccaauuucucaagaaucugaaucugggaggagcuaugaucugguccaucgacauggacgacuucacaggaaagucaugcaaccagggcccuuauccucucguucaagccgucaagcgcagccuggguucacuguag

SEQ ID NO: 14038 - RNA, 1173 nt, Artificial Sequence
  Description of Artificial Sequence: Synthetic coding sequence
augggagccaccaccauggaccagaagucacugugggccgggguuguuguucucuuauugcuucagggaggaagugcuuacaaacugguuuguuauuucacuaauuggucacaggauagacaggaaccaggaaaguucaccccagaaaacaucgauccauuucuguguagccaucugaucuauagcuuugcaagcaucgaaaacaacaagguaaucaucaaggacaaaagcgagguuaugcuguaucagaccaucaacucauuaaaaacuaagaauccuaagcuuaaaauacuucugaguauaggcggcuaucuguucggauccaagggcuuccaccccauggucgauucauccaccagcagacuagaauucaucaacucuauuauccucuuccuccgcaaucauaauuucgacggacuugaugugagcuggauuuauccggaccagaaggagaacacacacuuuacuguucugauccacgaacuugcugaagcuuuccagaaggacuuuacgaagagcacuaaagagcgccuucugcuaacagccggggugucagcgggaaggcagaugaucgacaauuccuaccaggucgaaaaacucgccaaagaucucgacuuuauaaaccuacucaguuucgauuuccacggcucaugggagaagccgcugauuacaggucacaacagcccccugaguaaagguuggcaagaucgggguccaucuagcuacuauaacgucgaguacgccguuggguacuggauucauaagggaaugcccucugagaagguaguaauggguaucccaaccuacggacauucuuuuacccuagcaucugcugagacuaccguuggagccccugccucuggcccuggcgccgcugggccuaucacugaaaguucaggauuccuugcuuacuaugaaauaugucaguuccuuaaaggcgccaagauuacacgccuucaagaucaacaggugccauaugcugugaaagguaaucagugggugggauacgaugacgucaagaguauggaaacgaaagugcaguuucugaagaaccugaaucuuggaggggccaugauuuggagcaucgauauggacgacuucaccggaaaaagcuguaaucaaggcccuuacccccucguccaggccguaaagcgaagcuuagguagucucuag

SEQ ID NO: 14039 - RNA, 2202 nt, Artificial Sequence
  Description of Artificial Sequence: Synthetic coding sequence
auggcgggcggaagagaaacgugucucccacucaucggcuuuauccuaauuugucugaagauggucgccuccgcuaagagcgcacccgaaaucccuacgaucgaucaggcuuacucuaagcucuccaacuccauuacuguagaaugggccaccgugccuggugcaacgucauauuugcuuaccgcagaagacggcgauacggucaucgagacaacaguugcaaauucccccgguaccgugaccggacugaaggcggccacaugguacgaaaucacuaucagauccaucucggccgcugggagaucacaagcgagccccccuaagcaagcgaagaccguguuggcugcgcccauucuggaaguuagcagccccuccucugacagcauccugguccagugggaagccguguauauggcaaucgccuucucagugaguauuaugcgcgccaauggacucggcaguauuuggaaggaaaacaccacuaauaccucccuuacauucacaucccuggaagcuggaacucuguauacaauuaaagcauacgccuggaacgcuaaccggauaccaggagaugauucaaccugcaaccaaagaacguccccccgcgccccagcuaacauacaagucucuuucgauuccggugcccucaaggcuaguuucaguugggccagagcggaaggggcauucaauuauaccgucauggcucuuagcgauucaucagagcucaccuguucaacaacauuuuccagcugcacuaucucgucccugcagugcggcaccgaauacuuaaucagcguguuggcgaguaacgacgccggguccaguaagucaagcucagcaaugacacugaaaacagucgcgugugcacccggaagagugacuauccaagaagacccgccaggacaccucagcguugccuggaguuccgucgaucuuggggauuauuacguuguguucgucaaauccgacgacggccuggagguacacugcaacaccuccuugacccagugcaacuuucuuagcgaaugcgguuuuacuuacuuuaucagcguauuuguguacaacaaagcgggucaguccccuuuaggugacauuuuuaacuauacuacggcgccuugcuguccuuccgauauaaauccaguccuuguguccucagaucgcguagagauugugugguccccggugagaggggcagaacucuaugaaacuaaggcaguagacgguuacaacauggucgaauguaaugacaccacacccgcaugcacccucucagcacucgagugugauacuaaauauaauauaacaguauacagcuucaacgaaguucgaggcagcaauaugucgugcaccccucaguuuaucaccaccgcaccaugcuccccagaaauuaaaaacguguccagagacgcauuuagcaugauuaacgugcauuggagaucgacaaacgaugacgcaaccuacacgguuaccgcacagggugagaaaggacuuuaccagugcaguucuaccggggagagcugcaccaugaggggccucccaugcgguagcguguuuagcgugacagcaguugccgaaacccaagcugguaggucccugccuucauacucggugccauuagagacagucccaugcuguccuacuggacucacugugacccaaaucacccaauccguuaucaacgucucauggacuaucggccguguggcacaaacucacguagcugucuuagaaucccauaccggccaaucaaaaugccacacccaccagaaucacugcuugcuuggcuguaucacuugcggaaucaacuacacugucacucugaaagccaucucugcuaccggucucaccgcugauugcagcuaccaaucuuacuucagcggagccugcuguccacuaggggucaaacuguacagacuuggccccaacggaauacgcauauacuggcaagcuucacgagggucugcuaauuacucaaccgaccucuacggcuccaaagggauuuuuaccuguaccccaucugcuggcuugucguucugcgaugugaccgaaaucccaugcggcgacguguauaccgucauggucucuccuguugccaaaacaggccucaaacugacuuuuugcccuaaaaaaauuuacucugugacauguucugguagcacacucggaauggugauuuaucgggguaagcggaacgaagaauag

SEQ ID NO: 14040 - RNA, 555 nt, Artificial Sequence
  Description of Artificial Sequence: Synthetic coding sequence
augagaggccaggggcguaaagaaucccugagcgauucacgcgaucuagaugggucuuacgaucaacugacagauucuguggaugacgaauuugagcucucaacagugugccauaggccagaaggacucgaacagcugcaggaacagacuaaguucaccagaaaggagcugcaggugcuauaucgcggguuuaagaacgaaugcccgagcggcauugugaaugaggaaaacuucaaacaaauauacagccaguuuuucccucaaggcgacucaucaaccuacgcuacauuuuuguuuaacgcauucgacaccaaccaugacggcuccguuuccuuugaggaaaugcuggacaucaugaagucuauuuacgauaugaugggcaaguacaccuacccugcacugcgcgaagaggccccucgagaacacgucgagaguuuuuuucaaaaaauggaucguaauaaggacggcguaguaacuauugaagaauuuaucgagucuugucagaaagaugagaacaucaugagaucaaugcagcucuuugauaacgugaucuag

SEQ ID NO: 14041 - RNA, 759 nt, Artificial Sequence
  Description of Artificial Sequence: Synthetic coding sequence
augcgugggcagggaagaaaggagagucugagcgauucccgagaccuggauggaucuuacgaccagcucacuggacacccaccaggccccacuaagaaggcucuuaagcaaagauuccucaaacugcucccguguugcgguccacaggcucuccccucgguuucagaaagcaauguggacgacgaauucgagcuaaguacugugugccacaggccggaagggcuggaacagcugcaggaacagacuaaguuuaccaggaaagaguuacaagugcuguaucguggcuuuaaaaaugaauguccaagcggcaucgugaaugaagaaaacuuuaaacagauuuauucccaauuuuucccacagggagacaguuccacauaugcaacauuuuuguucaacgcguucgauacaaaucacgacggaagcgucagcuuugaagauuuuguggcuggucucagcguaauucuccgcggcacagucgacgaccguuugaauugggcuuucaaccuguaugacuuaaacaaggacgguugcauuacuaaagaagaaaugcuugauauuaugaaaucaauuuacgacaugauggggaaguauacauacccagcacucagagaagaggcucccagagaacacguggaaucauuuuuucagaagauggaucggaauaaagauggcguggugaccauugaagaauuuaucgaauccugccagaaggacgagaacauuaugagaaguaugcagcuguuugacaacgucaucuag

SEQ ID NO: 14042 - RNA, 1377 nt, Artificial Sequence
  Description of Artificial Sequence: Synthetic coding sequence
augcaggcuaccuccaauuugcugaaccuucuucuccuuucccucuucgcgggccucgacccuucuaagacacagaucaguccaaaagaaggcuggcaaguguacucaagcgcccaggacccagauggcagguguauaugcacugucguugcucccgagcagaaucugugcagcagggacgccaaaucccgccagcuuagacaguuacuagagaaaguacagaacaugucucaguccauagaaguuuugaaucuuagaacucagcgugacuuccaguauguguuaaaaauggaaacucagaugaagggauuaaaggcaaaauucagacaaauagaagaugaccguaagaccuuaaugaccaagcacuuccaggaauugaaagaaaagauggaugagcugcugccccugauuccugugcuagaacaguacaagaccgaugcaaaguuaauuacacaauuuaaagaggagauacggaacuuaagcgcaguucugacaggcauucaggaggaaaucggugcguacgacuacgaggaacuacaucagaggguucugucgcuggaaacacggcuucgagacugcaugaaaaaacugacuugcggcaaguugaugaagauaacugguccagucacugugaagacuagcgggacaagguucggagccuggaugaccgacccacucgcaucagaaaaaaacaauagagucugguacauggacagcuacacaaacaauaaaaucguucgggaauacaaaaguaucgcagauuuuguguccggcgcagagagcaggacguacaaucuuccuuucaaaugggcggguaccaaccacguaguuuacaacgguagccucuacuuuaacaaguaccaaucaaacaucaucauaaaauacagcuuugacaugggcagaguccuugcacagcgcucuuuagaauaugccggguuucacaacguguauccauacacauggggcggcuucucugacaucgacuuaauggcagacgagauagggcugugggcuguauacgccaccaaccaaaaugccgguaacaucguaauaucacaacucaaccaagauacacuggaagucaugaaaagcugguccacgggauauccuaagaggucagccggcgaaucuuucaugauauguggaacccuguacguaaccaacagucaccucaccggagcuaaaguuuauuauucauauucuacaaaaaccuccacuuaugaauauacagacauccccuuucacaaucaguauuuccauauuaguauguuggauuauaaugcccgcgaucgagcuuuauaugcauggaacaacggccaccagguucuguuuaaugucacuuuguuccacaucauuaagaccgaagacgauacauag

SEQ ID NO: 14043 - RNA, 915 nt, Artificial Sequence
  Description of Artificial Sequence: Synthetic coding sequence
augcugccuccuccucguccugccgccgcgcuggcacuacccgugcuacuguugcuguugguaguucucacucccccuccuacaggcgcucggccaaguccuggccccgauuauuugagacgcggauggaugcgccugcuagccgaaggcgaaggaugcgcccccugccguccagaagagugugccgcaccacguggaugucucgcaggccggguuagagaugcgugcggcugcuguugggaaugcgccaaucucgagggucagcucugugaccuagaucccucugcucacuuuuauggccacugcggggagcagcuggaaugccgccuggacaccggaggcgaccuaucgcgaggagaaguaccagagccgcuuugcgcauguagaagucagaguccucuguguggaucugauggacacaccuacucccagauuugucgacugcaggaagccgcuagagcaaggcccgacgcaaacuuaacggucgcacaucccgguccaugcgaguccgguccucagauagucagucauccguacgacacuuggaacgugaccggccaggaugugauuuucgggugcgagguuuuugccuaucccauggcgucgaucgaauggagaaaagacggacuugauauccagcuccccggugaugauccccauauaagugugcaauucagaggaggaccacaaagguucgaggugaccggcuggcugcagauucaggcugugagaccaagcgaugaaggaaccuauagaugucuggggaggaacgcccugggccagguggaggcccccgccagucugacuguucugacacccgaccagcugaacagcaccgggaucccccaguugcgcucccugaaccuggugccagaagaagaagcagaguccgaagagaaugaugauuauuacuag

SEQ ID NO: 14044 - RNA, 327 nt, Artificial Sequence
  Description of Artificial Sequence: Synthetic coding sequence
augacuccuucaaggcugcccuggcugcuaucuugggugucagcaacagcauggcgcgcugccagauccccacuguugugccauagccuacgaaagacaagcucuucccagggaggcaagagcgaacugguaaagcagagccugaagaaaccaaaacuuccagaggguagguuugacgcaccagaggacucucaccucgaaaaggagccccucgagaaauucccggaugacgugaacccuguaacaaaggaaaaaggagguccccguggcccagagcccacuagauacggcgauugggaaagaaagggccgauguauugauuuuuag

SEQ ID NO: 14045 - RNA, 663 nt, Artificial Sequence
  Description of Artificial Sequence: Synthetic coding sequence
auggcugggcuuucacgcgguucugcccgcgcauuacuggccgcccuacuggcgucaacauuacuggcucuguuagugucgcccgcucguggacgugggggccgugaccacggggauugggacgaggccagcaggcuuccaccucuuccacccagggaagacgcugcucguguugcacgcuucguaacacacgucucugacuggggagcauuggcuaccauaagcacacuggaggcuguuagaggcaggcccuuugcagacguauuaucccucuccgauggcccuccuggggcaggcucuggcgucccguauuucuaccuguccccgcuccagcuuuccguguccaauuugcaagagaacccuuaugccacauuaacaaugacauuggcgcagaccaauuucugcaaaaaacacggcuucgauccucaguccccucugugcguccauaucaugcuuucuggcacugugaccaaggugaacgaaaccgagauggauauugcaaagcauucucuguucauucgacauccggagaugaaaacauggccaagcucucacaacugguuuuucgcgaaacugaauaucacgaacauuuggguucuggauuacuuuggcggccccaagaucgugacuccugaggaauacuauaacgugaccguucaauag

SEQ ID NO: 14046 - RNA, 2760 nt, Artificial Sequence
  Description of Artificial Sequence: Synthetic coding sequence
augggucuguuccgcggauuugucuuucugcuaguccugugccugcuccaucagaguaauaccucauucauaaaacugaauaauaacggauuugaggacaucgugaucgugaucgacccuuccguccccgaggaugaaaaaauaaucgaacaaaucgaagauauggugaccacagccagcacauacuuauuugaagccacugaaaaaagauuuuuuuuuaaaaauguaagcauccuaaucccagagaauuggaaggagaacccacaguacaaacgucccaaacaugagaaccauaagcacgcagacguuauuguggcuccaccaacucucccuggacgggacgagccuuauaccaaacaguuuaccgaauguggugaaaagggcgaguacauacauuucaccccugaucuauuacugggaaagaagcagaacgaauauggaccaccugggaagcuguucgugcaugaaugggcgcaccugcgauggggaguguucgaugaauacaacgaggaccaacccuuuuaccgagcuaaaucgaagaaaaucgaagcaacaagaugcagugcuggaauuucgggcagaaaucgcguuuauaaaugccaggggggauccugucuuagccgcgccugccgcaucgauuccaccacgaagcuuuauggaaaggacugccaguuuuucccugacaaaguacagacugaaaaggcuuccauuauguuuaugcaaucuauugacucuguaguagaguucugcaacgagaaaacccauaaccaagaggcucccucccugcaaaacaucaaguguaacuuccggaguacaugggaaguaaucagcaauuccgaagauuucaaaaauaccauuccuauggugaccccaccucccccuccuguuuucucacuacuuaaaauuagucagcgaauagugugccucgugcucgauaaaucagggucaaugggcgggaaggacagguuaaacaggaugaaccaggcagcgaaacauuuucugcugcagaccguggaaaauggaucuuggguagggaugguacacuuugauuccaccgcaaccaucgucaacaaacuuauccagauuaaaagcucagacgagaggaacaccuuaauggccggacucccaacguauccccucggcggcaccucuaucugcagcggcauuaaauaugcauuccaggugauuggggaguuacacucccagcucgauggaagugagguacuucucuuaaccgacggcgaggauaauacagcaagcaguugcauugaugaagugaaacaaucuggugccauugugcacuuuauugcacugggaagagcugcugaugaggccgugaucgagaugagcaaaauuacaggcgguucccacuuuuaugugagugacgaagcccagaacaacggccugauugaugcauucggagcacucaccucaggcaauacugaccugucgcaaaaaucucuccagcuggaaaguaaaggauuaacucucaauuccaacgccuggaugaaugacacuguaaucauugauuccacaguaggcaaagauacuuuuuuucucaucacauggaacucucucccccccuccauuucucuuugggauccaucgggaacaauuauggaaaacuucacuguggacgccacuuccaaaauggccuaccuguccauacccgguaccgcuaagguggguacaugggccuacaacuuacaggcuaaagccaacccugaaacacugacuauuacuguaacuagcagggccgcuaacaguuccguaccccccauuacaguuaacgcuaaaaugaacaaagauguuaacagcuucccuucgccuaugaucgucuacgccgagauucuccaaggguacgugcccguguugggcgcaaacguuaccgccuucauugaaucacagaauggccauacagagguccuggagcuccuugauaacggugccggagcagauucuuuuaagaaugacggaguguacucacgguauuucacagccuacaccgagaacggccgguauucauugaaaguuagagcccacggaggagccaacaccgccagacucaaauuaaggccuccacugaacagggcugccuacauccccggauggguggugaauggggaaaucgaagcuaauccaccaagacccgaaauugacgaagauacacaaacaacacuagaggauuucagccggaccgccagcggcggagcuuuugucguaucacaagugcccagccugccccuuccugaccaguauccucccucucaaauuacagacuuagaugccacuguucacgaggacaagauuauucugacguggaccgcuccgggcgacaacuucgacgucgguaaggugcagcgcuacaucauuaggauaucugccagcauacuagaucugagagacaguuucgacgaugcccuccaaguaaacaccacugaucucucuccaaaagaagccaacucuaaggaauccuuugcuuucaagccagaaaacauuucugaagaaaacgcuacccacauuuuuauugccaucaaaucgauagauaagagcaaccuaacuuccaaagucagcaacaucgcucaggugacacucuucauuccccaagcuaacccugaugacaucgacccuacuccaaccccgaccccgacacccacacccgauaaaagccacaauagugggguaaacauuucuacccucguauugucugugauuggaucagucguuaucguaaauuucauacucucuacaacuaucuag

SEQ ID NO: 14047 - RNA, 1938 nt, Artificial Sequence
  Description of Artificial Sequence: Synthetic coding sequence
auggccccaucugccgaccccggaaugucacguaugcugccauuucugcugcuccucugguuucuaccuaucacggaaggcucucagcgcgccgagccaauguuuacugccgucacaaauuccguacuaccuccugauuacgacucaaaucccacacaacugaacuacggcguggcugucacagaugucgaccacgauggcgacuuugagaucgugguugcuggauauaacgguccaaaucuggugcucaaauaugaccgcgcccaaaaaagauuggugaauauagcuguggaugaaagguccagucccuauuaugccuuaagggaucgacaggggaaugcuaucggagucaccgccugcgauauagacggagauggaagagaagaaauuuacuuccucaacacgaacaacgcuuuuagcgguguggcaacauauacugauaaauuauucaaauuuaggaacaaccgaugggaggauauucuaagcgaugagguuaacgucgcacgaggagucgcgagcuuauucgcaggccggagcguugccugcguagauagaaaagggagcggcagauauucuaucuauaucgccaauuacgcauauggaaacguaggaccagacgcccugaucgaaauggauccagaagcaagugaccugucacgaggcauucucgcccugcgugauguggcagcagaagcaggcgugucaaaguacacggggggccguggcguuuccgugggaccuauucugaguagcagcgcuagugacauuuuuugcgacaacgagaacgggccgaacuuuuuauuucacaauaggggugauggcacauucguugacgccgccgcuucagcugguguggaugauccacaucaacacgggagaggaguggcauuagcugauuuuaaucgcgacgggaaagucgacaucguguacgguaacuggaacggaccacaucgccuauaucugcagaugucaacucacggaaaaguccgauuuagagacaucgcuagcccaaaguuuucaaugccaucuccagucaggaccgugauuaccgcugacuuugauaaugaucaggagcuugagaucuuuuucaacaauauagccuacagaaguaguagugccaaucgacuguuuagagugaucagaagggagcacggagacccccuuauagaggaacugaaucccggcgacgcucucgaacccgagggaagagggacaggaggugucguuaccgauuucgacggggaugggaugcuggauuuaauuuuaucacauggagagucgauggcgcagccccucagcgucuuccgcggcaaucagggauuuaacaacaauugguugcgggucgugccuagaaccagauucggggcauuugcucggggugcgaaggucgugcuguacacuaaaaaguccggagcacaccuaagaauuaucgauggggggucgggguaccugugcgagauggagccugucgcccacuuuggccugggaaaagacgaagcaucaaguguugaagugacuuggcccgacggcaagauggucagcagaaaugucgcguccggugaaaugaacucuguucuggagaucuuauacccccgagaugaggacacuuugcaggacccugcacccuuagaguguggacaagguuuuagucagcaggagaauggucacugcauggauacaaacgaauguauucaguuucccuucguguguccuagggacaagcccguaugugugaauaccuauggcagcuaccggugcagaaccaacaaaaagugcucucgagguuacgaacccaaugaggacgggaccgccuguguagcccaggucgcauuucucggcggauauucuucugcagccucccggauuucagagccacugucccgcgccucauaucuaucucuuggucuugggcucugucugcagcucuacgcacuguag

SEQ ID NO: 14048 - RNA, 1986 nt, Artificial Sequence
  Description of Artificial Sequence: Synthetic coding sequence
auggcucccuccgccgacccugggaugucaagaaugcugccauuccugcuguugcucugguucuuacccauuaccgaggguucccaaagggccgaaccuauguuuacagcgguuaccaauagugugcuuccuccugacuacgacucuaacccuacccagcuaaauuacggaguugccguuaccgacguagaccacgacggagauuuugaaaucgugguggcuggauacaauggacccaaucucguucugaaauaugaccgcgcccagaagagguuaguuaauaucgcgguugaugaaagaucuuccccuuacuacgcacuccgggaccgucaggggaaugccauuggagugaccgcaugcgauaucgauggagacggaagggaggagaucuauuuucucaauacuaauaaugcauuuucaggcgucgcaacuuauaccgacaaacuauucaaguuccgaaacaauagaugggaagacauucugucugacgaggugaacguggcacgagggguugcuagccucuuugcuggaagauccguggcuugcguggacagaaaggggagcgguagguauucuauuuacauugcaaauuacgcguacggaaacguaggacccgaugcacucaucgaaauggacccagaagccucagaccuaucacgcgguauucuggcguuaagagacguggcugccgaagccggugugagcaaguauacgggaggccggggcguuucuguggggcccauucucagcuccuccgccuccgauauuuucugcgauaacgagaacgggccaaauuuccuauuucacaacagaggggacggaacauucgucgaugcagccgccagcgcugggguugacgauccucaucagcacggaaggggugucgcgcucgccgacuucaacagagacgguaagguagacauugucuaugggaacuggaaugguccgcauagauuguauuuacaaauguccacccaugggaaaguccgcuuccgggacaucgccagcccuaaauucagcaugcccuccccuguucgaacuguaauaacggccgauuucgauaaugaucaagaacucgagauuuucuuuaacaauaucgcauaucgaucuucuucugcuaaucgacuuuuucgcgugauucggcgcgaacauggcgacccucugaucgaagagcugaauccaggcgacgcacuggaacccgagggcagaggaacuggaggcguggucaccgauuuugauggcgauggcaugcuggaccuuauauugucucauggcgagagcauggcucagccauuauccguuuuuagaggcaaccaggguuuuaacaacaacugguuacgagucguuccuagaacgagauucggggcuuucgccagaggugccaaggucguucuguacaccaaaaagagcggggcccaucugagaaucauugacggcggcagcggcuacuuaugcgagauggaacccguggcucacuucggcuuagggaaggaugaggcuuccagcgucgaggugaccuggccagacggaaagauggucagccggaacguggcauccggggaaaugaacagcguacucgaaauccuguauccaagggaugaggacacgcuccaagaccccgcuccccuugaauguggacagggcuuuucucagcaagagaacggacacuguauggauacuaaugaaugcauucaauucccuuuuguuugcccgagagacaagccugugugugugaauacuuauggaucuuauagguguaggacuaacaaaaagugcuccagaggguaugagccaaacgaagacgguaccgcguguguaggaacccucggacagucaccagguccccggcccacuacccccacugcugccgccgccacugccgccgcugcugccgccgccggagccgcgacugcugccccuguguugguggacggagacuuaaaucuuggaagugugguuaaagaaagcugcgagccaaguugcuag

SEQ ID NO: 14049 - RNA, 1230 nt, Artificial Sequence
  Description of Artificial Sequence: Synthetic coding sequence
auggcacugacccccggcuggggauccucugcgggucccguccggccugaacuuugguugcuguugugggccgccgcuuggagauuaggugcaucugcuugccccgcccuguguacuuguaccggcaccacuguagacugccacggcacuggccuucaggcgaucccuaaaaacaucccgcgcaauacggaaagauuggaacucaacgguaauaacaucacaaggauccauaagaaugacuucgcuggacucaagcagcucaggguucugcaguuaauggaaaaccaaaucggggccguggaacggggcgcauucgacgacaugaaggaacuugaacgauuaagauuaaaccgcaaccagcugcauaugcuaccagaacugcucuuucagaacaaccaagcccuuagccgguuagaucuguccgagaacgcaauccaggcuauaccgcgaaaggcuuucaggggcgccaccgaccuuaaaaaucugcagcuggacaagaaucagauuuccuguauugaggaaggcgcauuuagagcacucagggggcuggaggugcuaacucucaacaacaacaauaucacaacuauuccugugucuaguuuuaaucacaugccuaagcucaggacuuuuagacuucacagcaaucaucuauucugcgacugucaccuggcuuggcucucccaguggcuucggcagaggcccacuauuggucuuuucacacagugcucaggccccgccagucuuagaggcuuaaauguugccgaggugcagaagucagaauucaguuguuccggucagggcgaagcaggacgggugcccaccuguacccuaagcuccggauccugucccgccauguguacauguuccaacgguauuguggauugucgaggaaagggacugacagcuauucccgccaaccuucccgagaccaugacagagauaagauuggaguuaaauggaaucaaaagcauuccuccaggugcauucucacccuaccggaaacugcggagaaucgaccugagcaauaaccagaucgcugaaaucgcucccgacgcauuccagggacuuaggagcuuaaauucucugcacacuggcccugugacauguccacauacaaccggcacacauucuucucacuguagagcauuugccgucgcaguaccacacaguaggaacgaccucgaggcuauguuugaagaggaggucccacgcaucuuuuauucagcuuag

SEQ ID NO: 14050 - RNA, 1143 nt, Artificial Sequence
  Description of Artificial Sequence: Synthetic coding sequence
auggcauuaacaccuggaugggggucaagugcaggcccuguucgcccugagcugugguuauugcugugggccgcugcuuggcgccugggugcaucagcaugucccgcacuuugcacguguaccggcaccacgguagauugccacgguaccggucugcaggccaucccuaaaaacauccccaggaacaccgaacggcuggagcucaacggaaauaacauuacacggauacauaaaaacgacuuugccggauuaaaacaacuaagggugcuucagcuuauggagaaucaaaucggggcuguggagagaggcgcguucgacgauaugaaagagcucgagcgccuggaccuaagugagaaugccauucaagccaucccccggaaagcauuuagaggcgcaaccgaccugaagaauuuacaguuagacaaaaaucaaaucucaugcaucgaggagggcgcauuucgagcccugcggggacuugaggugcugacccugaauaauaauaauaucacuacaauccccguuaguuccuucaaccacaugccgaaacugaggacauuucgccugcacuccaaucaccuauucugcgacugucacuuggcuuggcuaucacaguggcucagacagcgccccacuauaggauuguuuacacaauguucuggcccugccagccugagaggccuaaauguggcggaggugcagaaauccgaauucucuugcucaggacagggggaagcuggccgggugccgaccuguacccucucuucaggaagcugucccgcuaugugcacauguucuaaugguauuguugauugccgugguaaaggacuaaccgccauccccgcuaaccucccggagacaaugaccgaaauuaggcuugagcucaacgggaucaaauccauccccccaggcgcuuucagccccuaccgaaaauugaggcguauugaucugaguaacaaccaaaucgccgaaauugcccccgaugccuuccaaggacuucgaucucugaauucucuuguguuguacgguaauaaaauuaccgaucugccaagagggguuuuuggcggccucuacaccuugcagcuccuucuccugaaugccaacaaaaucaacugcauacgaccagaugccuuucaagaccucuag

SEQ ID NO: 14051 - RNA, 2448 nt, Artificial Sequence
  Description of Artificial Sequence: Synthetic coding sequence
auggcccugacaccuggcuggggaagcucagcagggcccgugaggccagaacuguggcuauugcuuugggccgcugcguggcgauugggcgcaagcgcaugccccgcacuuuguacuugcacagggacuacuguugauugucacgggaccggacuccaagcaauccccaaaaauaucccacguaauaccgaaaggcuugagcucaauggaaacaauaucacucgcauacacaaaaacgacuucgccggccugaaacaauuaaggguccugcaguugauggagaaccaaauuggcgcuguagaacguggugccuucgacgauaugaaagaacuugaacgacugcgacucaaccgaaaucagcuccacauguuacccgaacugcuguuccagaauaaccaggcacucagccgucuagaccuaucugagaacgcuauccaggccauaccacgcaaagcauuccggggggcgacagaccugaaaaaucuccaauuggacaagaaucagauuagcuguaucgaggagggcgcuuucagggcccucaggggcuuggagguuuuaacccuaaauaauaacaacaucacuacaaucccugugagcucauucaaccacaugccgaagcugcgcacuuuuagauuacacuccaaccaccuguucugcgacugucaccucgccuggcuuucacaaugguuacgacagcggccuacaaucggucuauuuacucaguguaguggcccugcuucacuaaggggccugaaugucgccgagguacagaagucugaauucuccuguucuggacagggcgaagcgggccguguuccaacuugcacucuaucauccggaagcugccccgccaugugcacaugcagcaauggaauagucgacugcagggggaagggucugacugcaauuccugccaauuugccagaaacuaugaccgaaauucgccuugagcugaaugggauuaaaucgaucccuccuggugcauuuucuccuuaccgcaaacuccgaagaaucugcccccuuucguuuugcagcccuugucgugacuugucgaauaaccaaauagcugagauugcucccgaugccuuucaaggccugcgcagccucaauucccucgugcucuacggaaacaaaauaaccgaucucccgcgcggaguguucgggggccuguacacgcuucaguugcuguuguugaaugcaaacaagauaaauugcauacgccccgacgcuuuccaggauuugcaaaaccucucucucuuaucucuguacgauaauaagauucagucccuggcaaagggaaccuucacuucucuaagagccauucagacccuccaucuugcccagaacccauuuaucugcgacuguaaccugaagugguuggcugacuuucucaggacaaauccuaucgagacuuccggagcuagaugugcauccccacgacgccucgccaauaaaagaauagggcagauuaaguccaaaaaguuucgcuguucugcaaaagaacaauauuucaucccgggcaccgaggauuaccaacugaauucugaauguaacucugacgucgugugcccccauaaaugccguugugaagccaaugugguagaaugcagcagccucaaacugacaaaaauacccgagagaaucccccagaguacugcugaauugagacuaaauaacaacgagauuucaauucucgaagcuaccggcauguuuaaaaaacuaacgcaucugaagaagaucaaccuaucaaauaacaaagucagugaaaucgaggacggagccuucgaaggggccgccagcgugagcgaacuacaccugacugcaaaucagcuagagaguauaagaagcggcauguuccgcggacucgacggccuucguacgcucaugcugcggaauaacaggauaucauguauccauaaugauucauuuacggggcucaggaaugugcgccugcugagccuuuacgacaaucagauuacuaccgugucucccggagcuuuugauacacugcaaucccuuucaacauugaaucugcuugcgaaucccuuuaauuguaacugccaacuugcuugguuaggaggcugguugagaaagcgcaaaaucguuacgggaaauccaaggugccagaacccugacuuucugcgacagauuccguuacaggacguggcauuccccgauuucaggugcgaagaaggucaagaggagggggguugcuuaccgcggccacaguguccacaggagugugcaugccuagacaccguuguucguugcucuaauaaacaccugagggccuugccuaaggggaucccuaaaaacguuaccgagcucuauuuagauggcaaucaguuuacauugguccccggacaguugucuacuuuuaaauaucuccaacugguuauucucaguuacaacgcuuugcaauguaucccaccucuagcuuuccaguag

SEQ ID NO: 14052 - RNA, 4386 nt, Artificial Sequence
  Description of Artificial Sequence: Synthetic coding sequence
auggccuugacaccuggguggggaaguagugccggccccgugcgaccugaauuguggcuacuacugugggcugcugccuggagauugggcgcaucugcauguccagcccucugcacaugcaccgggacaaccguugacugccacgggacgggcuugcaggccaucccaaagaauauuccaagaaacacagaaaggcucgagcugaacggcaacaauauuacucggauccauaagaaugauuucgccggacuuaagcaacugagagugcuccagcucauggaaaaccaaauuggagcgguggaaaggggcgcuuuugacgauaugaaggaauuagagagacucagacugaacagaaaucaacugcauaugcucccagagcuguuguuucaaaacaaucaggccuugucucgauuagacuuaucugagaacgcuauccaggccauuccacgcaaggcguuucguggugccaccgaccuuaagaaccugcaguuagacaagaaccaaauaucgugcauugaggagggcgcuuuccgcgcguugagggggcuagagguguuaacccucaauaacaacaauauuacaacuauucccguuuccuccuuuaaucacaugccaaagcugcguaccuucagacuacauuccaaccaccuguuuugugacugccaucuugcauggcugucccaguggcuuagacaacggccuacaaucggcuuauucacacaguguuccggcccggcaucucuucggggucuuaacgucgcagaaguacagaaaagcgaauuuuccugcagcgggcagggcgaggcuggcagaguuccuaccugcacacucagcucugggucuugucccgcuaugugcacguguagcaacgggaucguugauugcagaggaaagggcuuaacagcaaucccagcuaaucuuccagaaacuaugaccgagauccgucuugaacugaacgggauuaaguccauccccccaggcgccuucagcccauaccgcaaacuuagaagaauugaucuguccaacaaccagauugccgagaucgccccugaugccuuucaaggucugcgcucuuugaacagccucgucuuguacggcaacaaaauaacagaucuuccacgcggcguauucggcggcuuguauacccuacaacuguuacugcugaacgcuaauaaaaucaacuguauccgcccggaugcuuuucaggaccugcaaaaccucucccuacucagcuuguacgacaauaaaauccagagccuugcuaaagggaccuucacuagucucagagcuauucaaacacugcaucuggcccaaaacccauucaucugugacuguaacuugaaguggcucgccgacuuucugagaaccaacccaauagaaacaucaggcgcacgcugugcaucccccaggagacuugccaacaaaaggauuggccagauuaagucuaaaaaauuucguugcucugcaaaagagcaauacuuuauaccagguacagaggacuaucaguuaaauagcgagugcaacucagacguggugugcccccauaaguguagaugugaggccaacguuguagaaugcuccucucuaaagcucacaaagauaccggagcggauaccucaaaguacugcugagcugcggcugaauaauaacgagauaaguauacuugaagccaccgggauguuuaaaaagcugacccaccugaagaaaauaaauuuauccaauaacaaagucuccgaaauagaagauggcgcuuuugaaggcgcagccuccguaagugaacugcaucucaccgccaaucagcuagaaagcauaagaucagguauguuuagaggccuggauggacuacgaacccucauguuaaggaacaauagaauaucuuguauucauaacgauucguuuacgggccuuagaaaugucaggcuccucucccuguacgacaaucagaucaccaccgugucaccuggcgcuuuugacaccuugcagucccuuaguaccuugaaccugcucgcaaacccauuuaauugcaauugucagcucgcauggcugggaggauggcuucgcaaacgcaagauagugaccgggaauccacgcugccagaauccugauuuuuugcgccaaauuccacuucaagacguugccuuuccugacuuccgaugcgaggagggacaggaggaaggggggugccuaccucgcccucaaugcccucaggaaugcgccugccuggacacagucgucagauguuccaacaaacaccuaagagcacuucccaaaggcauaccaaaaaaugucacugaacuauaccuggacggaaaucaguucacccucguucccggucaguugucuacauucaaauacuugcaacucgucgaccuguccaauaauaaaauuucuagucugagcaauucuuccuuuacaaauaugagccagcugacaacccuuauccuuaguuacaacgcacugcaguguaucccaccauuagcguuccagggccugaggucucuccgccugcucucccugcacgggaacgauaucuccaccuugcaagaaggaauuuuugcugauguuacaagccuaucccauuuggccauuggcgccaacccuuuauauugugacugucaucuuagguggcuguccuccuggguuaagaccggcuauaaagagccaggcaucgccaggugugcggguccucaagacauggaagggaaacuccugcucacaacuccugcaaaaaaauucgagugccaaggcccaccuacacuggccguucaagcaaaaugugaccuauguuuaucgucccccugucagaaccaaggcacuugccacaacgaccccuuagagguauaccggugcgcuugcccuagcggcuauaaagggagagacugugagguuucgcucgacaguuguagcucuggcccuugcgagaauggaggaacaugccacgcacaagaaggggaggaugccccguuuacguguagcuguccuacaggguuugaaggcccgacaugcggugugaacaccgaugacugcguggaucaugcaugugcaaacggcggcgucugcguggauggggugggaaauuacacaugucagugucccuugcaauaugaaggcaaagcaugcgaacaacugguagaucuguguucucccgaucuaaacccuugccagcaugaggcucagugugugggaaccccugauggaccaagaugcgaauguaugccaggauacgcaggagacaauugcagcgagaaccaggacgacugcagggaccaccguugccagaauggagcucagugcauggaugaaguaaauucguacuccugucucugcgcagagggauauagcggccaguuaugcgagaucccaccacaccuccccgcaccaaaaagcccaugcgagggcaccgaaugucaaaacggcgcuaauugcguugaucaggguaaccgcccagucugucaaugccugcccggguuuggaggaccagaaugcgagaaacuccucucuguuaauuucguugaucgagacaccuaucuacaguuuaccgaccuucaaaauuggccccgcgcuaacauuacucuucaggugucuaccgccgaagacaauggcauauuacuauacaauggagauaaugaucacauugccgucgaacuauaccaaggacacguuagaguuagcuaugaucccgguuccuaucccuccagugcaauauauucagccgagacuauuaaugacggucaguuucacacaguugagcugguggccuuugaucaaauggugaauuugaguauagacggcggcaguccgaugaccauggacaacuucggcaaacauuauacacugaacucugaagcaccccuguacguuggaggaaugccuguagauguuaacagcgcagccuuucguuuguggcaaauacugaacgguacaggauuucacggguguaucagaaacuuauauauaaacaacgagcugcaggauuucaccaaaacgcagaugaaaccaggagucgugccgggaugugaaccgugcagaaagcuguacugccugcauggcaucugucaaccaaacgccacaccgggccccaugugccacugcgaagccgggugggugggacuacauugcgaucaaccugcugauggcccuugccacggucacaaaugcguacacggccagugcgucccucuggacgcuuugaguuauagcugucaaugucaagacggguauucuggugcacugugcaaucaguccccaucugcaggcggcacucugagcgguacuuucacaagaucaaggggagcuaugccaagcgcacguccuagggcacccugucauggaugguccgccggcgcccgagcgcaggcucgugccgccgcuagagcuuucggguag

SEQ ID NO: 14053 - RNA, 570 nt, Artificial Sequence
  Description of Artificial Sequence: Synthetic coding sequence
auggaggcuacuggaaccgaugaggucgauaaauugaaaacaaaauuuauuucagcguggaacaacaugaaguauucaugggugcucaagacuaaaacuuacuuuuccagaaacucaccgguguuacuguuaggaaaauguuaccacuuuaaguacgaagacgaggauaagacacugccugccgagaguggcugcacuaucgaggaucauguaauugcgggaaacguggaagaguucaggaaggauuucaucagucgcaucuggcucaccuaucgggaggaauucccacagauugaggguagcgcacuuaccaccgacuguggguggggcugcaccuuacgaacagggcagauguuguuggcccaagggcuuauucuucauuucuuaggacgagccuggacauggccggacgcccugaauaucgagaauuccgacucagaaagcuggacuucacacaccgucaaaaaauuuacugcguccuuugaagcaagucucuccggggaacgagaguuuaaaacaccuaccaucucacugaaggaaaccaucggcaaauauagugaugaccacuag

SEQ ID NO: 14054 - RNA, 1377 nt, Artificial Sequence
  Description of Artificial Sequence: Synthetic coding sequence
auggaggcaaccgggaccgacgagguugauaagcugaaaaccaaauuuauauccgccuggaacaacaugaaauacagcugggugcucaagaccaagacauacuucuccagaaauucucccgugcuucuuuuggggaagugcuaucacuuuaaauaugaggacgaagacaaaacgcuacccgccgaaaguggaugcacuauugaggaucaugugauugccgguaauguugaagaauuuagaaaggacuuuauaucacggaucuggcugacauauagagaggaauuuccccagaucgaagguucugcucuuacaacugacugcggauggggcugcacacugcguaccggccagaugcugcuugcacaagggcuaaucuugcauuuccugggcagagcauggacuuggccugaugcacucaacauugaaaauagugauucugaauccuggacgucacacacggucaaaaaauuuacugcuaguuucgaagccucccuuagcggagaaagggaguucaaaacaccgacgaucagccugaaagagaccauaggaaaguacuccgacgaccaugagaugagaaacgaagucuaucaucggaagaucauuucuugguuuggugauagcccauuagccuuguucggccugcaccagcugauugaguaugggaaaaaaagcggcaagaaagccggugacugguacggccccgcagugguggcacacauucuucguaaggcgguugaagaagccagacauccugaccuccaaggcaucaccauuuacgucgcccaggauuguaccguguauaacucagaugugauugauaagcaauccgcauccaugacaucagacaacgcagacgauaaggccguuauuauuuuagugcccguuagacuugggggcgaacgaaccaauaccgauuacuuggaauucgugaaaggcauucucagucuggaauacugcgugggcaucaucggcggaaagccaaagcaaucuuauuacuuugcaggguuucaggaugacagccuuauuuacauggacccccacuauugucaaucuuucguggaugucucgauaaaagauuuuccuuuggaaacuuuccacugccccucuccuaaaaaaaugucauuccgcaagauggauccuuccugcacaauuggauuuuauuguagaaauguccaagauuucaaacgugccucagaggaaaucaccaaaauguugaaguucaguucuaaagagaaguauccacuauucaccuucgucaaugggcauagccgagauuaugauuuuacuaguacgaccacaaacgaagaagacuuauuuuccgaagaugaaaaaaaacaguugaaaagguuuuccacagaagaauuuguucugcucuag

SEQ ID NO: 14055 - RNA, 8178 nt, Artificial Sequence
  Description of Artificial Sequence: Synthetic coding sequence
auggagcagacagauugcaaaccauaucaaccccucccuaaagucaagcacgaaauggacuuagcuuacacaaguuccuccgacgagagugaggacggaaggaaaccucgccaguccuauaauagccgggaaacacuccacgaauacaaccaagaacuucggaugaacuauaauucccagucucgaaaaaggaaggaggucgagaaauccacccaagagauggaauucugcgaaacuagccacaccuuaugcucaggcuaucaaacagacaugcauuccguuagcagacacggauaucaacucgagauggggagcgauguagauacugagaccgagggcgcagcguccccugaucacgcucuuaggauguggauucgcggcaugaaaucugagcauuccuccugucuuuccagucgugcuaacagcgcccucucccuuacagacaccgaccaugagcggaagagugauggagaaaauggauucaaguucaguccaguaugcugugacauggaagcacaagcggguagcacucaagauguucaguccucgccccauaaccaguucacauucagaccacuuccccccccaccaccaccuccucacgcauguacaugugcccgcaaacccccucccgcagccgauagcuugcagcgccgcuccaugacgacacgaagccaaccaagccccgcagccccugcacccccaacauccacccaagacuccguacacuuacauaacaguuggguuuugaacaguaauaucccccucgaaaccaggcauuuucuuuucaaacauggcaguggaaguuccgcuaucuucucugcagccucccagaacuacccacucacaaguaacaccguuuauuccccuccaccccgaccauugcccaggagcacuuuuucccguccugcauuuacauucaacaaaccauaucggugcuguaauuggaagugcaccgccuugagcgcuacagcaaucacagucacccuggccuuguuauuagcauacgugauugccgugcaucuguucggcuugacauggcagcuacagcccguagaaggagaacuguaugccaauggcguuuccaaaggaaacagggguacagaaucaauggacacgaccuacucaccgaucggggguaaagugagugauaaaucagaaaaaaaaguauuccaaaagggccgcgccauagacacuggagaagucgauauuggugcccaagugaugcagacuauuccaccgggucucuucuggagguuccagaucaccauucaucauccaauauaucuuaaguucaauauaucucuggccaaagacagucugcucgggauuuacggcagaagaaacauucccccuacccacacucaauucgauuucguuaagcuuauggauggaaaacagcucgugaaacaggauagcaaagguucggacgacacacagcacagcccccguaaucuuauccucaccucccuccaggagacaggcuuuauugaauauauggaucaaggacccugguaccuggcuuuuuacaacgacggaaagaaaauggagcaaguguuugugcuaaccacagcaaucgagaucauggacgauuguuccaccaacugcaauggaaauggagaaugcaucagcggacauugucacugcuuccccggcuuccucggaccagacugugcucgggauaguugcccaguuuuauguggaggaaauggugaguacgagaagggacacugcguuugcaggcacggcuggaaaggaccagagugcgacgugccagaggagcaauguauugacccuacauguuuuggacauggcaccuguaucaugggagucuguaucugugugccgggcuauaaaggagaaauuugugaggaggaggauugcuuggacccgaugugcucuaaucacgggauuugcgugaagggagaaugucacuguaguacagguuggggcggagucaauugugagacaccccugcccgugugccaggagcagugcucagggcauggaaccuuccucuuagaugcuggggucuguucuugugaucccaaauggacagggagcgacugcaguaccgaacuguguacaauggaaugugggucgcacgguguauguucaagagguaucugccagugcgaggaaggguggguggggcccaccugcgaggagcgcuccugucauagucauugcacagaacacgggcaguguaaagacgguaaaugugaauguucaccaggaugggagggagaucacuguacaauugcacacuauuuagacgcugugcgcgacggcuguccuggacuauguuucgguaauggccgcuguacuuuagaucaaaaugguuggcacugugugugucagguaggaugguccgguacuggaugcaacguaguaauggagaugcugugcggggacaaccucgacaacgacggagacggcuuaacggacuguguggaccccgauugcugccaacagaguaauuguuauauaucaccccucugucagggaagcccggacccucucgauuuaauccagcaaagucagaccuuguucagccagcacaccagccgguuguucuaugauagaaucaaguuccuaauaggcaaagauuccacccacguuaucccaccggaaguuucuuucgauagcaggagggcuugcguaauuagaggacaagucguggcuauagaugggaccccccucgucggugugaacguauccuuccuccaccacagugacuacggcuuuaccaucucucgacaggacgguaguuuugaccuaguggccauuggcggaauuucugugauccucaucuucgaucgguccccauucuuaccagagaagagaaccuuguggcugcccuggaaucaguuuaucgugguugaaaaagugaccaugcagcggguugugucagaucccccuuccugcgauauuagcaacuuuaucucgcccaauccuauuguucugcccucuccacucaccagcuucgguggcuccugcccugagcgcgggacaaucguaccagaacuccaggugguccaagaagagauaccgaucccuuccucauuuguucgacuuagcuauuuaucuaguagaacuccuggguacaagaccuuguugagaauccuucuuacucauucuaccauuccuguggguaugauuaaggugcaccucaccguggcuguggagggacgccugacccaaaagugguuuccggccgccaucaauuuaguguauacguuugcuuggaauaaaacugauaucuacgggcaaaaagucugggggcucgcugaagcacuagugucaguagguuacgaauacgaaacuugcccugauuucauacugugggagcagaggacuguggugcugcaagguuuugaaauggaugcuuccaaccuggggggguggagucugaauaagcaccauauacugaacccccaaucuggcauaauucauaaaggcaacggcgagaacauguuuauuagccagcaaccuccaguuauuucaaccaucauggguaacggacaccagcguagcgucgccugcaccaacuguaacggaccagcccacaacaacaaauuauucgcuccggucgccuuggcuagcggaccugacggcagcgucuacgucggcgacuucaauuucguucggcggaucuuuccaucugguaacuccgugucuauccucgagcugucuacauccccugcacacaaguacuaccuugccauggacccgguguccgaaagucuauaccugucggauacgaauacccgaaaaguauacaaacuaaaaucauugguugaaacaaaagaccucucuaaaaauuuugaagugguggcugggacuggggaccagugucuaccuuuugaccagagccacugcggcgacgguggucgugccucagaagccaguuugaacucuccucgugguaucacuguggaucgccauggcuucauauauuuuguagacgggacuaugauaagaaagauugaugagaaugcaguuaucaccacuguuauuggcuccaaugguuuaaccucgacucagccuuuguccugugauagcggaauggauauuacgcaggugagauuagaauggccaacagaccucgccguaaacccaauggacaauagucuauauguucuggacaacaacauugugcugcagauaucugaaaaccgcagagugcgcauuaucgcuggaaggccaauccacugccaggucccagguauagaucacuuccucguguccaaagucgcaauacauuccacacucgagucugcuagagccauuagugugucccacucaggacuccucuuuauugcugaaacggaugagagaaaagugaaucggauucaacaaguuacuacuaauggugaaauuuauaucauugcuggggccccuacugauugugacuguaagaucgaccccaacugcgauugcuuuucuggagacgggggcuacgcaaaagaugcuaagaugaaagcucccaguaguuuggccguuucgccugauggcacacuguauguggcagacuuaggaaacgucaggauccggacaauuagcagaaaucaagcccaucugaacgauaugaacauuuaugaaaucgcaucucccgccgaucaggaauuguaucaguucaccgugaauggcacucaucugcacaccuugaaucucauuacaagagacuacguauauaauuuuacuuauaauagcgagggcgauuuaggagcaaucacaucaucaaauggcaauagugugcacauucgcagggaugcuggagguaugccccuauggcuggugguaccaggcggacagguguacugguugacaauuucauccaacgggguucuaaaacggguuucagcucagggauauaaccucgcccucaugaccuacccuggaaacacaggacugcuagcuacgaaauccaacgagaacggauggacuacuguauaugaauaugaccccgaagggcaccugacaaacgcaacuuuucccacgggugaggucucuuccuuccacucugaccuggaaaaacuuacgaaggucgaacuugauaccuccaaucgcgaaaauguacucaugagcacgaaccuuaccgccacuagcacaauauacauucugaagcaagaaaauacccagaguaccuauaggguuaaucccgacggcagccuuagaguuacauucgccucuggcauggaaauuggacuaagcagugaaccucacauacuggccggcgccgugaauccaacguugggaaaauguaacaucagccugccaggcgaacauaaugcgaaccucaucgaguggcgucaacgcaaagaacaaaauaaagggaacguuucugccuuugagcgucgguugagagcacauaauaggaaccuguugucuauugauuucgaucacauaacccgcaccgguaaaaucuacgaugaucaccgcaaauuuacacugagaaucuuauaugaccaaacagguagacccauacuguggagccccgucucuagauauaacgaagucaacauuaccuacagcccuuccggccucgucaccuuuauucagagggguaccuggaaugaaaagauggaauaugaucaaagcggaaaaaucaucucucggacaugggcagacggaaaaauuuggaguuacacauaccuggagaaaucugugaugcuucugcugcauucacagagaagguacauauuugaauacgaucagccagauugccuccugagcgugaccaugcccuccauggugcgccacaguuuacagacaaugcugagugucggcuacuaucgcaauaucuauacuccaccagauuccagcacgagcuucauccaggacuauucgagagauggaagacuccuccagacccugcaucuggguacuggucgccgcgugcuauacaaauauacuaaacaggccagauugucggaggugcuguacgauaccacccaaguaacccuaacuuaugaagaaucauccggcgucauaaagacgauccaccucaugcacgauggcuuuauuugcacaauuagauacaggcagaccggcccccugaucgggcgccaaauuuuuagauucucagaagagggccuugucaacgcuagauucgacuacuccuauaacaauuuccgaguaacuaguaugcaggcagugauuaaugagacaccucucccaauugauuuauaccgauauguggauguguccggccgcaccgagcaguuugggaaauucagcguuaucaacuaugaccuaaaccagguuaucacaaccacagugaugaaacauacaaagauauucucagcaaacggacagguaauugaaguccaauacgaaauuuugaaagcgauugccuacuggaugacuauccaauaugacaacguuggccgaauggucaucugugacaucagaguugguguugaugcaaacauaacucgcuauuuuuaugaauaugacgcugacggacagcuucagacagugagcgugaaugacaagacacaauggagauauagcuacgaccuaaacggcaacauuaaccuccucucacauggaaaguccgcccgacuuacgccccuucgcuacgaucuccgagaucgcaucacgaggcugggcgaaauucaauacaaaauggacgaagauggauuccucagacaacgcggaaaugacauauucgaguacaauucuaacgggcuccuucagaaggcguauaauaaggcauccggcuggaccguucaauacuacuaugacggauugggucgucgggucgcgagcaaaagcucacuaggacaacaucugcaauucuuuuaugcugaucuuaccaacccuauacgcgugacccaccucuacaaccacacuaguuccgagauuacaucauuauacuacgaucugcaaggucauuugaucgcuauggaguugagcagcggcgaagaguauuacguugcaugcgacaacacuggaacgccccuggcugucuuuucuucucgaggacaggugauuaaagagauccuguacacgccauacggggacauauaucacgacacuuauccugacuuccaggugauaaucggguuccacggaggacuuuacgacuuccuaacaaagcuggugcacuugggccaacgcgauuacgacguaguagcagggagauggacaaccccuaaccaccauaucuggaagcaacugaaucuuuuaccaaaaccuuuuaaucucuauagcuucgaaaauaacuaccccgucgguaagauucaagauguggcaaaguacacgacagacauucgcagcuggcucgagcuuuuuggauuucaacuccacaauguucugcccggguuucccaagccagaguuagagaaucucgagcuaacuuacgaacugcugcgguugcaaacuaaaacccaggaaugggauccuggcaaaacgauacuuggcauucagugcgaacuccagaaacagcuacgcaauuuuauaucccuagaccagcuacccaugaccccacguuacaacgacggacgcugucuggagggcggaaagcagccacgcuucgccgcagugccuucgguuuucgggaagggaauuaaauucgccauaaaagacgguauugugacugcugauaucauagguguggccaacgaagacagucgccgacuggccgcgauacucaacaaugcucacuaucuggaaaaccugcacuuuacgauugaggggagagauacacacuauuuuauuaaacuugggagccuggaggaggaccucgugcuaauaggcaauaccgguggcagaaggaucuuggagaauggggugaacgugacugugagccagaugacuagcgucuugaacggcaggacccggagauuugcggacauacagcugcagcacggagcgcugugcuuuaauauacguuacggaacuacaguggaggaagagaagaaucacguuuuggagaucgccagacagagagcuguggcucaagcuuggacuaaggaacagagacgacugcaagagggggaggaaggcauuagggcuuggaccgaaggggaaaagcaacaguugcugagcacuggaagaguucaggguuacgacgguuauuucguauuaucaguggaacaguaucuugaauuauccgacuccgccaacaauauucacuuuaugagacagucagaaaucgguaggcgcuag

SEQ ID NO: 14056 - RNA, 204 nt, Artificial Sequence; identical to SEQ ID NO: 12417
  Description of Artificial Sequence: Synthetic coding sequence

SEQ ID NO: 14057 - RNA, 831 nt, Artificial Sequence
  Description of Artificial Sequence: Synthetic coding sequence
augaagcaaauacuacacccagcacucgagaccacagcuugcaccaaucacuuuaacgcggacccuugcuccacaggcuucgucuucccagcuaugacacuguucccugugcuguuauuccuaguggcuggacuccugccuucuuuucccgccaacgaagacaaagacccugccuucaccgcccugcugacuacucagacgcaggugcagagagagaucguuaacaaacacaaugaacuucgucgggccguuucuccacccgccaggaacaugcucaagauggaauggaauaaagaggcagcugcaaaugcucagaaaugggccaaucaguguaauuacagacauucuaauccaaaggacaggaugacaucccugaagugcggugagaauuuauauaugaguucagccucauccucauggucacaagcaauucaguccugguucgacgaauauaaugauuucgauuucggagucggaccaaaaaccccuaaugccguggugggacacuauacccagguugugugguacucaucuuaucuugucggcugugggaaugcuuacugcccaaaucaaaaggugcugaaguacuauuacgugugccaguauuguccagcaggcaauugggcuaauagacuauauguacccuacgaacagggcgcaccaugcgccuccuguccagauaauugugaugauggcuugugcacgaacggaugcaaauacgaggaccuguauucuaacuguaaaaguuugaagcugacccugacaugcaaacaucaacuuguaagagacucuugcaaagccuccuguaauugcagcaauucaauuuacuag

SEQ ID NO: 14058 - RNA, 1350 nt, Artificial Sequence
  Description of Artificial Sequence: Synthetic coding sequence
augcuggcagaguggggagcuugucuccuguuggcagucgcauuacuaggacccggccugcaagcccaggcuauggaaggugucaagugcggaggugugcugucugcucccucggguaacuuuuccucuccaaacuucccccgacuuuaccccuauaauaccgaauguuccuggcugaucgucguugcagaagguuccucugugcuucugacguuccaugcauuugaccucgaauaucacgauacuugcuccuuugauuuccuggaaaucuauaauggagcuucuccugacaaagggaaccuccuggggcgauuuugcgguaaggucccaccaccccccuucacaagcucuuggcaugucaugagugugaucuuucacuccgauaaacauguggccagucacggauuuagcgccggauaucaaaaagaugugugcggaggugugcucacaggcuugagcggugugcugaccucucccgaauaucccaacaacuacccgaauucgauggagugucacuggguaaucagagccgccggaccugcccaugugaaacuuguguuuguagacuuucaaguugagggcaacgaagaaugcacuuacgauuauguugccguguugggcgguccggguccaacaagaggucaccauuacugcgguucaacuagacccccaacucuggucucucucggccacgaacugcaagugguauuuaaaucagauuuuaauaucggcggccgcggcuuuaaggcauacuacuuuuccggcgagugucaagaagucuauauggccaugcgcggcaauuuuucuuccccgcaguacccuucuaguuaucccaacaauauucgaugucauuggaccauacgccuccccccgggcuaccaggucaagguauuuuuucuugauuuagaccuggaagaaccgaacucucugacaaaaacaugugauuucgaucauuuggcggcauucgauggagcuagugaagaagccccucugcugggcaacugguguggacaccaucucccaccgccagucacgucaucgcacaaucagcucuuauuacugcuacauaccgacagaucuacaacucgcagagguuucagcguggcauacauuggggggcaacucggcugcggauccgggucaaccgaaggugagggagaagcccuccagccucagucucuucagagcccuucuagcauuccacccguuugccccgccccaccuaugaauggcuugcugcaacugcugcuccacuggcugcacccuugcccucugucuggcccuuugagauuggacgggaccgcucccgcuugcuuucacuacugucgcgccuccuuuccuaguuucuag

SEQ ID NO: 14059 - RNA, 1434 nt, Artificial Sequence
  Description of Artificial Sequence: Synthetic coding sequence
augaccucuaaauuccuucuggugucguucauuuuagcagcucuuucucucucaacuacauuuaguuuacagcccgaccagcagaaaguguuacuugucuccuuugauggguucagaugggauuacuuauauaaggugccaacgccacacuuccacuauauaaugaaguacggaguucacgugaaacaggucacuaacguguucauaacuaaaaccuauccaaaucauuacacccuagucacaggucuguucgcggagaaccacgggauagucgcgaacgauauguucgaccccauucggaacaaaucauucagccucgaccacaugaacauauaugauuccaaauuuugggaggaggccacucccaucuggauuaccaaccagcgcgcaggucauacgucaggugccgcaauguggccaggcacggauguaaaaauacauaagcgcuuucccacccauuauaugccuuacaacgagucaguaagcuuugaagacagggucgccaaaaucauagaaugguuuacuuccaaagagccuauaaaucugggguugcuuuacugggaggauccugacgacaugggucaucacuuaggacccgacucaccucucaugggcccuguuauuagugauauugacaagaaacugggcuauuugauucagauguugaagaaagcuaaacucuggaauacacugaaccuuauuaucacaagcgaccaugguaugacccagugcagcgaagaacguuuaaucgagcuggaccaguaccucgauaaggaccauuauacccuaaucgaucaaucaccuguugccgcgauccuucccaaggaggggaaguuugacgaagucuaugaagcccugacacacgcacacccaaaucucacuguuuacaaaaaagaagacgugccugaacgcuggcauuauaaauauaauucucgaauacaacccauaaucgccguggccgacgaagguuggcacauccugcagaacaagucugaugacuuucuguuaggaaaucauggauacgacaacgcucucgcugacaugcaccccauuuucuuagcccacggaccugccuuccgaaagaauuuuaguaaggaagccaugaacucaacagacuuauacccuuuacugugccaccuuuuaaauaucacugcaaugccucauaaugguucauucuggaacgugcaggacuugcugaacucugcaaugccgcgggucgugccuuacacacagucuacaauuuuacuucccgggagcguaaaaccggcagaguacgaccaggaaggcucauauccauacuuuaucggugucagucuggggaguaucaucgucauuguuuuuuuuguaauuuuuauuaagcaccucauucacucucaaauccccgcucuucaagacaugcaugcugagauugcacaaccucugcuucaagccuag

SEQ ID NO: 14060 - RNA, 1479 nt, Artificial Sequence
  Description of Artificial Sequence: Synthetic coding sequence
augggcagcgcucccugggcaccuguauuacuguuggcucugggccugcgaggacuacaggcaggcgcccgacgggccccagacccaggauuucaagaaagguucuuucagcagcgucuggaccacuucaauuuugagagauuugggaacaagacuuucccucaacgauuuuuagugagcgauagauuuugggucagaggggaggguccaauauucuucuacaccggcaaugaaggggauguuugggcuuucgcaaauaacagugccuucgucgcugagcuugccgcggagcggggugcgcugcugguguucgcugagcauagauacuaugguaagucacuuccuuuuggcgcccagucaacccagaggggacacacugaacuacucacugucgaacaggcccuggcggacuuugccgagcuuuugagggcccuaagacgagauuugggagcucaggaugcccccgcaauugcuuucggcggaucauauggagggaugcuuucugccuaucugcggaugaaauacccgcacuugguggcgggcgcauuagcagcauccgcaccaguucuugcgguggccgguuugggcgacuccaaccaguucuuccgggaugugacugccgauuucgaaggccagagcccuaaaugcacucagggagucagagaggcuuuccgccagauaaaggacuuguucuugcagggcgcuuacgauaccguucgaugggaguucgggaccugucaaccucugagugacgagaaagaccugacucaacuauuuauguuugcccguaaugcuuucacugugcuugccaugauggacuacccuuauccuacugacuuccuuggaccucugcccgccaaucccgugaaaguuggaugugaccgccugcucuccgaggcccagcguauuaccgguuugcgcgcuuuggcaggacuggucuacaacgccaguggaagcgagcacugcuaugauauuuauaggcuguaccauucuugcgcugauccuacaggcuguggcacaggacccgaugcaagagcaugggacuaucaggcuugcacugaaaucaauuugacuuucgccaguaauaaugugaccgacauguuuccagaucugccguuuaccgacgagcuccgacagcgauauuguuuagauacuuggggaguauggccaagacccgacugguugcugacaaguuuuuggggcggcgaucucagggcggcaucaaacauuaucuucucaaacgggaaccuagacccaugggcugggggaggaauucgcagaaaccugucagcuagcgucauugcaguaacuauucagggaggugcacaccaucuggaucuacgagccucccaccccgaggacccugccagugucguggaagcccggaaacuugaagcuacaauuauaggagaaugggugaaagcugcacgucgggagcaacagccugcucuucgcgggggacccagacugaguuuauag

SEQ ID NO: 14061 - RNA, 2850 nt, Artificial Sequence
  Description of Artificial Sequence: Synthetic coding sequence
augauccugucccuccuauuuucccucggcggcccucuugguuggggccugcuaggcgccugggcccaggccucaucuaccucacugucagauuuacaaucaagucgcacaccuggaguuuggaaggcagaggcggaggauacuggcaaagauccagugggucgcaacuggugccccuacccaaugucuaaacuggucacccuuuuagcccugugcaagacagaaaaauuuuugauucacucccaacaaccuuguccgcagggagccccugauugccagaaaguaaaggugauguauagaauggcccauaagccugucuaccaagugaagcaaaagguucuuacuagccucgccuggcguuguugucccgguuauaccggccccaauugugaacaccaugauuccauggcaauucccgagcccgccgaucccggagauucucaccaggagccccaggacggacccgugucauucaagcccggacacuuagcugcagugaucaacgaggucgagguacaacaggaacagcaggagcaccugcugggggauuugcagaacgauguccauaggguugcagauucacucccuggacucuggaaagcgcugccggggaaucuuaccgcugcagugauggaagccaaccagacaggucacgaguucccggauagaucguuagaacagguccuguugccccacguagauaccuuccugcaaguucacuuuucaccaauauggcggagcuucaaucaaucccugcacagcuuaacucaggccauucggaaucuuuccuuggauguggaggcuaaucgucaggcuauaucacguguccaagauagcgcaguugccagggcugacuuccaggaguugggagcuaaauuugaagccaaaguccaggaaaauacacagcgugugggacagcuacgacaggauguggaggaucgucuccacgcucagcacuuuacauuacaccgauccauuagugaacuccaagcagauguggacacaaagcucaagcggcuacacaaggcacaggaggccccugggacaaaugguucucuagugcucgcgaccccaggagccggggcaaggcccgaacccgacucucuccaggcccgcuuaggacaacuucagagaaaucuguccgaauuacacaugaccaccgcgcggcgugaggaagagcuucaauacaccuuagaagacaugagagcuacacugaccaggcacguggacgagauaaaggagcuuuacuccgaaucugacgaaacuuucgaucaaauuagcaaggucgagcgacagguggaagagcuccaggucaaccauaccgcacuucgcgagcugagaguaauccugauggaaaagagccugauaauggaagagaacaaagaggaaguagaacgucaacugcuggaacugaaccugaccuuacagcacuuacagggcggucaugccgaucugauaaaguacguuaaagauugcaauugccagaaacuguaccuggaccucgaugugaucagggaaggacagagagacgcuacccgggcccucgaggaaacccaagucucacuugaugagagacgccaacuugaugguuccucuuugcaggcccuccaaaacgcugucgaugcaguuagccuggcuguugaugcccauaaagcagagggugagagagcucgggccgccacaucaagacuccgcucucaaguccaggcucuugaugacgaagugggggcgcugaaagcagcagccgccgaggcacgccacgaaguccgccaacuccauucagcguuugccgccuuacucgaagacgcacugcgccacgaagcgguguuggcagcccucuuuggcgaagaagugcucgaagagaugagcgagcagacacccggaccuuuaccuuuaagcuaugaacagaucagggucgcacuccaagaugccgcgucugguuugcaagagcaggcacucggcugggaugaacuggccgcucgcguaacggcguuggagcaggcaucagagcccccccguccggccgaacaccucgaaccuucacacgaugcagguagagaagaggcagcaaccaccgcacuggcuggccuggcgagagagcuacagucucuauccaacgaugugaaaaaugugggccgcugcugugaggcagaagccggagccggggccgccagccucaacgcuagcuugcacggacuccauaaugcauuauucgcaacacagcgcucacuggagcaacaccagagacuuuuccacucacucuucgguaacuuucaagggcugauggaggcgaacgugucuuuagaccuagguaaacuucagacaauguuaagcagaaaagggaagaagcagcagaaggauuuagaagccccccguaagcgggacaaaaaggaagcggagcccuugguugacauccgcguuacaggcccggugccgggcgcccuuggugcugcacucugggaagcuggcaguccagucgcauucuacgccucauuuucugagggaacggcagcccuccagacagugaaauuuaacaccacauauaucaacauaggaucuaguuacuucccugagcauggauauuuucgugccccugagcguggcguuuaucuguuugcagugucaguugaauucggccccggcccaggaaccggacagcugguguuuggugggcaccacagaacucccguaugcaccaccgggcaaggcagcgggaguacagcaaccgucuucgcuauggcugaauuacagaagggagaaagaguaugguucgagcucacucagggaucuauaacuaaacggucuuuguccggcacagcuuuugguggcuuucuuauguucaagaccuag

SEQ ID NO: 14062 - RNA, 246 nt, Artificial Sequence; identical to SEQ ID NO: 12423
  Description of Artificial Sequence: Synthetic coding sequence

SEQ ID NO: 14063 - RNA, 690 nt, Artificial Sequence
  Description of Artificial Sequence: Synthetic coding sequence
augagcuuucuacaggacccgucuuucuucacgaugggcauguggaguaucggugcaggagcuuuaggugccgccgcucuggcucugcuguuggcaaauaccgauguguuccugucuaaaccccaaaaggccgcucuagaauacuuagaggauauugaccuuaaaacacuugaaaaggagccacgcacguucaaggcuaaagaguugugggagaagaauggagcuguaaucauggccgugagacgccccggaugcuuucucugccgcgaggaagcugccgaccuguccagucugaaauccaugcucgaucagcugggcgucccacuguaugcaguagugaaggaacacauuagaacagaaguuaaagauuuucaaccuuacuucaaaggagaaauauuucucgacgaaaagaagaaauuuuacggcccucaaaggagaaaaaugauguuuaugggauuuauucguuuaggggugugguacaacuucuuccgagccuggaacggcggcuucucuggcaaccuggagggagaaggauucaucuuaggcgggguguuugucguagguaguggaaagcagggcauuuugcucgagcaccgagagaaagaauuuggcgacaaagugaauuuauuaucagugcucgaggccgcuaaaaugaucaaaccccagacgcucgccagugaaaagaaauag

SEQ ID NO: 14064 - RNA, 657 nt, Artificial Sequence
  Description of Artificial Sequence: Synthetic coding sequence
auggguauguggucaauuggugccggcgcccucggagccgccgcccuggcauugcugcucgcaaacaccgacguguucuuaucuaaaccacaaaaggcugcacuugaauaucuugaagauauugaucugaagacuuuggaaaaagaaccucgaacauuuaaagcgaaagagcugugggagaagaacggggcugugaucauggcagucagaaggccaggguguuuucugugcagagaggaagccgcugaucuuagcucacuaaaguccauguuagaccaacugggggucccguuguacgcaguuguuaaggagcacaucaggacagagguuaaagacuuccagccuuacuuuaaaggcgagaucuuccuggacgagaagaagaaguuuuacgguccccagcggagaaaaaugauguuuauggguuuuauacggcugggcguuugguauaacuuuuuuagggcauggaauggaggguucaguggcaaccuggagggggagggguuuauccuaggagggguguuuguugugggaagugguaaacaggggauauugcuggaacauagagagaaggaauucggugacaaagugaaucuguuaagcgugcuggaagccgcuaagaugaucaaaccacaaacacuugccucagaaaaaaaauag

SEQ ID NO: 14065 - RNA, 690 nt, Artificial Sequence
  Description of Artificial Sequence: Synthetic coding sequence
auguccuuucuccaggaccccaguuucuucacaauggguauguggucaaucggagccggugcccuaggcgcugcagcacuggcgcugcuauuagcuaauaccgacguguuccucuccaaaccacaaaaggccgcacucgaguaucucgaagauauugaucucaagacgcuggaaaaagaaccgaggacuuucaaagcuaaggaguuaugggaaaagaauggagccgucaucauggccgugcgaagaccuggcuguuuucuguguagagaggaagcggccgaucucuccuccuuaaaaaguaugcuggaccagcucgguguaccucuauacgcaguagugaaggagcacaucagaacagaggucaaagauuuccagcccuacuucaagggagagauuuuccuggaugaaaaaaaaaaauuuuacgggccucagagacgaaagaugauguucaugggauucaucagacuaggaguuugguacaacuuuuuucgcgccuggaacggcgguuuuagugguaauuuagaaggugagggauucauucuuggaggggucuucguaguggggucuggaaaacaagggauucucuuagagcaucgcgagaaggaauucggggacaaagugaaucuucuuagcguauuagaagcggccaaaaugauaaagccucaaacucuggccagcgagaaaaaguag

SEQ ID NO: 14066 - RNA, 690 nt, Artificial Sequence
  Description of Artificial Sequence: Synthetic coding sequence
augucauuucuucaggauccuucauuuuuuacuaugggcauguggucaauuggagccggggcccugggcgccgcugcacuggcucugcucuuggccaauacugacgucuuucuguccaagccgcagaaggccgcccuggaauaccucgaagauaucgaucuaaagacucuggaaaaagaaccuagaacauucaaggcuaaagaacuuugggaaaaaaacggcgccguuaucauggccgugagaagacccggaugcuuccugugccgggaagaagcagccgaccucucuagucucaagagcaugcuugaucaauugggcgugccuuuauacgcugucgugaaagaacacaucagaacggaagucaaggauuuucagcccuacuuuaaaggcgagauuuuucuggacgaaaaaaaaaaauuuuacggcccucagagaagaaagaugauguuuaugggguuuauuagguugggggugugguacaauuucuucagggccuggaaugggggguucuccgguaaccuggaaggggagggauuuauccucgggggcguauucgugguuggcucuggaaaacaaggcauucugcucgaacauagagagaaggaauuuggugacaagguuaaucuguuaaguguguuagaagccgccaaaaugaucaagccccagacauuggccagcgaaaagaaguag

SEQ ID NO: 14067 - RNA, 1248 nt, Artificial Sequence
  Description of Artificial Sequence: Synthetic coding sequence
augucucccuuccuauaccuugugcugcugguguuaggacuccaugcaaccauacauugcgcaucccccgagggaaagguuacggccugccacagcucucaacccaacgccacucuuuauaagaugucuuccaucaaugcggauuucgcguuuaaucucuaucgccgcuucaccguugaaaccccugauaaaaacauauuuuuuucuccugucagcaucagcgccgcccugguuauguugucguuuggagccuguuguuccacucagaccgaaauaguagaaacucucggauuuaaucugacugacacaccaauggucgaaauucaacacggauuccaacaccucauuuguucucugaauuuuccaaaaaaagaacucgaguugcagaucggaaaugcccuuuuuaucgguaagcacuuaaagccauuagccaaauuccucaaugaugugaagacccucuacgagacagaagucuucagcaccgacuucuccaacauuuccgccgcuaaacaggagaucaauagccacguagagaugcagacaaaaggcaaggugguuggccuaauccaggaccucaagccaaacacaauuauggucuugguuaauuauauccacuucaaagcccagugggcaaacccuuuugacccuucuaaaacagaagauagcucaaguuuccucauugauaaaacuaccacgguccaagugccuaugaugcaccagauggagcaguauuaccaccucgucgacauggagcugaacuguacugugcuacagauggacuacaguaagaaugcccuagcauuguucguucugcccaaggaaggccaaauggagucuguggaggcagcuaugucaucuaagacacuuaagaaauggaaucgacuccugcagaaaggauggguugaucucuucguccccaaauuuucuauuagcgcuacauaugaccugggggccacgcuucugaaaaugggcauccaacaugcguauucagaaaacgcugacuucucugggcuaacagaggauaacggauugaagcuguccaaugccgcccacaaagcugugcuacacaucggcgaaaagggcaccgaagccgcugcugugccagaggucgaguuguccgaucaaccagaaaacaccuuucuccauccaaucauucagauagaccgguccuuuaugcugcucauacuggaacgcuccacccguuccauucuguuccugggcaagguugucaaccccacugaagcauag

SEQ ID NO: 14068 - RNA, 240 nt, Artificial Sequence; identical to SEQ ID NO: 12429
  Description of Artificial Sequence: Synthetic coding sequence

SEQ ID NO: 14069 - RNA, 486 nt, Artificial Sequence
  Description of Artificial Sequence: Synthetic coding sequence
augggucucucagguuuacugccuauauuagugccuuucauucuccucggagauauucaggaaccaggucacgcugagggaauccucgggaaaccuugccccaaaauuaagguagagugcgaaguagaagaaaucgaccagugcacaaaaccucgagacugccccgaaaacaugaaauguugcccauucucuagagguaaaaaaugucuggacuuccgcaaaaucuaugcagucugucacagaagauuagcuccugccuggccgccguaucauacagguggaaccaucaaaaaaaccaaaaucuguucagaguucauuuacgguggcucccaggggaauaauaacaacuuucaaaccgaagcuaucugccucgugaccugcaaaaaguaucauaaguccgcuuuacucuacacaauaaggaggagccuuaacaaucuucaggaucuagcacacaaucccggccucucaccccgcgucccugacuag

SEQ ID NO: 14070 - RNA, 261 nt, Artificial Sequence; identical to SEQ ID NO: 12431
  Description of Artificial Sequence: Synthetic coding sequence

SEQ ID NO: 14071 - RNA, 375 nt, Artificial Sequence
  Description of Artificial Sequence: Synthetic coding sequence
augccagcuuguagauuaggaccucuggcugcagcuuuacugcucucccugcucuuauucggcuucacccucgugucaggaaccggugcggaaaaaaccgggguguguccagaauuacaggcugaccagaacugcacacaggaaugcgugucggauagugagugcgccgacaacuugaagugcugcucagcaggaugugccaccuuuugcucucugcccaaugauaaggaagguagcuguccucaaguaaauauuaauuucccacagcucggcuugugccgugaucagugccagguggauucccaaugcccuggccagaugaaguguugccggaacggaugugguaaggucucuuguguaacuccuaauuuuuag

SEQ ID NO: 14072 - RNA, 1428 nt, Artificial Sequence
  Description of Artificial Sequence: Synthetic coding sequence
auggcagauaugcagaaccuugucgagagacuugagcgcgcuguuggccgccuagaagcugucucucauacaucagacaugcaccgugguuaugccgacucucccagcaaggccggcgccgcacccuauguacaagccuuugacagucuccuggcuggcccagucgcugaguaucugaaaaucaguaaggaaauugggggcgacguacaaaagcacgccgagauggugcacacaggacuaaaguuagagagagcccuguuggucacugccagucaaugucagcaaccugccgagaauaaacucuccgaccuguuagcgccaauuuccgagcaaauuaaagaaguuauuacauuuagagagaaaaaccggggguccaagcucuucaaccaccuaagugcaguuuccgagaguauucaagccuugggguggguugcuauggcaccaaagccuggcccguacgucaaggagaugaaugacgccgcaauguuuuauacgaauagaguucugaaagaauacaaggauguagauaagaagcacguagacugggugaaggcauaccuuucaaucuggacagaacugcaggcauauauuaaagaauuucauacuacuggacuugcgugguccaagacagggcccguggcaaaagaacuguccggacugccuuccggccccuccgcugggaguugucccccuccaccaccaccaugcccuccgccccccccagucuccaccauaucuuguucauaugaauccgccucucgaucuucucuguucgcccaaauuaaccagggcgaguccauaacgcacgcccuaaaacaugucucagacgacaugaaaacccacaaaaacccagcauuaaaagcucagucaggccccguccgcucuggccccaaaccguucucagccccuaagccacagaccuccccaaguccaaagagagcaacaaagaaggagcccgcgguccuggaguuagaaggcaagaaguggcggguggagaaucaggaaaacgucucaaauuugguuaucgaggacacagagcucaaacaggucgcuuacauuuauaagugcgucaauacaacccuccaaauaaaagguaagaucaacagcauaaccgucgacaacugcaagaaauugggacuuguguuugaugacgugguugguaucguagagaucauuaacagcaaagacgucaaagugcagguuaugggcaagguuccaacuauuuccauuaacaagacugacgggugucacgcuuacuuguccaaaaacucucuugauugcgaaauugugagcgcaaagaguucugagaugaacguuuuaaucccaacggagggcggggauuuuaaugaauuuccgguaccagaacaguuuaagacacuguggaacggccaaaaacuugucacuaccguuacugaaauugccggcuag

SEQ ID NO: 14073 - RNA, 438 nt, Artificial Sequence
  Description of Artificial Sequence: Synthetic coding sequence
auggcugacaugcagaaucuggucgagcgacuagaacgcgcuguuggccgccuugaggcuguaucucacacuucugacaugcacagaggauaugccgacucccccuccaaggccggagccgccccauacguccaagccuacauuaaggaauuccauacaacaggcuuagcuuggaguaagaccggucccguagccaaggaacuuucuggacuaccuucaggccccucagcagguucaugucccccucccccgcccccuugccccccuccccccccaguuucuacgaucagcugcagcuacgagagcgcuucccgcagcagcuuauucgcucagauuaaccaaggugaaagcaucacacaugccuugaaacauguauccgaugacaugaaaacacauaaaaauccagcacucaaagcacaaaguggacccguccgguag

SEQ ID NO: 14074 - RNA, 1428 nt, Artificial Sequence
  Description of Artificial Sequence: Synthetic coding sequence
auggccgauaugcagaaucucguggagagguuggaaagggcgguaggaaggcuugaggcaguaucgcauacaucagacaugcacagagguuaugcugacucuccgaguaaagcgggugcugccccuuacguccaggccuucgauucucugcuggccggaccuguggcugaguauuugaaaauaucuaaagagauaggcggcgauguacagaagcacgccgagauggugcauaccggacugaaauuagaaagagcccuacucgugacugccagucagugucaacagccugcugaaaacaagcugucagaccuacuugcuccaauuucugagcagauuaaagaagugauuaccuuucgugaaaaaaacagagggucuaaauuguucaaucauuuaucagccguaucagagagcauucaggcacucggcuggguagcuauggccccaaagccuggacccuacgucaaggaaaugaaugaugccgcgauguucuauacuaaccgagugcugaaagaguacaaagauguggacaagaaacauguugauuggguaaaggcauacuuaucuaucuggaccgaauugcaggccuacauuaaagaguuccacacgacuggacuggccuggucaaagaccggacccguggccaaagaacucaguggacuucccuccggacccagcgccggcucauguccuccuccuccaccccccugcccaccucccccuccagugucgaccaucucaugcucuuacgaauccgcuucgaggucuagccuguucgcccagauaaaucaaggagaguccauaacccacgccuugaagcacgugagcgaugauaugaaaacucauaagaaccccgccuuaaaagcacaauccgggcccguacgcuccgguccuaagccauuuuccgcucccaagccccagacuucaccaucgccuaagcgggcaacaaaaaaggaaccugcuguccuggaauuagagggaaaaaaauggagaguagagaaucaagaaaacguaucaaaucuugugauagaagauaccgaauuaaagcagguagcuuauauauacaagugugugaacacaacccugcagauuaaaggcaagauuaauuccauaaccguggacaauugcaaaaagcugggccugguguuugaugauguagugggaaucguagagauuauuaacagcaaggaugucaaagugcaagugaugggcaaaguccccacgauaucuauaaauaaaacugauggaugccacgccuaccuauccaaaaacucauuagauugcgaaaucgucucagccaaauccuccgaaaugaacgugcugauuccaaccgaggguggcgacuuuaaugaauuucccgugccugagcaauuuaaaacgcuguggaacggccagaagcuggugacuaccgugacggagauagccggauag

SEQ ID NO: 14075 - RNA, 1425 nt, Artificial Sequence
  Description of Artificial Sequence: Synthetic coding sequence
auggcggauaugcagaaccuugucgaacguuuagagcgcgcuguggguagauuagaagcagugucccacaccucugacaugcaccguggcuaugccgauucccccaguaaaggcgcagcuccauacguacaggcauuugacucucuucuggccggaccgguggcagaguaccuaaaaauuaguaaagaaaucgguggagacgugcagaagcacgccgagaugguacacacugggcucaaacuggaaagggcacugcuuguaaccgccagucaaugccagcaaccagcugagaauaagcucuccgaucucuuggcucccauuagugaacagaucaaagaagugauuaccuuucgugaaaagaacagaggaagcaaacuuuucaaccauuuaucagcagucuccgaguccauacaagcccuuggauggguggccauggcaccuaaaccaggaccuuacgucaaggaaaugaacgacgcagcuauguucuacacuaauaggguacuaaaggaguacaaagauguggacaagaagcacguagauugggucaaagcuuauuugagcaucuggaccgaacuucaggccuauauuaaggaguuccacacuacuggacucgccuggucuaaaaccggcccaguggcuaaagaacugucuggcuuaccauccgguccaagcgcagguucauguccucccccaccuccucccugccccccccccccccccgucuccaccaucaguugcucauaugaaagugcaagucggagcuccuuauuugcccagauuaaccaaggagaguccauuacccacgcuuugaagcauguuucugacgauaugaaaacacauaaaaacccugcacuaaaggcucagucuggccccguuagaagugggccuaaaccauuuagcgccccuaaaccccagacaucaccuucccccaaacgcgcgacaaagaaggaacccgcagugcuggaacuugagggcaagaaguggcgagucgagaaccaggagaacguuagcaaccuagugaucgaagauacggaacucaaacaaguagccuacauuuauaaaugcgugaacacgacgcuucagauaaagggaaagaucaacagcauaacagucgauaauugcaaaaagcuugguuuaguguuugaugacgucguugguauuguggaaaucaucaacucuaaggacguuaaagugcagguaaugggaaaagugccgacuaucucuaucaauaaaacagacgggugucaugccuaccuuuccaaaaauagucuggauugugaaauugugagcgccaagucuuccgaaaugaauguucuaauuccaacugaagggggagauuucaaugaguucccggugccagaacaauuuaaaacgcuguggaauggucagaaacuagucacuacugucacggagauugcaggguag

SEQ ID NO: 14076 - RNA, 1425 nt, Artificial Sequence
  Description of Artificial Sequence: Synthetic coding sequence
auggcugacaugcaaaauuugguggaacgacuggagagagccguaggcagguuggaagccguuucccacacuuccgacaugcacaggggauaugcugauucccccucuaagggugccgccccuuacguacaagcuuuugacucccuccuggcaggaccaguugcagaguacuugaagaucuccaaagaaaucggcggugaugugcagaaacaugccgagauggugcauacaggccuuaagcuagagcgcgccuugcuggugacugcaagccaaugccagcaacccgcagagaacaaacucucugacuuguuagcucccaucucugaacagaucaaggagguuauaaccuuuagagagaagaaccgcgguuccaagcuguuuaaccaccugucugccguuucugaguccauccaagccuuggguugggucgcuauggcaccaaaacccggaccauacguaaaggagaugaaugacgccgcaauguuuuauaccaauagaguccucaaggaauacaaggauguggacaaaaagcacguggacugggugaaagcauaucuaucgaucuggacugaacuccaggccuauauuaaggaauuccacaccacaggccuagcuuggucuaaaaccggaccagucgcaaaagaguugucgggacuccccagcggcccuuccgccggaagcugcccaccgcccccaccaccgugcccuccaccaccacccgugucuacaaucucuuguucuuaugaaagugccuccagguccucccuguuugcccagauuaaccagggcgagucaaucacucacgcucuuaaacaugugucagacgauaugaagacccacaagaaccccgcacugaaggcccaguccggccccgugcggucuggcccaaaacccuucucggcaccuaagccccagacuucaccuucucccaagcgugccaccaagaaagaaccugccguccuggagcuugaaggaaagaaauggcgcguggaaaaccaagaaaacgucucaaaccucgugaucgaagacacugaacugaaacaaguugccuauauuuauaaaugcguaaacaccacgcuucaaauuaagggcaagaucaacuccaucacagucgauaacugcaagaagcuuggacugguguuugacgacgugguaggcaucguggaaaucauaaauucaaaagacgugaaaguacaaguuaugggaaagguccccacuaucagcauuaacaagacugacggaugccacgcauaccuuucuaagaacucccucgacugugaaaucgugagugcaaaaucuucugagaugaauguccugauuccgaccgaagguggcgacuucaaugaguuccccgugcccgagcaguucaagacucuguggaacggacagaaacugguaacgacugugacggagaucgcuggcuag

SEQ ID NO: 14077 - RNA, 1428 nt, Artificial Sequence
  Description of Artificial Sequence: Synthetic coding sequence
auggccgauaugcagaaccugguggagcgacuggagagggcggugggcagguuggaggcugugagccacacaagcgauaugcacagaggauaugcagauucgccaaguaaagccggugccgcacccuacguccaggcuuuugauucacuccucgccggaccaguggccgaauaccugaaaaucagcaaggagauagggggggauguacagaaacaugcagagauggugcauacggggcugaagcuagagagggcccuuuuggugaccgccagucagugccagcagcccgcagagaacaaguugucugaccuguuggccccaaucuccgagcagaucaaggagguuaucaccuuucgcgaaaaaaacaggggaagcaaacuguuuaaccaucuauccgccguuucugagucaauucaagcuuuggguuggguugcuauggccccgaaacccggaccuuacgugaaagagaugaaugacgcagccauguucuacaccaacagaguucugaaagaauacaaggaugucgauaagaaacauguugauugggugaaggcauaccucuccaucuggaccgaacugcaagccuauauuaaagaguuucauacaacagguuuagcauggaguaaaaccggcccugucgccaaagaguuaagcggucuccccagcgguccaucagccgguagcuguccaccuccuccuccacccugucccccaccaccccccgugaguacaaucucaugcagcuacgagucagcuucacguagcagccucuuugcccagauuaaucagggugaaagcaucacucaugcccuuaaacauguaagcgacgacaugaaaacccacaagaauccggccuugaaggcacagaguggccccguccgaucugguccaaagccauuuucagcuccuaaaccccagaccucucccucuccuaagcgcgcaaccaaaaaagagccagcugugcuugaacuggaaggaaagaaguggcggguggagaaucaagagaacgucucuaaccuugugaucgaggauacagagcucaagcagguagccuauauuuauaaaugugucaacacuacgcugcaaauaaaaggcaagauuaauucaauaacaguagacaauugcaagaaacucggucucguuuucgacgaugucguagguauuguagagauuauuaacucuaaggaugucaaagugcaagucauggguaaagugcccacaaucucgauuaauaaaacagauggaugccacgccuaccucaguaagaacaguuuggacugugaaaucgucucugcaaagucaagugagaugaauguccucaucccaaccgagggcggugauuuuaacgaguuucccguucccgagcaauucaagacccuauggaauggccaaaaauuaguaaccaccgugaccgaaaucgccggcuag

SEQ ID NO: 14078 - RNA, 1209 nt, Artificial Sequence
  Description of Artificial Sequence: Synthetic coding sequence
augaccgcacugccuggcccgcucuggcugcuuggacucgcauugugugcacugggcggcggugguccaggccuuagacccccaccuggaugcccacagaggcgucucggcgcucgggaacguagagaugugcaacgggagauuuuggcugugcucggacuuccugguagaccucgcccaagggcuccuccagccgcuuccagacuaccugccagcgccccccucuucaugcuggaucuguaucaugcaauggcaggagaugaugacgaagacggggcucccgcugaacgcagauugggaagggccgaucuugugaugaguuucguuaacaugguggaacgagaucgggcacuuggacaccaggagccccacuggaaagaauuuagauucgaccugacacagauuccagccggggaggccguaaccgcugccgaauuucguaucuauaaagucccuucaauccauuugcucaaccggacccugcacguaagcauguuucaagugguacaggaacagaguaaucgagaaucagaucuuuucuuuuuagaucugcagacccucagagccggagacgaaggcuggcucguucuggacguuaccgccgcuucggacugcuggcuucugaaaaggcauaaagaccuagguuugcggcuguauguggagacggaagauggucacagugucgaccccggucuugcuggccugcugggucagcgcgcccccagaucgcaacaacccuucgucgugacuuuuuucagagcauccccaucuccuauuagaacgccaagagcuguuaggcccuugcgccgucgccagcccaagaaaucuaaugaauuaccacaggcaaacagguuaccagggauuuucgaugauguccauggaucucacgggagacaagugugucgaagacacgagcuguaugucaguuuucaagaccugggcuggcuggauugggucauugcuccacaggguuauucagccuauuauugugaaggugaauguuccuucccccucgacuccuguaugaacgcgacaaaccaugcaauucuucaaagccuuguccaccucaugaugcccgaugccgugcccaaggccugcugcgccccgacaaaauugucugccacuuccguacucuauuaugacucaagcaauaacgugauucugcggaagcacaggaauauggucgucaaagccuguggcugccacuag

SEQ ID NO: 14079 - RNA, 804 nt, Artificial Sequence
  Description of Artificial Sequence: Synthetic coding sequence
auggccgcuauucguauggguaagcugaccacgaugcccgcaggccuaauauacgcaucggugagcgugcaugccgcaaaacaggaagaaucuaagaaacagcugguuaagcccgaacaacugccaauauacaccgcccccccauugcagucaaaauauguugaagaacaacccggccaucugcagaugggauuugccucuauuaggaccgcgacaggauguuauaucgguuggugcaagggugucuacgucuucguuaaaaacggcauuauggacacaguacaguucggcaaggacgcuuauguuuaccugaaaaacccuccgagagauuuccugccaaagaugggcgugauuacuguuaguggacuggccggccuuguguccgcccgcaaaggaucaaaguucaaaaaaauuacuuauccccugggacuggccacccuaggugccaccguauguuauccaguucagaguguuauaauugccaaggugacagccaagagauauaugcugcaggcuucuaaguuccuggaacaauuaaaccauuguggacagaaagcggccaaaaagucacacagccugaacuugaagaagaccaaauugggaucaucauccgaaaucgaaguuccagcaaagacuacacacguacucaaacacagcgucccgcuucccacagaacugucuagugaagcuaagacaaaguccgaaagcacauccggcgcuacucaguucaugcccgauccuaaauugauggaucacggccaaucccacccagaagauaucgauauguacagcacucguuccuag

SEQ ID NO: 14080 - RNA, 807 nt, Artificial Sequence
  Description of Artificial Sequence: Synthetic coding sequence
auggcagcuaucaggaugggcaagcuaacaacuaugcccgcagggcugaucuacgccucugucucugugcacgcugcuaaacaagaggaaucgaagaagcaacucgucaaaccggaacagcucccaauuuauacagcuccuccauugcagagcaaauauguugaagagcagccaggccaucugcagaugggguucgccuccauaagaacugcuacagggugcuauauaggaugguguaagggcguguauguuuucgucaagaacggcauuauggauacagugcaauucgggaaagaugcauacguguaccugaagaaucccccccgagacuuuuuacccaagaugggcguuauaacugugaguggacucgccggccucgugucagccaggaaaggcaguaaguucaagaagaucacguacccccugggucucgccacacuaggcgcaacaguguguuaucccguccagagcguuauuauagcuaaaguaacugcuaagaagguguaugcuacuagccaacagauauuuggggccguuaaaagccuguggacaaagucauccaaagaagagucccuccccaagccuaaggaaaaaaccaagcugggguccagcucagaaaucgaaguuccagccaagacuacccacgucuugaagcacagcguuccacuuccaacagaacuuaguagcgaggccaagacaaagagcgaaucgaccagcggugccacacaauuuaugcccgauccaaaacugauggaccacggacagucccauccugaagacauugacauguacuccacuaggucguag

SEQ ID NO: 14081 - RNA, 3672 nt, Artificial Sequence
  Description of Artificial Sequence: Synthetic coding sequence
auggccccacuccgcgcccugcuuucuuaccugcucccucuccauugcgccuugugugcagcagcuggaucacguacucccgagcuucaucuauccggcaaguugagcgacuacgggguaacagugccauguuccaccgauuuuaggggacgcuuucugucacacguuguauccgguccugcggccgccucugcuggauccaugguagucgacaccccgccaacgcuaccaagacauaguucgcaucugaggguggcccgcuccccgcuccauccgggcggaaccuuguggcccgggaggguaggcagacauucacuguacuucaacguaacgguguucgggaaggagcuacauuuacguuuaagaccuaauaggcgguugguagugcccgggaguaguguggaguggcaagaagauuuccgagaacuauucagacagccucugcgucaggaauguguguacaccggaggagugacaggcaugccuggugccgccguggcgaucaguaacugcgauggauuggccggccucauucgcaccgacucaacagacuucuucauugagccauuagagcgagggcaacaggaaaaggaagcaucagggagaacacauguggucuaccgucgagaggccgugcaacaagagugggcugagccagauggagaccugcacaaugaagccuuugggcucggcgauuuaccaaaccuccucggcuuggucggugaucaguuaggagauacugagagaaagaggcgccacgcuaagccugggucauacaguaucgaaguccuucuggugguggaugauucagugguaagguuccacggaaaagaacacgugcaaaauuauguccugacccuuaugaacauuguagacgaaauuuaccaugaugagucacucggggugcacauaaauaucgcacuugugcgccuaauaauggugggauacagacagucacucucccuuaucgaacgcgggaacccuucaagaagucuggagcaaguuugccggugggcucacagucagcagcgacaggacccaagccacgccgagcaccaugaccacgucguauuccugacaagacaggacuuuggaccauccgguuacgccccuguuacuggaaugugucaccccuugagaucgugcgcucucaaucacgaagauggcuucucuagcgcauucgucauugcccaugaaacaggucacgugcuggggauggaacaugacggacaagggaaugguugugcugaugaaacgucuuuaggcuccgucauggcaccauuggugcaggccgcuuuucauagauuccacuggucccgcugcaguaaacucgagcucagccgcuaccugcccucuuaugauugucucuuggaugauccuuucgauccagcuuggccccaaccuccggaacucccagggauuaacuauucuauggaugaacagugccgguucgauuuuggaucaggcuaucagacuugcuuagcuuucaggaccuucgaacccuguaagcaacuuuggugcucacacccggacaaccccuacuuuugcaaaacuaaaaaaggacccccucucgacgguaccgagugugccccuggaaaguggugcuucaaagggcauuguaucuggaaaucuccugagcaaacauaugggcaggauggagguuggucuucguggacgaaguucggaagcuguucucguuccugugggggcggagugcggagcaggucaagaucaugcaacaacccuagcccggcuuauggaggccgucuuugucucggcccuauguucgaauaccaagugugcaacuccgaggaaugccccggaacauacgaagacuuccgugcucagcaaugugcuaaacguaacaguuauuacgugcaucagaaugccaagcacagcuggguuccuuaugaaccagaugaugaugcucaaaagugcgaacugaucugccagucagccgacacaggugaugucguguucaugaaucaagucguccaugacggcacuagaugcucuuauagagacccuuauucagugugugcaagaggagaaugugugccugucggaugugacaaagagguggguagcaugaaggcugacgauaaaugcggaguguguggcggggauaacucacauugcaggaccguuaaaggcacccucggaaaggcguccaagcaggcaggcgcucugaaacucgugcagauccccgcuggagccagacacauucagauagaagcucuggagaaaucgccccaccgcaucgugguuaagaaccaggucaccggaucauuuauacugaacccuaaaggaaaggaggcuacaucaaggacauucacagcaauggggcuggaaugggaggacgcuguggaagaugcaaaagaaagucuuaaaaccucagggccucugccugaagccauagccauucuggcucucccacccaccgaaggggggccucggaguucacucgccuacaaauaugugauucacgaggaucuucugcccuugaucgggucuaauaauguguuauuggaggaaauggauacuuaugaaugggcucuuaaaaguugggcuccaugcaguaaagcuugcggaggcgggauccaguuuacgaaauauggaugcaggaggcggcgggaucaucacauggugcagagacauuugugcgaucauaagaaaagaccuaagccaauccguagacgcuguaaccaacacccaugcucccaaccuguaugggugaccgaggaguggggggcuuguucccgaucuugcgguaagcuugggguccagacgagagguauccaaugccugcugccucucuccaauggaacacauaagguaaugccugccaaagccugcgcgggagauagaccagaagcaagaaggccuugccugcgcgugccaugucccgcccaauggaggcucggugccuggagccaguguagcgccacuugcggugaagguauccaacagagacagguuguuugcagaacaaacgccaacucacuggggcacugcgaaggcgaccgccccgauacaguucagguguguagcuuaccugccugcggcgguaaccaucagaauaguaccgugagggccgacguuugggaguugggaaccccagaaggacaauggguuccacaaucagagccccugcauccuauuaacaagaucaguagcacagagccaugcacuggcgauagauccguauuuugucagauggaaguguuagaucguuauuguucaauuccgggauaucaucgacuauguugugucuccugcaucaaaaaggccuccggaccuaacccuggcccagaccccggucccacaucauugccccccuucucaacacccgguaguccgcucccaggaccccaagacccagccgacgccgccgaaccucccggcaagccuacagggagugaagaccaccagcacgggcgcgccacacaacugccgggcgccuuggauaccaguagcccgggcacucaacacccuuucgcucccgaaacgccuauacccggugccucuuggucaauuaguccaacgacucccggcggccucccuuggggcuggacacagacucccacacccgucccugaggauaaaggucaaccuggagaagaucuccgucaucccggcaccagucugcccgcagcauccccagucacauag

SEQ ID NO: 14082 - RNA, 3681 nt, Artificial Sequence
  Description of Artificial Sequence: Synthetic coding sequence
auggcaccgcugagagcccugcuuucauaccuacucccauugcauugcgccuuaugugccgcugcuggcucccgcacucccgaguugcaccucucuggcaaacucucggacuacgguguaaccguaccuuguaguacugauuucagaggaagguucuugucccacguuguguccggucccgcugccgcaucagcgggcuccaugguuguggacaccccccccacccuccccagacauaguucacaccuccgagucgcacggucuccgcuccaccccggcggaacguuguggccaggccgggugggacgccauagcuuauacuuuaacguaaccguguuuggaaaggagcugcaccuccgucuuagaccuaaccgaagguuaguugugccggguagcagugucgaguggcaagaggauuuucgggaguuguuucggcagccccugaggcaggagugcguguacacaggaggcguaacuggaaugccuggugccgcgguugcaaucucaaacugugauggacuggccggccuaauccgcacugacagcaccgacuuuuuuaucgagccuuuagagcguggacagcaggagaaggaagcgucgggccggacccacgugguuuaccgccgcgaagcugugcagcaagaaugggcugaaccagauggagaccuucacaaugaggcauucggacucggggaucuuccuaaucugcuaggauuggugggcgaucagcucggcgacacagaacguaaaagaagacacgcaaagccaggcuccuacagcaucgaaguauuauuagugguggaugauuccgucgugagguuucaugggaaagagcauguccagaacuacguuuuaacucugaugaacauaguggaugagauauaccacgacgagagccugggcgugcauaucaauauagcgcucguuaggcugauaauggugggcuaucggcaaucuuugucauuaaucgaacgugguaaucccuccagaagcuuagaacagguguguaggugggcacauucucaacagagacaggacccuagccaugcagagcaccacgaccacgucguuuuuuuaacaaggcaggacuucggaccgagcggaaugcaggguuacgcuccggugacugggaugugccacccgcugcgcucuugugcuuugaaucaugaagaugguuuuaguucagccuucguuaucgcucaugagaccggccacgugcucgggauggaacaugauggccagggcaacggaugugcagaugagacgucucuugguucagugauggcaccccuuguucaagcggcuuuccauagauuucauuggucacgauguuccaaacuggagcuuucuagauaccuccccucuuacgacugucuguuagaugacccauucgacccagcauggccacagccuccugagcucccaggaauaaacuacucaauggacgaacagugucgcuucgacuucggaucuggauaccagaccugcuuggcauuccgcacuuuugagccguguaaacaacuuugguguucacaucccgauaauccuuauuucuguaagaccaagaaaggcccuccccuggacggcacagaaugcgcaccugguaagugguguuucaaagggcauuguaucuggaaaucucccgaacagacguauggccaggaugggggcuggucuagcuggacuaaauuugguucuuguucaagaaguuguggagggggcguucgaucuaggagcaggucuugcaacaaucccucuccagccuacggcgggcgucugugcuugggacccauguuugaguaccaaguuugcaauucugaagaauguccuggcacuuaugaagauuuuagggcccaacagugugccaaaaggaacucuuauuauguucaccagaacgccaaacacucauggguacccuaugagccagacgaugacgcucaaaaaugugaacuaauuugucaaucggccgacacuggugaugugguguuuaugaaucagguggugcacgacggcacccgcugcagcuaccgcgacccuuacucaguaugugcccgcggagaaugugugcccgucggaugcgacaaagaagucgguucuaugaaagccgaugauaaaugcggugugugcggcggcgacaacagucauugcagaacugugaaaggaacacuggggaaggcaucuaagcaagccggagcucuuaaacucgugcaaauuccggccggggcacggcauauacaaaucgaggcucucgaaaaguccccucauaggauugugguaaagaaucagguuaccgggagcuuuauucugaacccgaagggcaaagaagcaacauccagaacauucaccgcuaugggccucgagugggaggacgccguggaggacgcaaaggaaagccugaaaacgucaggcccuuuacccgaagcuaucgcuauccuggcacuccccccaacagagggaggcccaagaagcagccuugcauauaaguacguuauccacgaagaucuuuugcccuugauaggcuccaauaacguacucuuggaggaaauggacacuuaugaaugggcucucaagaguugggcuccuugcucuaaggccuguggaggcggcauccaauucacgaaguaugguugucguagacggcgcgaucaccacauggugcagagacaucucugugaucacaagaagcguccuaaaccaaucaggagaagaugcaaucaacacccuuguucccaaccaguguggguuaccgaagaauggggagccugcucaagaagcugcgguaagcuuggagugcagacacgcggaauccagugccucuuacccuuaucaaacgggacucauaaaguuaugcccgcuaaggccugugcgggagauaggcccgaggcacggaggccgugccuucgagucccaugcccggcucaguggagacuaggugcguggucccaaugcucugccacuugcggugaagggauucagcaaagacaggucguaugucgcacaaaugcgaauucgcucggacacugcgaaggcgaccgaccugauaccguccaaguuugcucacuacccgccugcggaggcaaccaccagaacucuaccguacgagcagacgugugggagcugggcacacccgagggucaaugggugccccagucugaaccguuacaccccauuaacaagauuucauccaccgagcccugcacaggcgacagauccguguuuugucaaauggaaguuuuggaccgguacugcagcauaccaggcuaucaucgacucugcugcgugucauguaucaagaaagccagugggcccaauccuggaccugaccccggccccaccagccugccuccuuucucgacuccgggcucuccccucccaggaccucaagaucccgcugaugccgcagagccuccaggaaagccaacaggaucagaagaccaucagcauggcagggcaacacaacugccaggagcccuggauaccucaucuccggggacccagcacccuuucgcccccgaaacuccaauccccggugccuccugguccauuuccccuacaacaccuggcggacuccccuggggauggacacagacaccaacuccuguacccgaggauaagggccaacccggugaagaucuccgacacccaggaaccucucugccugccgcuagccccguaacauag

SEQ ID NO: 14083 - RNA, 762 nt, Artificial Sequence
  Description of Artificial Sequence: Synthetic coding sequence
auggcugcagcaacuagagguuguaggccguggggcucucuccugggacuacuggggcugguaucugcugcugccgcugcaugggacuuagcuucacuccgcuguacgcucggggccuuuugugaaugugacuuucgcccugaucuuccaggccuggaaugugaucuugcacagcauuuagcgggacagcaucuugcuaaggcacuggugguuaaagcguugaaagcuuucgucagggacccugcgcccacgaagccccuaguuuuaucacuucacgguuggacaggaacagguaagagcuaugucagcucuuuauuggcccacuacuuguuccaaggcggauugaggucuccccgagugcaccauuucuccccuguucuccauuucccucaccccucacauauugagcgauauaagaaagaccuaaaaucuugggugcaagguaaccugaccgccuguggccgcucuuuguuucuguuugacgagauggauaagaugcccccugggcugauggaagugcuacguccguuuuuggggucauccugggucguguaugggacuaacuaucgcaaggcaauauucauuuucauucguugggguccugcucuccagugggcacaguggggagggcacuucagcgaaguucaguuauauucccuaaguuuaugcucccagcaaaacccugugccucacggccuuuccugggcuuuccccguuccaucagcaacucugcgcgacgacauagugauuccuccaggcuag

SEQ ID NO: 14084 - RNA, 966 nt, Artificial Sequence
  Description of Artificial Sequence: Synthetic coding sequence
auggcugccgcuacacgcggaugucgaccgugggguucccucuugggucugcugggacuugugucagcugccgcugccgccugggaccuggcuucucuuagauguacccuuggggcuuuuugcgaaugcgauuuuagacccgaccugccuggguuagaaugcgaccuugcccaacaucuugccggucagcaccucgcuaaagcccucgucgucaaggcccucaaggcguuuguccgcgaccccgccccaaccaagccccuugugcugagccugcacggauggacgggaacagggaaaucauacgugucuucucuucuugcucauuaccucuuccaagguggcuuaagaucacccagaguacaccauuucucuccagugcugcauuucccacacccuucccauauagaaagguacaagaaggaucuuaagucguggguacaaggcaacuuaaccgccuguggucgaucacuuuucuuauuugaugaaauggacaaaaugccucccggcuugauggagguguugcguccguuccugggcagcuccuggguaguguacggcacaaauuaucggaaggccaucuucaucuuuauauccaauaccgguggcaaacagaucaaccagguggcacuggaggcuuggaggucaagaagggacagagaggagauucugcuucaggagcuagaaccaguuauuagcagggcaguauuagauaacccccaucacggauuuuccaacucgggcaucauggaagagcggcugcuggaugcuguugugccuuuccugccccuacaaagacaucaugugcggcauuguguucucaaugagcucgcacagcucggguuagagcccagagacgaagugguacaggcuguccuggauucgacuacauuuuucccugaagaugaacagcuauucaguucuaauggauguaaaacaguggccucccgaaucgccuuuuuuuuguag

SEQ ID NO: 14085 - RNA, 576 nt, Artificial Sequence
  Description of Artificial Sequence: Synthetic coding sequence
augcaagucuggugcgaccagcgucaugaccccgguggcuggaccgugauccaacgcagacuggacggcagcgugaauuucuuucggaacugggagacuuacaagcagggcuuuggaaauauugauggcgaguacuggcuaggacuugaaaauauuuauugguugacaaaucaaggaaauuacaaacugcuagugacgauggaggacuggagcggcagaaaagucuuugccgaguacgcaaguuuccggcuugaacccgaaucugaguauuacaaauuacgucugggccgauaccacgggaaugcaggcgacaguuucaccuggcauaacgggaaacaguuuacgacccuggacagggaucacgacguuuacaccgggaacugcgcgcacuaccaaaaaggcggcuggugguauaacgcuugcgcccacagcaaccugaacgggguaugguaucggggcggccauuaucgaaguagguaucaggauggcguauauugggcagaauuuagaggaggcucauauucccucaaaaaaguaguaaugaugaucagaccaaauccaaacacauuucacuag

SEQ ID NO: 14086 - RNA, 1482 nt, Artificial Sequence
  Description of Artificial Sequence: Synthetic coding sequence
augcgaccauuaugcgugaccugcugguggcugggcuugcuggcagcaaugggcgcuguugcuggacaggaggaugguuuugaggguacagaagaaggcagcccccgcgaauuuaucuauuugaaucgguauaaacgugcuggcgagucccaggacaaauguacauacaccuucaucgucccccaacagagagugacgggagcuauuugugugaauucuaaagaaccugaagugcuguuagaaaaucgcguccauaagcaagaacuagagcugcuaaauaacgagcuucuuaagcagaagagacaaauagaaacucuccagcagcugguagaaguagaugguggaaucgucagcgaaguuaaguuguuacgaaaagaaucaagaaauaugaacagccgagugacacaauuauacaugcagcuccuccacgagauuauucggaagcgggacaacgcucuagagcugucccaguuagagaaucguauccucaaccaaaccgcugauauguuacagcucgccucaaaauauaaggacuuggaacacaaauaucaacaccuugcaacccuugcucacaaucagucagaaaucauagcucagcucgaagaacacugccaaagaguuccaagcgccagaccugucccccagccaccucccgccgcgccuccgagagucuaucagccacccacauacaaucgcaucaucaaccaaauuuccacuaacgaaauucaguccgaucagaaccuaaaagugcucccucccccccuccccaccaugccuacccugacaagucugccuaguaguaccgauaagccuagcggaccguggagagauugucugcaagcccucgaagauggacacgauacaucaagcauuuaccuaguuaagccggagaauacuaauagacugaugcaggucuggugugaucaaagacacgauccaggugguuggacagugauccaacggagacuggaugggucuguuaauuucuuuagaaacugggaaacguauaagcagggauuuggcaacaucgacggggaguacuggcugggucucgaaaauauuuauuggcucacuaaccaggguaacuacaaacugcuggugacaauggaagacuggagcggcagaaaaguguucgcggaauaugcaucguuuagguuggaaccagagagugaauauuauaaacugcgcuuggggagguaucacggcaacgccggggacuccuuuacauggcauaauggcaagcaguucacuacuuuggaucgagaccacgacguguauaccggcaauugugcccauuaccagaaaggaggguggugguauaacgcuugugcccacaguaacuugaauggaguuugguaccgaggaggucacuauaggaguagguaucaggauggcguguauugggccgaguucagaggaggaagcuauucucuaaaaaaaguugugaugaugauucgccccaacccuaacacauuccauuag

SEQ ID NO: 14087 - RNA, 1959 nt, Artificial Sequence
  Description of Artificial Sequence: Synthetic coding sequence
auggcugcugcagcguugcccccuagaccccuccuguuacuucccuuagugcugcuauuaucaggucggcccaccagagcagauagcaaaguuuuuggggaucucgaccaaguacggaugacaucagaaggauccgacugucgguguaaaugcauaaugaggccacucagcaaagacgccugcagccgggugcggaguggcagagcucguguggaagauuuuuacaccguagagacagugucgucugguacagacuguagaugcaguuguacggccccccccuccucccuuaauccaugcgagaacgaguggaagauggaaaaauuaaagaaacaggcuccagagcuguugaagcugcaaucaaugguagaccuccuagaagggacacuguauucuauggacuugaugaaaguccaugcuuacguacacaagguggcuucgcagaugaauacccuggaagagucgauaaaggcuaauuuaagccgugagaacgaggugguaaaagauucugugagacacuuaucugagcaauugagacacuacgaaaaucacuccgcaaucaugcuuggcauuaagaaagagcuuucucgccuggguuugcagcuguuacagaaggacgccgccgcugcucccgccaccccagcaacugguaccggauccaaggcccaggacaccgcacggggcaaagguaaggauauaucuaaguaugggagcguacagaaaaguuucgcugaucgcgggcugccuaaaccacccaaagaaaaguugcugcaagucgagaaauuacgaaaggagagcggcaagggaagcuuccuccagccaacagcuaagccccgggcacuggcucagcaacaggcgguuaucagaggguucacauacuacaaggcugguaaacaagaggucacugaggcggucgcagauaacacauuacaggggacuagcuggcuggaacaauugccucccaagguggaaggccgcaguaauagcgccgagccuaacagugcugaacaagacgaagcagaaccacgcucauccgagagaguugacuuggcguccggcaccccaacaucaaucccagccacuaccaccaccgccaccacuacuccaacuccaacaacuucacuccuucccaccgagcccccguccggcccagaagucagcagccaagggagagaggcuucuugcgaggggacccugcgcgccgucgauccaccggugcgucaucauagcuacggucggcacgagggcgcuuggaugaaagacccagccgcuagagaugauagaaucuaugugaccaacuacuauuacggcaacucacuggucgaguucagaaacuuagaaaauuuuaaacaagggcgcuggagcaauauguacaaacuccccuacaauuggauagguaccggccacguagucuaucaaggggcauucuauuacaaucgcgcauuuaccaagaauauuaucaaguaugaucuucggcagagguucguggccaguugggcccuguugcccgaugugguguacgaagacacaacccccuggaaguggagaggacacucugauaucgauuuugcaguggacgaaucugggcuuugggugauuuaucccgccgucgaugaccgcgacgaggcacaaccugaggucauuguuuugucccgcuuggacccaggcgaucucagcguacacagggaaacaacuuggaaaacccgacuuagacggaacuccuauggaaacugcuucuugguaugcgggauucucuaugcugucgacacuuauaaucagcaagagggacaaguagcauacgccuucgauacccauacaggaacugacgcgcguccacaacucccuuuucugaaugaacacgcuuacacaacccagauugauuacaauccaaaagaacgaguucucuacgcuugggacaacggacaucagcuuacauacacacugcauuuuguggucuag

SEQ ID NO: 14088 - RNA, 1641 nt, Artificial Sequence
  Description of Artificial Sequence: Synthetic coding sequence
augaaaaaucaggacaagaagaacggagcagcaaagcagucuaacccaaaguccucgccuggacagcccgaagcaggcccugaaggcgcccaggaacgcccgagccaagcagcccccgcuguugaagccgaaggaccgggauccagucaggcaccacgaaagcccgaaggagcgcaagcaaggacagcccagaguggugcucuuagagauguaucagaggaacuaucucgacagcuugaggauauccugucuaccuacugugucgacaacaaccaggguggucccggcgaagauggggcucagggggagccagccgagccagaggaugcugaaaagagccguacauaugucgcccguaacggugagccugaaccaacaccagucgugaacggggaaaaagaacccucuaaaggggacccaaacacugaggaaauaaggcagagugacgaagucggagauagagaccacagaagaccacaagagaaaaagaaagccaaaggucugggcaaagaaauuacccugcuaaugcaaacuuugaacacacuuucuacaccugaggaaaaacuggcggccuugugcaagaaauaugccgaacugcuggaagaacacagaaacucacagaaacagaugaaacucuuacaaaagaagcaaagccaacugguucaggagaaagaccaucuuagaggugagcacagcaaagcuguccucgcaaggagcaaguuagaaucccucugucgcgaguugcagagacacaaccgaucgcucaaagaagagggcguccagcgagcgcgcgaggaagaagaaaaaagaaaggagguuacgucacauuuucaagugacucugaaugauauacaacuccagauggagcagcauaaugagcguaacagcaaacuaaggcaggagaauauggaacuagccgaacgccucaagaagcuuauugagcaguaugaacugcgggaagaacauaucgacaaagucuucaagcacaaggaccugcagcaacagcuggucgacgccaaacugcaacaggcucaggaaauguuaaaggaggcugaagagcgccaccaaagggaaaaagauuuuuuguugaaagaagcaguugagucucaaagaaugugcgaacuuaugaaacagcaggagacccaccucaagcaacagcuugcccuguacacggaaaaguuugaagaauuccagaauacacuuucuaagucaucugagguuuuuacaacauucaaacaagagauggaaaaaaugacaaagaagauaaagaaauuagaaaaagagaccacuauguaccgcaguaggugggaaucaucgaauaaggcccuucuggaaauggcugaggagaagacagugagagacaaggaauuagaaggguugcagguuaagauccagagguuagaaaagcugugccgagcccuucaaacugagagaaacgacuugaacaagagggugcaggaucugagugcaggaggucagggaagucucacggacuccggaccagaacgaagaccugagggaccaggcgcacaagcacccagcucgccuagagucaccgaagcaccauguuauccuggugccccaucuaccgaggccagcggccaaaccgguccccaagagccaaccagcgcuagagccuag

SEQ ID NO: 14089 - RNA, 1641 nt, Artificial Sequence
  Description of Artificial Sequence: Synthetic coding sequence
augaagaaucaggacaagaaaaacggagcugccaagcaguccaacccuaagagcagcccaggacagccagaagccggaccggagggcgcacaggagagaccaucccaagcugcucccgcuguagaggccgagggacccggguccucacaggcuccaagaaagccagaaggcgcccaggcucggacagcacagaguggcgcgcuccgcgauguaucugaagagcuaucucgccaacuggaagauauauuaucuacuuauugcguggacaacaaccaaggagggcccggcgaggacggagcucaaggagagccugccgagcccgaggaugcagaaaaaucaagaacuuacguugcgagaaacggcgagccugagccgaccccuguugucaauggugaaaaggaaccuaguaaaggagacccuaacacugaggaaauccgucaaagcgaugaggugggagaccgggaccaucgaagaccccaggaaaaaaaaaaagcaaagggauugggaaaagagauuacgcuccugaugcagaccuugaacacgcuaaguacccccgaagagaaguuggcugcacuguguaagaaguaugcugaauugcuugaagagcaccgaaauagccagaagcaaaugaaacuacugcaaaagaaacaaucgcaguugguccaggaaaaagaucacuuacgaggagaacauuccaaggcugugcuugcccgauccaaacucgaauccuuaugucgcgagcugcaacgccauaauagaagucuuaaagaggagggcguccaaagagcgcgugaggaggaagagaaaaggaaggaaguaacgucacauuuucagguuacucuuaacgacauccagcugcagauggagcaacacaaugaaaggaacagcaaacuaaggcaggaaaauauggaacucgccgagcggcugaagaaacuaauugaacaguacgagcugcgggaggagcacauugauaagguguuuaaacacaaggaccuacaacaacagcugguggacgcuaagcugcagcaagcacaggagauguugaaggaggcugaggaaagacaccagagggaaaaagacuuuuuauuaaaggaagccguggaaucacagcgcaugugugaguugaugaaacagcaggagacacaucugaaacagcagcuggcccuauacaccgaaaaauuugaagaguuucagaauacucugucaaagaguagcgaaguguucacaacguuuaaacaggaaauggagaagaugacgaaaaaaauuaaaaagcuggaaaaagaaacuacuauguaccgcuccaggugggaaagcucgaacaaagcuuugcuggaaauggcugaggaaaaaacggugcgggauaaagagcucgaaggacuccaggugaaaauucaacggcuggaaaaauuguguagagcucuucaaaccgaaaggaacgacuugaacaaaagggugcaggaucugagugcuggcggacaggggaguuugaccgacagcggucccgaacgacguccggaggguccaggggcucaggcaccuucaucaccccgcgucaccgaagccccaugcuaucccggagcccccuccaccgaagccagcggucagacuggcccccaagagccuaccucagcuagagccuag

SEQ ID NO: 14090 - RNA, 1392 nt, Artificial Sequence
  Description of Artificial Sequence: Synthetic coding sequence
augcacgggucaugcagcuuccugaugcuucuucugcccuuacugcuguuacugguggcuacgacgggcccaguuggcgccuugacugaugaggagaaaaggcucaugguggaacuacacaaucuguaccgcgcccaaguuucucccacugcauccgauaugcugcacaugagaugggaugaggaacuggccgccuuugcuaaagccuacgcccgacaguguguuuggggacacaacaaggaaagagguaggcggggagagaaucuguuugcuaucaccgaugaaggaauggaugugccccuagccauggaggaguggcaccaugaacgugaacauuacaaucuguccgccgcuaccuguucaccuggacagauguguggucauuauacccaggucgugugggccaagacagagagaaucggauguggcagucauuuuugcgagaaacuucagggaguagaagagaccaauaucgaacugcuggucuguaacuacgaaccaccgggaaacgugaaaggcaaacggccuuaucaggagggaacaccuugcagccagugcccgagcggcuaccacugcaaaaacagucugugugagccaauaggcagcccagaggaugcacaagaccucccuuauuuagugacugaagcucccuccuuuagggccaccgaagcgucugauaguagaaaaauggguacucccucaucuuuggccacggguauccccgcuuuccuuguuaccgaaguuucuggcucacuggcaacuaaagcucugcccgcaguggagacucaagcgcccacuucccuugcgacuaaagacccccccuccauggccacugaggccccaccgugugugacaaccgaagugcccuccauccucgccgcgcacucucucccgagccuugacgaggaaccuguuacguuuccuaaaucuacccauguuccaauucccaaaucugccgacaaggugacugacaagaccaaggugccaagcagaagcccggaaaacucucucgaucccaaaaugucucugaccggugcacgagagcugcuuccgcaugcccaggaagaggccgaagcagaagcugagcugccuccaucuucugaagugcucgcuagcgucuucccggcacaggacaaaccaggggagcugcaggccacucuagaucauacuggucacacaaguuccaaaucucuuccgaacuuucccaacacauccgcgacggcuaaugcaaccggaggcagagcacuugcacugcaaaguucacucccgggugcugaggguccagauaaaccaaguguaguguccggccugaauucugggccaggccaugucugggggccacugcugggcuugcuccugcucccaccacuuguccuggcagguaucuucuag

SEQ ID NO: 14091 - RNA, 459 nt, Artificial Sequence
  Description of Artificial Sequence: Synthetic coding sequence
augauguugccucaguggcugcuccuuuuguuccugcuguuuuuuuucuuauucuuguugacacgcgguagucugucgccuaccaaauauaacuuacucgagcucaaggaguccugcauuagaaaucaagacugugagaccggauguugucaacgcgccccugauaauugugagagucacugugcugaaaaaggaagugaaggcucacugugccagacccaagucuuuuuuggccaguaucgcgcauguccuuguuuacggaaucugacauguaucuauucuaaaaacgaaaaguggcugaguaucgcuuacggaaggugucaaaagauuggucgucaaaagcucgccaaaaagauguuucucguccugccacccaguuguugccugcuacuucuccacuuauuaagcagucugcccagagcccugugcucuccaugcucgccagaaccaccuccuuag

SEQ ID NO: 14092 - RNA, 366 nt, Artificial Sequence
  Description of Artificial Sequence: Synthetic coding sequence
augaugcugccucaguggcuacugcuguuauuucuuuuguuuuuuuuuuuauuccuguugacucguggaagucugucucccacaaaguauaaccugcuagaauugaaagagaguugcauacguaaccaagacugugaaaccggcuguugucaacgcgcacccgacaacugcgagagucacugcgcagaaaaaggaagugaagggucacucugccagacacagguuuucuucggccaguaucgugcgugcccuugucugagaaaccuuacaugcauuuauuccaaaaacgagaaguggcuuucuauugcauacggacguugccagaagaucgggaggcagaaacucgcaaaaaagauguuuuucuag

SEQ ID NO: 14093 - RNA, 1122 nt, Artificial Sequence
  Description of Artificial Sequence: Synthetic coding sequence
augcgccuucucgcguggcugauuuuccuugcaaauuggggcggagcucgggcugaaccaggcaaguuuuggcacauugccgaccugcauuuggaccccgauuacaaagugaguaaggacccguuucaggucugucccuccgcaggaagucaaccagugcccgaugccggucccuggggagauuaucugugcgauucaccgugggcauugauaaacagcucaaucuaugcuaugaaagaaauagagcccgagccggacuuuauucuguggaccggagaugacaccccucacguccccgacgaaaaauuaggcgaggccgcugucuuggaaaucguagagcgacugacaaaacugauucgcgaaguguuuccagacaccaaaguauacgccgccuuagguaaccacgauuuccauccuaaaaaucaguuuccagcgggcagcaauaauauuuauaaucagauugccgagcucuggaagccuugguuauccaaugagucaauagcacuuuucaagaagggggccuuuuacugcgagaagcugccaggaccaagcggggcaggucgaauaguugugcuaaacacuaauuuauacuauaccagcaaugccuugaccgccgacauggccgaccccggacaacaguuccaguggcuugaggacguccugaccgacgcgucaaaagcaggggacaugguauacauuguaggacacguacccccaggguucuuugaaaagacacaaaacaaggcuugguucagggagggguuuaacgagaaauaucucaaagucguucgcaaacaucacagggucaucgcuggacaguucuucggacaucaccacacagauucuuuccgaauguuauacgacgacgcaggggugcccaucagcgccauguuuauuacccccggaguuacucccuggaagaccacucugccaggcguagugaacggugcuaacaauccggcuauuagaguauuugaguaugaucgcgcuacuuugaguuuaaaagugagaucccccgcagaggcucguggaggcggcugggaagggcuuaaaugcauuaccacuuucccacauagccaacucauccaccugccacucaccaccgaaccccaagaaggauag

SEQ ID NO: 14094 - RNA, 810 nt, Artificial Sequence
  Description of Artificial Sequence: Synthetic coding sequence
augaggcuguuggcuuggcucaucuuuuuggcuaauuggggcggugcacgagcagaaccugaagaagcccaaggaccuugcgcccaggaaaaaggaaaggggcccccccccacaucaauccuagccucccuagccccaggucucgaagcugggaaauuuuggcacauugcagaccuacauuuagauccggauuacaagguguccaaggacccuuuccaggugugucccucugcaggcagucagccuguaccagacgcgggccccuggggggacuaccugugugauuccccgugggcgcugaucaauucuucaauuuacgccaugaaggagauugaaccagagcccgacuucauccuguggaccggugacgauacuccccaugugcccgaugagaaacucggugaagcagcaguccuugagaucguggagcgcuuaacaaaacucauccgcgagguguucccagauacuaaaguguacgccgcccuagguaaucaugauuuccauccuaagaaucaguucccagcaggguccaacaauauuuauaaucagaucgcagagcucuggaagccaugguuaucaaacgaaagcauugcccuguucaagaaaggcgccuucuauugcgaaaaacuaccugggcccagcggagcaggcaggaucguugugcuaaacacaaauuuguauuauacuucgaaugcacugacagccgauauggcugauccuggucagcaguuucaauggcuagaagauguccugaccgaugcuaguaaagcgggcgauaugguuuacauugugggucacgugcccccauag

SEQ ID NO: 14095 - RNA, 1368 nt, Artificial Sequence
  Description of Artificial Sequence: Synthetic coding sequence
augagauugcuagccuggcugauuuuccuggccaacuggggaggagcuagagccgagccugggaaauucuggcauauugcggaccugcaucuggaucccgacuacaaagugagcaaagacccuuuccagguuugcccauccgcuggaagccagccagucccugaugcuggucccuggggugauuaucugugugacagccccugggcgcuuaucaacucgucgaucuacgcaaugaaagaaauugaaccagagccagacuuuauucuuuggaccggggaugacacaccacauguaccagaugaaaaacucggcgaagcugcaguguuagagaucguagaaagauugaccaaauugauucgugaaguguuuccagacaccaaagucuaugccgcacugggaaaucaugacuuucacccuaaaaaucaguuucccgcuggaucuaacaauaucuauaaucagaucgcugagcucuggaagccaugguuguccaacgagaguauugcucuguucaagaaaggcgcauucuacugugagaagcugccaggaccaagcggggcaggcagaauugugguauugaauacgaacuuguauuacaccucuaacgcacucaccgccgacauggccgacccaggucagcaguuccagugguuggaagaugugcuaacugacgccagcaaagccggcgauaugguguauauaguggggcaugugccaccagguuucuucgaaaaaacgcagaacaaggcuugguuuagggaaggguuuaacgaaaaguauuugaaagucgugagaaaacaucacagaguuauugcaggucaguucuucgggcaccaccacacagauagcuuccggaugcucuaugaugacgcaggcgucccgauauccgccauguucauaaccccagggguaaccccauggaagaccacccuccccggcgugguuaacggagcaaacaacccugcaauucgcguuuuugaauaugacagagccacccuaucgcuuaaggauaugguaacauacuucaugaaucucucucaggcaaaugcccagggcaccccucgaugggaguuagaauaccaauuaacagaggcuuauggugugccagaugccagcgcccacaguaugcacacuguucuggaucgcauagccggagaucagucaacucugcagagauacuauguauacaacagcgucagcuacuccgcaggaguuugugacgaggcuuguucuaugcagcacgucugcgcgaugcgucagguggauaucgacgccuacacaaccugccuguaugcgucugguacaacacccgucccccagcucccacuacuccucauggcuuuacuuggacugugcacccuaguacuuuag

SEQ ID NO: 14096 - RNA, 867 nt, Artificial Sequence
  Description of Artificial Sequence: Synthetic coding sequence
auggccuuagcaccuccgccuagaggccucuggcaggccaaagacauuucucccaucgugaaggccgcucgucgagauggagagcuuuugcugucugcccaacucgauuccgaagaaagggacccaggugucccaagaccuucccccuacgcacccuacauuuugguuuaugcaaacgaccuggccauuuccgaaccaaauagcguagcagugacauuacaaagguacgaccccuucccugcaggcgauccugaaccacgugcagcaccaaacaacuccgccgacccuaggguuagacgcgccgcccaggccacaggaccccuacaagacaaugaacucccuggucucgacgagcgcccuccccgcgcacaugcucagcauuuccacaaacaucagcuuuggccaagccccuuucgagcucugaagccaaggccuggccggaaggaucgucggaagaaaggacaagaaguguuuauggccgcuagccaaguacuggacuucgaugaaaaaacaaugcagaaagcacggcggaagcagugggaugaaccuagaguguguaguaggagguaucuaaaaguugacuucgcggauaucggauggaacgaguggauaaucucucccaaaaguuuugaugccuacuacugcgccggagcuugcgaguucccaaugcccaagaucgugcgccccuccaaccacgccaccauacaauccaucgucagagcaguugggauuauaccugggauaccagagcccuguuguguucccgauaaaaugaauagccuuggcgugcucuuuuuggaugaaaaccgaaaugugguccuuaaaguguacccaaacaugucuguugauaccugugccugucgcuag

SEQ ID NO: 14097 - RNA, 1626 nt, Artificial Sequence
  Description of Artificial Sequence: Synthetic coding sequence
augccguuucggcugcugauuccucugggcuugcuaugcgcuuuauuaccucagcaccauggggcuccuggcccugacggcucugcgccugacccugcccacuauucuuuuucccugacccuuauugacgcccuugacacccugcugauacuuggaaaugugucugaauuccaacgcgugguagagguucuccaggauuccguagacuuugauaucgauguaaacgcuucagucuucgaaacuaauauucgggucgucgggggccugcuuagugcgcaccuccuguccaaaaaggccgggguggaagucgaagcaggcuggccaugcucaggaccccugcugcggauggcggaagaggccgcgcgaaaauugcugccggcauuucagaccccgaccggaaugccauauggcaccgugaaucuguugcacggcgugaaucccggagaaaccccagugacuuguacugccggaauugggacauuuauuguugaauuugccacccucuccaguuuaacuggugacccugucuucgaagauguugcuaggguggcauugaugcgucugugggagucuagaucugacauuggccucgucgguaaccauauagacguucuuacagggaaauggguggcccaggacgcuggaaucggagccgggguggacuccuauuuugaguaccuaguuaagggcgcaauccuacugcaagacaaaaaguugauggcaauguuccucgaguauaauaaggcaauccgcaacuacacccgauucgacgauugguaucugugggugcagauguauaaagggacuguaucaaugccgguguuccaguccuuagaagccuacuggcccggauuacaaucucugauuggugauaucgauaaugcaaugcgcacuuucuugaacuauuauaccgucuggaagcaguuuggcggacugccugaauuuuacaauaucccucaaggcuacacgguugagaagcgugaaggcuacccguugcgacccgaacugauugagucugcuauguaccuguauagagcaacaggugauccaacccuccuugagcuggggagggacgccguagagagcaucgagaagaucuccaagguugaaugcggauuugcaacuauuaaggaccugagagaccacaaacuugauaauagaauggaaucuuuuuuucuggccgaaacaguaaaauaucucuaucugcuauuugauccaacaaauuucauucacaauaacgggaguaccuucgacgcugugauuacaccguauggcgagugcauacugggagcagggggauacauuuuuaauaccgaagcacacccuauugauccagcagcgcuucacugcugccagcgccuuaaggaagagcagugggaggucgaagauuugaugagggaguuuuauucacugaagagaucaagaagcaaguuucaaaagaacaccgugucuucuggcccuugggagccuccggcuaggccuggaacccuguuuaguccagaaaaucacgaccaagccagagagcgaaagccugccaagcaaaaagugccacuuuuaucauguccgucacaacccuuuacaaguaagcuggcccugcucggacaaguguuccucgacucaagcuag

SEQ ID NO: 14098 - RNA, 1737 nt, Artificial Sequence
  Description of Artificial Sequence: Synthetic coding sequence
augccauuucguuugcucauaccuuuagggcuccucugcgcucuccugccucaacaucauggagcaccuggacccgacggcagugcaccagauccagcccacuauagagagagagugaaggcaauguuuuaccacgcuuacgacagcuaucuggaaaaugccuucccauucgacgagcuuagaccacugacuugcgaugggcaugacaccuggggaagcuucucguuaacacuaauugacgcacuggacacccugcugauucuggguaacguuagugaguuccaaagagucguggaggugcuucaggauucaguagacuucgacauugacgucaacgccucuguuuucgagacgaauauuagaguggucggaggcuugcuuuccgcacaccuguuaagcaagaaggcuggaguagagguagaggcaggauggccaugcagugguccacuucugaggauggcagaggaggcggcaaggaagcucuuaccugccuuucagacgccuacaggcaugccuuacgggacugucaaccuacugcauggugugaaucccggcgagacacccgugacaugcaccgcaggaaucgguacauuuauuguagaguuugcgaccuuguccucccucacaggagauccagucuucgaggauguggcccgggucgccuuaaugcgucugugggaaucuagaucugacauuggacuagugggaaaucauauagacgugcucacagggaaauggguagcucaggacgcggguaucggggcuggaguagacagcuacuuugaguauuuggugaagggcgcgauccucuugcaggauaagaaacugauggcuauguuccuggaauacaauaaggcaauuagaaacuauacacgguucgacgauugguaccucugggugcagauguauaaggggaccgugagcaugccuguuuuccaaagcuuagaagcuuauuggccuggacugcaaucauugaucggcgacaucgacaacgccaugcgcacauuucugaauuacuacacaguuuggaaacaguuuggcggacugcccgaguuuuauaauauuccacaaggcuacaccgucgagaaaagggaaggcuauccucuaaggccugagcugauagagagugccauguaccuuuauagagccacuggugauccuaccuuauuagaauuaggacgagacgcggucgaguccauugaaaaaauuuccaagguugagugcggauucgcuacaauaaaggauuugagggaccacaagcuagacaaccgcauggaaucauucuuucucgccgaaaccgucaaauaccuguaccucuuguucgaucccaccaacuuuauccacaauaauggaucaaccuucgaugcagugaucacuccguacggugaguguauuuuaggggcuggggguuacaucuuuaauacugaagcgcauccaaucgaccccgcugcauuacacuguugccagaggcuuaaagaggaacaaugggaaguggaagacuuaaugcgcgaauucuauucuuuaaagcggagccggaguaaguuucagaaaaacaccguaaguucgggaccaugggaaccuccugcucgaccuggcacccuguuuucuccugaaaaucacgaccaagcucgcgagcgcaaacccgccaagcaaaaaguaccucuacucagcuguccaagucagcccuuuacuuccaagcucgcccugcucggacaaguauuccuggauucgucuuag

SEQ ID NO: 14099 - RNA, 495 nt, Artificial Sequence
  Description of Artificial Sequence: Synthetic coding sequence
augcguuccuguuauguagcccaagccggcuugaaacugccugggaguagugaucccccagccagcgcuagccagucaacccgcauuacagcuaguggauacggcccuccaucguccagaccauccaguagaguggugaacggcgaagaugccgugccuuacucauggccauggcaaguaucacugcaauaugagaaaagcgggucuuucuaccacacguguggugguucccugauugcaccugauugggugguuacugcaggccacuguaucucgaguucaagaaccuaucagguuguucugggcgaauaugaucgggccguuaaggaagguccagaacagguuauuccuauuaauucuggcgaucucuucguucacccgcuguggaauagaucauguguggcaugcggaaaugacaucgcgcucaucaagcuuuccagauccgcucaacuaggggaugccguucagcuagcuucccuuccucccgcuggcuag

SEQ ID NO: 14100 - RNA, 3663 nt, Artificial Sequence
  Description of Artificial Sequence: Synthetic coding sequence
augccagguuugcugaauuggauuaccggcgcugcccuaccccugacugcuucugaugucacgucauguguuucaggauaugccuuaggccucacagcgagcuugacuuauggcaaccuggaagcucaaccauuccaaggacuuuucguguacccccucgacgaaugcacuaccgucaucggcuucgaagccgugaucgcugaucgcguugugacggugcagauuaaggacaaggcuaaguuagagucgggccacuucgacgccucccacguucgaucccccacuguaacuggcaauauccugcaagauggcgugagcauugcuccacacucuuguacccccgguaaagucacacuggacgaggaccuugagcgaaucuuauuuguugcuaaucucggcacgaucgcucccauggagaacguuacgauuuucauaucaaccagcagcgaacugcccacucugccaaguggcgccguaaggguucugcuccccgccgucugcgcuccuaccgucccucaauuuugcacuaaaucaacaggcacuaguaaucagcaagcgcaaggaaaagacagacacugcuucggcgccugggcaccagguucuuggaauaaacugugccucgcaacccuacuuaacacagaggugucuaaucccauggaguaugaguuuaauuuccagcuggagaucagaggaccuugucuccuggcaggaguagaaucgcccacucacgaaauccgggcugaugcagcacccucggccagauccgcuaaaucuaucaucauaaccuuagccaacaaacacacuuuugacaggcccguagagauauuaauacacccuucugagccacauaugccacauguauugauugagaaaggggacaugacccuaggagaguuugaccagcaucucaaaggucgcacagauuucaucaaagggaugaaaaaaaaguccagagcugaaagaaaaaccgaaaucauacggaaaagacuccauaaggauaucccccaucacuccguaauuaugcuuaacuucuguccugaccugcagaguguucaacccugucucagaaaggcacacggagaauuuauauuucugauagaucggucgucaucuaugucagguauuucaaugcaccggguaaaggacgccaugcucguagcucugaaaucgcuuaugccagcuuguuuauucaacauuaucggauuugguuccacguuuaagagcuuauuuccaucuagccagacauacucugaagacucccuggcgauggcaugcgacgacauccagcgaaugaaggcugacaugggagguacuaacauccucaguccacugaaaugggucauuagacagccggugcauagagggcacccaagacuucuauuuguaaucaccgacggggcagugaauaacacaggaaaaguuuuagaguugguucgaaaccacgcauucucuacccgaugcuauucuuucggcauaggacccaacgucugucacaggcuggugaagggguuggcuucugugucagaagggagugccgagcuucuuauggaaggagagcgcuugcagcccaagaugguuaagucccugaaaaaagcgauggcuccagugcugagcgaugugacuguugaauggauuuuucccgagacgaccgaggugcuuguuuccccagucucugccucaucuuuguuccccggcgagagguuagugggcuauggaaucgugugugaugcuagccuccauaucagcaacccgagaagugacaagaggcgacgcuauucuauguugcauagucaggagaguggaagcaguguuuucuaucauucccaagacgauggaccugggcuggaagguggcgauugugcuaagaauagcggggcacccuuuauccugggucaagccaagaacgcuagacuggcaagcggagacucuacuacuaaacaugaucuaaaccugucucagcgucgucgcgcauacucaacuaaucagauuacaaaucacaaaccauugccgagagcaaccauggccucugauccuaugccugccgccaaaagauacccucugcguaaagccagacuccaggauuuaacaaaucagacaagccuggaugugcagcgguggcagaucgaccuucagccccugcuaaauuccggacaggauuuaaaucagggaccaaaguugcggggaccaggcgcaaggagaccaucacuccugccucaagggugucagccuuuccucccaugggggcaagaaacucaggccuggucaccaguucgcgaacgcaccagugacagccgcucuccuggagaccuggaaccaucucaucaucccucagccuucgaaacagaaacuucuucugacugggauccacccgccgaaagccaagagcgagcaagcccaucucgcccugcuaccccagcucccguucugggcaaagcccuggugaaaggacuccaugauagccagcgacuccagugggaagugucauucgaacucgguacgccuggaccagagcggggaggugcacaagacgcugauuuguggagcgagacuuuucaucaccucgcugccagagcaaucauccgggacuucgagcagcuggccgagagagaaggcgaaauugaacagggcagcaacagaagauaucaagugagugcguuacauaccagcaaagccuguaacauuauuaguaaguacaccgccuuuguucccgucgaugugaguaaaucucguuaucuuccuaccgucguugaauauccuaacucagccgcccuuagaaugcucgggucacgggccuuggcucagcaguggcgggguacaucgaguggcuucggccggccucagacuaugcugggggaagauagugcuccuggcaacggaaaauuucaagcccucaauauggaagcuaguccuacugcccuuuucagugaagcccgcagccccggacgagagaaacauggcgccagugagggcccacagcgcucucuagcuacuaacacuuuaagcagcaugaaagccagugaaaaucuauucggcucguggcuuaaucugaacaagucaagacuguugaccagggccgcaaagggcuuucuaagcaagccuuugauuaaagcaguagagucgacuuccggcaaccaauccuucgauuacaucccacuaguaucauugcaguuagcauccggcgccuuucuguugaacgaagccuucugcgaggccacccacaucccaauggagaagcugaaauggacuucucccuucaccugccauagaguaucccuaacgaccagacccagugaaucaaaaaccccuucuccucagcuuugcaccuccucaccuccacgccacccaucuugcgacucauucucccuugagccucucgccaagggcaagcugggacuugaaccacgagcuguaguagagcacacuggaaaacugugggccaccguugugggccucgccugguuggagcacucaucagcuagcuacuuuacugagugggaacugguggccgcgaaggcuaauucaugguuggaacaacaggagguccccgaaggacgaacucagggcacacucaaggcagcggcaagacagcuguucguccugcugagacacugggacgaaaaucucgaguuuaauauguugugcuauaauccuaacuacguuuag

SEQ ID NO: 14101 - RNA, 3051 nt, Artificial Sequence
  Description of Artificial Sequence: Synthetic coding sequence
augccuggguuauugaacuggauaacaggcgcagcccuuccauuaaccgcgucagacgugacuagcugcgugucgggcuacgcccuggggcucaccgcaagucuuaccuacggcaaccucgaagcccagccuuuccaaggacucuuuguauacccgcucgaugaaugcaccaccguaauuggauuugaagccguuauugccgauagagugguuacaguccagauuaaggauaaagccaagcuugaauccggccacuuugacgcgucucacgugcgcuccccaacggucacggggaacauucugcaggacgguguuucaauugccccccacucaugcacacccggaaaagugacccuggacgaggaucuugagcgaauuuuauuugucgcaaauuugggcacgaucgcgccaauggaaaaugucacuaucuuuaucucaacuuccucagaguugcccacucuuccuucaggcgcaguuagagugcuccucccugccgucugcgccccuaccgucccccaguucugcacaaaaucaacuggaacuuccaaucagcaggcucaagggaaggaucggcacugcuuuggcgcaugggccccagggucauggaauaagcugugcuuagcaacccuuuuaaacaccgaaguaaguaauccaauggaauaugaguuuaacuuucagcuugagauucggggaccuugucuccuggccggggucgaaagucccacccacgaaauccgggccgaugccgcaccuuccgccagaagugccaaguccaucauuauuacccucgcaaacaaacauacauuugaccgccccgucgaaauacuuauccaucccagugagccucauaugccucacguucuuaucgagaagggggacaugacucucggcgaguucgaccagcaccugaaaggacguacugauuuuaucaaaggaaugaagaagaaaagucgcgcugaacgcaagacggagaucauccgcaagaggcuccacaaagauaucccccaccauuccgucaucaugcugaacuuuugcccugacuuacaaagugugcagcccugccuaaggaaagcccacggggaauuuaucuuuuugauagacagauccucaagcauguccgggaucucaaugcacagggucaaggacgccaugcugguagcucugaagucuuuaaugccagccugccucuucaauaucaucggcuuugggucuacauucaaaucucucuuuccuucaucucagacuuacagcgaagacagccucgcgauggccugcgacgacauccaacguaugaaggcggauaugggcgguacuaacauccuuuccccucuuaaguggguuauccggcagccugugcaucgcggacacccuagacuucuuuucgugauuaccgauggugccgugaauaauacuggaaagguacucgagcugguccgaaaucacgcauucagcaccagaugcuauucuuucgguaucggaccaaaugucugucauagacuugugaaaggccuugccucugucucagaaggcucugcugaauuacuuauggaaggcgagaggcuucagccuaagaugguuaaaagucucaaaaaagcgauggcaccuguucugucagacguuacuguggaauggauuuuucccgaaacgacugaagugcuugucucaccuguguccgcuucaucacuguuuccgggcgaacgccuggugggcuaugggauugucugcgaugcaagucuucacauaucuaacccucggucagacaaaagaagacguuauucaaugcuccauucucaggagaguggaucuucuguguucuaccauucacaagaugacgggccaggacuggaggguggagauugugcaaagaauucaggagccccuuuuauccucgggcaggccaagaaugcccgccuugccaguggggacagcacuacuaaacacgaucugaaccugucucaaaggagaagagcauacuccacuaaccaaaucaccaaucauaaaccguugccacgcgcuaccauggcaagcgaucccaugccagcagccaagcgcuauccauugcggaaggccagacuccaggaccucacaaaucaaaccagccuagauguccagcgauggcaaaucgacuuacagccacuccugaacuccggacaagaucugaaucaggguccgaaacuaagaggaccgggagcccggcgcccaucgcugcugccucagggcugucagcccuucuugccuuggggacaggaaacacaagccuggucaccaguucgggaaaggacuuccgauagccgcaguccgggcgaucuggagccuagccaccaucccucugccuuugaaacagaaacgucaagcgauugggauccuccugcagaaagucaagaacgcgcaagcccuagcaggccugcgaccccagcucccguccuagguaaagcccugguuaagggucugcacgauucucaaagguuacagugggagguaaguuuugagcugggaacuccaggaccagaacggggcggagcacaagacgccgauuugugguccgagaccuuccaucacuuggccgcacgggcaaucaucagggauuucgaacaacucgccgaacgcgagggagagauagagcaggguucaaaccgccgguaucaaguguccgcacuacauacaucuaaagcaugcaauauaauuaguaaguauaccgcauucgucccagucgaugucagcaaaucgagauaucuuccgacagugguggaguauccgaauucagccgccuuaagaauguuagggucacgagcacucgcccaacaauggagaggcacaucauccggcuucgggagaccucaaaccauguuaggugaagacucagcaccuggcaauggcccacgaaagugcagucaaacuuugaugggguuuaagacaaaaacagagacugaacacuccguaaggggguggaaaccacgaggcgccuuacaaaaucaaucugugcucucuaccuccuggucccacuggccccccaagccccguagaacguccucgaccccugaacccuccuag

SEQ ID NO: 14102 - RNA, 3663 nt, Artificial Sequence
  Description of Artificial Sequence: Synthetic coding sequence
augccgggccugcugaauuggauaaccggagcugcucugccauugacggcauccgacgucacguccugcgucucgggcuacgccuuagggcuuacugcuucacuaacauacgguaauuuggaagcccagccuuuccagggauuauucguguacccccuggaugaaugcacuacaguuauugguuuugaagccguuauagccgacagaguggugaccguacagaucaaggacaaagccaaacuugaaagcggacauuucgaugcuucucacguucgcucgccaacggugacugggaauauuuugcaggacgguguuaguauugcuccccacuccuguaccccugggaagguuacucuugacgaggaccuggaaagaauucuguuuguugccaauuuagggacuauugcccccauggaaaaugugacaaucuucauuagcacuaguagcgaacucccaacacugccaagcggcgcagugcgagucuugcugccagccgucugcgccccaaccguuccacaguucugcacuaaaaguaccggcaccagcaaucagcaggcacagggcaaagacaggcauugcuuuggcgcaugggcacccggcucauggaacaaacugugcuuagccacacucuugaauaccgaaguuucuaaucccauggaguacgaauuuaauuuucagcuggaaauccgaggaccaugccuacuggcaggcguggagucacccacacacgagauacgagccgacgcagcuccuucugccagguccgccaaaagcauaaucauuacuuuggccaauaaacacaccuuugauaggccggucgagauccuuauccacccaucugagccacacaugccacacguauugauugaaaagggagauaugacauugggagaguuugaucagcauuugaaaggcaggacugacuuuauuaaagggaugaagaagaaauccagagccgagcggaagacagaaaucauaaggaaaagacugcacaaggacauaccccaccacucugugauuaugcuaaauuucugccccgaccuacaaaguguacagccaugccuccgaaaggcccacggagaguucauuuuccugauugaccguaguuccucaaugucagggaucucaaugcacagagugaaagacgcaaugcuuguggcccucaagagucugaugccagcuugccuauucaauaucauuggcuucgguagcacauucaagagccuguuuccaagcucucagacauauucugaagauagccuggcaauggcuugcgacgacauacagcggaugaaggcggauaugggcggcacaaauauacuaaguccuuugaagugggugaucaggcaacccguccaccgcggacauccucgguuacucuucgugaucacagauggagcgguuaacaauaccgggaagguccucgagcuuguaagaaaccacgcauucucgacgcggugcuacucuuucgggauugggccaaacguuugucauaggcuuguaaagggccucgcgucaguauccgagggauccgcagagcugcuaauggagggagagcgcuugcagcccaaaaugguuaaguccuugaaaaaagccauggcaccagugcuaagugaugucaccguagaguggauuuucccugagaccacagaagugcuagugucccccgugucggcuaguaguuuguuucccggagaaagacugguugguuacggaaucguuugugaugcaucucugcacaucucuaaccccagaagcgauaaacgaaggcgauauucgaugcugcacucacaagaguccggaaguucaguuuuuuaccauucccaggaugauggcccaggccucgaaggaggugacugugccaaaaacuccggagcuccauucauccucggccaagccaagaacgccagacucgccucaggagacagcacuacaaagcaugaccucaaccucagccaaaggagacgagcguauucaacuaaccagauuacuaaucauaagccacuaccacgcgccacaauggcuuccgaucccaugccugccgccaaacguuauccucugaggaaggcaagacuccaggaucuuaccaaccagacaagccucgacguccagcgcuggcaaauagacuugcaaccacuucucaacucaggccaagaccugaaccagggaccuaagcuccggggaccuggggcuagaagaccgucauuacugccacagggcugucaaccuuuucuucccugggggcaagaaacacaggcauggagucccgugagggagaggaccuccgacucccgaucuccaggagaccucgagccgucgcaccacccguccgccuuugagacagagaccuccuccgauugggaccccccugcagagucacaagagagagccagcccuagucgaccagcuacucccgcccccgugcuggguaaagcccuagucaagggccugcacgauagccaacgauuacaaugggaaguuucuuucgagcuaggcacaccuggcccugaacgaggcggcgcacaggaugcagauuuguggagcgagaccuuucaucacuuggcagcucgcgccaucaucagggauuuugagcagcucgccgaaagagagggcgaaauugagcaaggcagcaacagaagauaucaggucagcgcccugcacacaucuaaggcuuguaacaucauuagcaaauacaccgccuucguuccuguugauguguccaagagccgcuaucuuccuacagucguggaauaccccaacuccgccgcuuugagaaugcuggguucgagagcucuugcucaacaauggcggggcacuagcuccggauuuggaaggccucagacaauguuaggcgaagauucugccccuggcaauggcaaguuccaagcacuuaacauggaagcuagcccaaccgccuuguuuucagaagccagaagccccggcagggaaaagcauggagccagugaagguccucagaggucucuggccaccaacacacugaguaguaugaaagccucugagaaucuguucggaucguggcugaaccugaacaaauccagauugcugacccgggcugcaaaaggguuucuuaguaaaccucugaucaaagccguggaauccaccucugguaaucagucuuuugacuacaucccgcuagucucccuacagcuggccaguggggcauuucuguugaacgaagcuuuuugugaagccacucauaucccuauggaaaaacugaaauggacaagcccuuucacaugccaucgagugucacuuacaacccgacccuccgagucaaaaacucccuccccgcagcucuguacauccucccccccuagacauccaucuugugacucauuuagccuggaaccucuugcaaaaggcaaauugggccuggagccaagagccguuguggagcacacaggaaaauugugggcaacaguaguugggcuugccuggcucgaacauuccagugccucauacuuuacugaaugggaauuggucgccgccaaggccaacuccuggcucgagcagcaagaggugccggaaggacggacacaagguacacuaaaggcugcugcuagacaacuauucgugcugcuuagacauugggaugaaaaccuagaauuuaacaugcucugcuacaacccuaauuacguauag

SEQ ID NO: 14103 - RNA, 5235 nt, Artificial Sequence
  Description of Artificial Sequence: Synthetic coding sequence
augcggcugcuauggggacuaaucugggccucuaguuuuuuuacauuaucacugcaaaagccgagacucuugcucuuuucaccgucgguugugcaucugggugucccucugucaguggggguucaacugcaggacguaccuaggggccaggugguuaaggggagcguguuucugcgcaaccccucccgcaauaacgugccaugcucuccaaaaguagauuuuacgcucucuagcgaaagggacuuugcauugcucucccuacaagugccauuaaaagaugccaagucuugugggcuccaucaacuuuugcgcggccccgagguacaguugguugcccauaguccguggcugaaggacucccuauccagaaccacgaacauucaggggauaaauuugcuauuuucaagcagacgcggacaucuauuccuacagacagaccagcccaucuauaauccuggccagaggguccgguaccgaguguuugcccucgaucagaaaaugcguccuuccacagauaccaucaccgugaugguugagaacucccacggcuuaagaguccgcaagaaagaaguguacaugccuaguagcauuuuccaggaugacuuugugaucccggacauaucugagcccgggaccuggaagauaucagcccgguuuucugacggucucgaaucaaacuccuccacacaauucgaaguaaaaaaauauguucugccuaacuuugaagugaagauuaccccugguaaaccuuacauacugacagucccaggacaccuugaugagaugcaacuggacauccaggccagauacauuuacggaaagccuguacagggaguggcguaugugcgcuucggccuccuggacgaagacggaaaaaaaacauucuuccgcggguuagagucccagacgaaacucgugaacggccaaucucacaucucccuuuccaaggcagaauuucaggaugcauuagagaaacuaaauaugggaauuacugaucuacagggccuccgccuuuauguagcugcugccauaauugaguaucccggaggagagauggaggaagcugaacucacuuccugguauuucgucuccucucccuucaguuuggauuuaucuaaaacaaagcgccaccuugucccuggggcgccuuuccuucuucaagcacugguccgagaaauguccggcuccccagccuccgggauuccugugaaaguaagcgcgaccgucaguuccccuggcucgguuccagaggugcaggacauucagcaaaacacagauggaucaggacaggucucaauccccaucauuauuccacaaacaauaagugagcugcagcuuuccguuucugcaggauccccgcacccugcgauugcacguuugacuguggcagcaccgcccagugggggacccggauuucucucuauugaacgucccgauuccaggccgccccguguuggcgacacacugaaucucaaccugcgggcagucgguucuggugccacauucagccauuauuacuauaugauuuuaagccgcgggcaaaucguauucaugaaucgagaaccaaaacgaacccuuacuucagugucaguauuugucgaucaucacuuagccccuuccuuuuauuucgucgccuuuuacuaccauggggaccauccugucgccaacucacugcgcguagaugugcaagcaggggccugcgaaggcaaauuagagcugucugucgauggugccaaacaauauagaaacggcgaaagcgugaaacuucaccuugagacggauagccuggcacucguagcacuuggugcucuugauaccgcgcuguaugcagcuggcaguaaaagccacaagccauuaaauaugggaaaaguauuugaggcuaugaacaguuaugacuuaggaugcggacccggggggggcgauuccgcucuacagguguuccaggcugccggacuggcauucuccgauggugaucaguggacucuguccaggaaacgacuaagcugcccuaaagaaaagaccacaagaaaaaagagaaauguuaacuuucagaaggcaaucaacgagaagcuggggcaauacgcuuccccuaccgcuaaacgauguugucaagacggaguuaccagguugccuaugaugagauccugcgagcagagagcagcaagagugcagcagcccgauugcagagagccuuuucuguccuguugccaguuugcugagagucuacguaagaaguccagagacaagggacaggcuggguuacaacgagcucucgagauuuugcaggaagaggaccucauugaugaggacgauauaccgguucgaucuuucuuuccugagaacuggcuguggcguguggaaacaguggauagauuucagauccugacacuguggcugcccgauaguuuaacaacuugggaaauacauggacugucgcugaguaaaacaaagggacugugcguugcgaccccaguccaacuccgaguuuucagagaauuccaucuacaccuucgauugcccaugucagugaggcgcuuugagcagcucgagcugagacccgugcucuacaacuaccuggauaagaaccugacuguguccgugcacgucucaccaguggaggguuuaugucucgccgggggcggaggccuggcccaacaggugcuggucccugcugggucugcaagacccguggccuuuagcguggugccgacagcugcggcggcagucucccuuaaaguaguagcccgaggguccuuugaauucccagucggugaugccgugucaaaggugcugcaaaucgagaaagaaggagcaauccaccgugaagaacuugucuaugaacugaacccacuugaccaucgcgggcggacgcuggaaaucccaggcaauuccgacccaaauaugauacccgacggcgacuuuaacaguuaugucagaguuacugcauccgacccacucgauacuuugggaagcgagggugcccuuucaccuggaggggucgccaguuugcugaggcuucccagagguuguggggaacagacaaugaucuauuuggcuccaacacucgccgcuagccguuacuuagauaagacagagcaauggucaacguuaccaccagaaacuaaggaucaugccgucgaccucauccagaagggcuauaugagaauacaacaauuuaggaaagcagacgggagcuacgcugcauggcucucgcgggggaguaguaccuggcugacagccuuuguccuuaaaguccuuucucucgcccaggagcagguggguggcucucccgagaaacuucaagagaccucuaacugguugcugagccagcagcaggcugacggauccuuucaggaccugagucccgugauccaccgcagcaugcaggggggacugguggguaacgacgaaacuguggcauuaacagcauuugugaccauagcacugcaucauggccuggccguguuucaggaugaaggagcugagccuuugaagcaaagaguggaggcaucuaucucgaaagcguccuccuuuuugggugaaaaggcaagugccggcuuauugggugcgcaugccgccgcaauaacugcuuaugcauugacgcuuacuaaagcuccagccgaccugcgcgggguagcucacaacaaccugauggcgauggcacaggagaccggagacaaucucuauuggggcucggugacaggaagccaauccaaugcagugucaccaaccccagcuccuagaaauccguccgacccuaugccccaagccccagcucuuuggauagagacuacagcauacgcccuccuccaccugcuucuccacgagggaaaagccgaaauggccgaucaggcagcugcuuggcuuacacgacagggcucuuuucaaggcggcuuuaggaguacacaagauaccgucauagcuuuagaugcccugucugccuauuggaucgcaucacacacaacugaagaacggggcuuaaauguaacccugucuagcacuggccgcaauggcuuuaaaucccacgcccugcaacugaacaacagacagauacggggccuagaagaggagcuacaauucagccucggcuccaaaaucaaugucaaagucggggggaacuccaaggggacucugaaaguacuacgaacuuacaacguacuugacaugaaaaacaccaccugccaggaucugcagaucgaagugaccgucaagggccacguggaauacacuauggaagcuaacgaggacuaugaggauuacgaauacgacgaguuaccugccaaagacgauccagaugcuccccuucagccagucacuccuuugcaacuguuugaagggagaaggaaucgaagacguagggaagcgccuaaagucguggaggaacaagagucaagagugcacuauaccguguguauauggagaaacggcaaaguuggguuguccggaauggccauugcugaugucacccuucucaguggguuccaugcauuacgagccgaucucgagaaguuaacuucacuaagcgaucgauacguaucacauuucgagaccgaaggaccacauguacuucucuacuucgauucugucccuacuucaagagaaugcgugggguuugaggcaguccaggaagucccugugggccuggugcagccugccucugccacacuguacgacuacuauaacccagaacgccgguguucaguuuuuuauggcgcucccucaaaaucuagguuacucgccacguuaugcagcgccgaagucugucaaugugcagaaggaaagugccccaggcaaaggcgcgccuuggagcgugggcuucaggaugaggacggcuacagaaugaaauucgcuugcuacuacccacggguugaauauggcuuccaggucaaaguacucagggaggauaguagagccgccuuucgcuuauucgagacuaagaucacacaggugcuucacuuuaccaaagacguuaaagccgccgccaaccagaugagaaacuuccuagucagagcuagcugccgauuacgccuugaaccggggaaggaauauuugauuauggggcuggauggcgccacauaugaccuugaagggcauccccaauauuugcuggacuccaauuccuggauugaagagaugccuagcgaacgguuaugucgauccacucgucaaagagcagccugcgcacaacuaaacgacuuucugcaagaauacggaacacaagguugucagguuuag

SEQ ID NO: 14104 - RNA, 1242 nt, Artificial Sequence
  Description of Artificial Sequence: Synthetic coding sequence
augaaaggagcgcugggcucaccugucgcagcagcaggcgccgcaaugcaggaguccuucggcuguguuguggcuaaucgauuccaccagcucuuggaugaugagucagacccauucgauauuuugagagaagccgaaagacggagacagcagcagcugcagaggaaacggcgagaugaggcugcagccgcagcaggggcuggaccacgggguggaagaagccccgcgggggccucuggacaccgggccggagcaggagguagaagggaaucccagaaagaacggaaaucacugccagccccuguagcucaaagaccugauucaccggggggaggauuacaagcuccaggucagaagaggacaccacggcgaggcgaacaacagggcuggaacgacaguagggguccagaggguaugcuugaaagagcggagaggcgaaguuaucgcgaguaccgccccuacgaaaccgagcgccaagcagacuucacggccgagaaguucccagacgagaaaccaggcgauagauuugauagggaccggccguugcguggccgaggaggacccaggggugggaugagaggcagggggaggggggggcccgggaauaggguuuuugaugcauuugaccagcgaggcaagagagaguuugaaagauauggagguaaugauaagaucgccgugaggaccgaagauaauauggggggcugcgggguccguacuuggggcucuggaaaagacacauccgacguugaaccuacugcaccaauggaagagccuaccgucguggaagagagccagggcaccccugaagaagaaagcccagcuaagguaccagagcuugaagucgaggaagagacgcagguacaggagaugacuuuggaugaauggaagaaucugcaggaacagacuagaccgaaacccgaguuuaauaucaggaagccugagucuacaguaccaucuaaagccguugugauccauaaaucgaaauaucgcgacgacauggugaaggacgauuacgaggacgauucacauguauuucggaaaccugcuaaugauaucacuagccaauuggagaucaauuucgguaauuugcccaggccaggcaggggcgcaagagguggcaccagaggaggccggggaagaauacgucgagccgaaaauuauggaccuagagccgaagucgugaugcaggacguggcgcccaacccagaugaccccgaagauuucccugcucuauccuag

SEQ ID NO: 14105 - RNA, 927 nt, Artificial Sequence
  Description of Artificial Sequence: Synthetic coding sequence
augaaaggugcacucgggucuccaguagcugcagccggcgccgcaaugcaggaauccuucggaugcgugguggccaauagauuucaccaguugcuggacgacgagucagauccauucgauauucugagagaggcggagagaagaagacagcagcagcugcagagaaagcgcagagaugaagccgcagcggccgcgggcgcaggaccacgcggggggcgaucuccagccggggcauccggccaccgugccggcgccgguggccggcgugagucucaaaaagaaagaaaaagccuuccagccccaguggcucaaagacccgacucuccuggaggaggccuucaagcgccaggccagaagagaacuccaaggagaggagaacagcaaggauggaaugacaguagaggacccgaaggaauguuagagcgagcggaacgcaggucauauagagaauacagaccuuaugaaaccgagagacaggcugauuucacugccgaaaaauucccagaugagaaaguuccggaauuggaaguugaggaggaaacacagguucaggagaugacuuuggacgaauggaaaaaucugcaggagcagacgcgcccaaagccagaauuuaacauuagaaaacccgaaucaacgguuccaagcaaagcugugguuauucauaaauccaaguaucgcgaugauauggugaaagaugacuaugaggaugauagccacguguuccggaaaccugccaaugauaucacgucccaguuggagauuaauuucgguaaccugccgcgcccagggaggggcgcacggggagguacaagaggcggcagagguagaaucagacgagccgagaacuacggaccaagggcagaaguggucaugcaggauguggcucccaacccagaugauccugaagauuuuccagcccugaguuag

SEQ ID NO: 14106 - RNA, 1437 nt, Artificial Sequence
  Description of Artificial Sequence: Synthetic coding sequence
augccccggaggggauauucuaagccggggucauggggauccuucugggcuaugcugacucugguaggcuugguuacucaugcugcucaaagggccgacguugggggagaagccgcugggacgucaauaaaccacagucaggccguuuugcaaagacugcaagagcuguuaagacaggggaaugcauccgauguggugcugcgcguccaggcagcaggaacugaugaggugcgcguguuccacgcucaccguuugcuccugggacuucacucugaguuguuuuuagaacuguuaaguaaucaauccgaagcugugcugcaggaaccccaggacugcgccgcuguguucgacaaguuuaucagauauuuguauuguggagaguugacugugcuccugacccaagcuauuccccugcaucgguuagcuacuaaauacggagucuccagccuccagcggggcgucgccgauuacaugcgagcccacuuagccgggggugcuggucccgcuguaggaugguaccacuacgcuguggguaccggggacgaagcacucagagagucaugccuucaauucuuagcuuggaaccucucugcugucgccgcaucuacagaauggggggccgucagucccgaauuacucuggcagcugcuacagcgcucagaucuuguguugcaggaugaacucgaauuauuccacgcacuagaggcuuggcugggcagggcuagacccccaccagcuguugcugagcgcgcucugagggcaauccgguacccuaugaucccucccgcccaacuguuucaacuucaggcccgaucugcagcccuagcuagacauggcccugccguggccgauuuacugcugcaggcuuaucaauuucacgccgcuucaccucuucacuaugcuaaguucuuugacgucaacgggucagcuuuccuccccagaaacuacuuagcucccgccuggggcgccccuuggguuauuaacaauccggcuagggacgaccgcagcacuucuuuucagacacaauugggaccuucaggccaugacgcugggcgucgugugaccuggaauguacuguucucaccaagaugguugccaguuagccuacgaccuguguaugccgacgccgcugguaccgcucugccagcagcuaggccagaagauggucgaccaagacuggucgugacuccggccuccucuggaggcgacgcggccggggucuccuuccaaaagacaguucuaguaggcgcuaggcaacaaggcaggcuccuagugcgacacgcauauucuuuccaucaguccuccgaagaagccggagacuuccucgcccacgcugaccuucagagaagaaauuccgaguaucucguugaaaaugcccugcaucugcaucucauugugaagccagucuaccacacccucauuagaacgccaaaguag

SEQ ID NO: 14107 - RNA, 477 nt, Artificial Sequence
  Description of Artificial Sequence: Synthetic coding sequence
auguguuguccaggcggccauuauaccuugauccugagaaggggaaauagauuuagacgagagaagcgcccugccaaggucacuggagcucaaaccgaggugcagcucgcuccuccccugccccgcggccgugccagacgaagcccuuggucagucccaaucagcuuaagcaucgaccggcuggaguuugaucuacuguaucccgcuaucaagggggacacaauucaguuauaccugggggcaaagcuuuuggauucgcagggcaaggucacgaagugguuuaacaacucugcugcaucacucaccaugcccaccuuggacaauauacccuuuucucuuauugugagucaagauguaguuaaagcugcggucgccgcuguucugagucccgaagaauucauggugcuacuagacaguguccuucccgaauccgcccauagauuaaaaucaucaauaggacugauaaaugagaaauag

SEQ ID NO: 14108 - RNA, 771 nt, Artificial Sequence
  Description of Artificial Sequence: Synthetic coding sequence
auguuccagacugggggccugaucguuuuuuauggccuucuugcgcaaaccauggcgcaguucggaggcuugcccgugccucuggaucaaacccugccccugaaugucaaucccgcacuuccgcugucaccuacuggcuuagcagggucauuaacuaaugccuuaucgaacggguuacuaagcggcggccucuuagguauacuggaaaaccuaccucuccuggacauccugaaaccgggaggcggaaccucagggggcuugcugggcgguuuauuggggaaaguuacaucaguuaucccaggguuaaauaacauuauugacauuaagguaacugacccacaguugcuagaauuagggcugguucagucuccagacggccacagacuguauguuaccauuccacuagguaucaagcuucaagugaacacgccucuagugggcgccucuuuguugcgccucgccguuaaacuagacaucacagcagaaauccuagccguucgggacaaacaggaacguauucaccugguucucggugacugcacccacucuccagggucucugcagauuucacucuuggacggccucggcccgcugccaauacaagggcuccucgacucgcucacuggaauacucaacaagguccugccugagcuggugcagggaaauguguguccucucguuaaugaaguguugcgcggauuggauauuacccuggugcacgauauuguuaauaugcuaauucacggauugcaguuugucauaaagguauag

SEQ ID NO: 14109 - RNA, 771 nt, Artificial Sequence
  Description of Artificial Sequence: Synthetic coding sequence
auguuccaaacaggagggcucaucguguucuaugggcuccuggcccagacuauggcucaauuuggagggcugcccguacccuuagaccagacgcucccacuuaaugucaacccagcgcuaccacuguccccaaccggacuugcuggaucucugaccaacgcccuguccaacggccugcugucggggggucuucuugguauucuggaaaauuuaccacugcuggacauuuuaaagccaggcgggggaacaucuggcggccugcucggcggguuacucggaaaaguuaccaguguaauuccuggauuaaacaacaucauugacauuaaaguaacugacccucaauuacuggagcugggacuuguucaaucuccugacggacacagacuuuacguuaccaucccccugggaaucaagcuccagguaaacaccccccucgucggcgcaaguuugcuucgccuggccguuaaacuggauaucaccgccgaaauccuugcagugcgugauaagcaagagaggauacacuugguacuuggagauuguacucacucuccuggaucucugcagaucucucuuuuagaugggcuggggccucugccuauccagggauugcuggauucucugacagguauccuaaacaaagugcugccugagcucgugcaaggaaacgucugcccccugguuaaugaagucuugaggggucuggacauaacauuaguacacgauauugucaauaugcucauccauggacuacaguuugucauuaaaguguag

SEQ ID NO: 14110 - RNA, 657 nt, Artificial Sequence
  Description of Artificial Sequence: Synthetic coding sequence
augauguguccucuguggcgucuucucauuuuucucggucuucuggcuuugccccucgccccacauaaacagcccuggcccggguuggcccaggcccaucgcgacaauaagucuacucuagcccgaauaauugcccagggauugauuaaacacaaugccgaaucuagaauacaaaauauucacuuuggagaucggcuuaaugcauccgcccagguggcaccaggccucguggguuggcuaaucaguggacgaaagcaccagcagcagcaagaaagcagauccuucgacaauaauauagugaaaaugugugcccauaugucaauugucguagaguucuggcuggagaaggacgaauucggacgccgcgaccuagugaucggaaaaugugaugcugagcccucaaguguacacguggccauccugacugaggcaaucccaccaaaaaugaaccaguuuuuauauaaccucaaggagaacuuacagaagguuuuaccucacauggucgagagccagguuugcccccuuauaggcgaaauccugggccaguuggacgugaagcugcugaagucccugauagagcaagaagccgcccaugaaccaacacaccaugaaaccucucaacccagugcuugucaagccggcgaaucuccauccuag

SEQ ID NO: 14111 - RNA, 765 nt, Artificial Sequence
  Description of Artificial Sequence: Synthetic coding sequence
augauguguccccuuuggcgacugcucauuuuuuuaggccuucuggcacugccccuugcuccccauaaacaaccuuggccggggcucgcccaagcucauagagauaacaaaucgacccuagcgcgcaucauugcacagggccugaucaagcauaacgcagaaagucgaauucagaauauacacuucggcgacagguuaaacgcaucagcacaaguagcccccggccuggugggcuggcugauaagcggccgaaaacaccagcagcaacaagaguccucuaucaacaucacuaacauccaacuugauuguggcggcauucaaauauccuuccacaaagagugguuuagcgccaauaucaguuuagaauuugaccuugaacuucgaccaagcuuugauaacaauauaguuaaaaugugugcucacaugucaauuguuguggaauucuggcuagagaaagacgaguuugggcgccgagacuuggugauaggcaaaugcgacgcugaacccaguucugugcaugucgcuauccugacagaagcaaucccccccaagaugaaucaguuccuguauaaccugaaggagaaccugcaaaaaguacugccacacauggucgagucacaggugugcccucuuauuggcgagaucuuaggccagcuggacguuaaguuauugaagagccuuaucgagcaggaggccgcucacgaaccuacccaucacgagacuucacagcccagugcgugucaagcaggggagagcccauccuag

SEQ ID NO: 14112 - RNA, 1635 nt, Artificial Sequence
  Description of Artificial Sequence: Synthetic coding sequence
augaaaaucaguaugauuaacuauaagucccuccuggcccuccucuucauucuggcaucauggaucauuuucaccguguuccagaacucaacuaaaguguggucggcucucaaccucagcauuucccuccauuacuggaacaauucaacaaaaucuuuauuccccaaaacaccucugauuucucugaaaccauuaacagagacugaacucagaauaaaggagauuaucgaaaaacuagaccaacagauuccaccucguccauuuacccaugucaacacuacaacaucagcuacccacaguacugcuaccauucugaacccuagagacaccuacugccggggcgaucaacuccauauauugcuagaagugcgggaucaucucgguagaagaaagcaauaugguggcgauuuucuucgcgcucggaugaguucucccgcucuaauggcaggcgccagcggcaaagucacugacuuuaauaaugggacuuauuugguuuccuucacgcuuuucugggaagggcagguuucccugagccuguugcucauacacccauccgaagguguuagcgcgcuuuggagugccagaaaucaaggcuacgacagagugaucuucacuggacaguucgucaacgguacgucucagguccacagcgaaugcgggcuuauacugaauacgaaugcagaacugugucaguacuuggacaaccgggaccaggaagguuucuacugcgugcgaccucaacacaugccaugugcugcccuuacacacauguacagcaaaaauaaaaaaguuucguaccuuaguaagcaggaaaagucauuguucgagcgauccaaugugggcguagaaauuauggaaaaguuuaacacgaucuccgucucuaagugcaauaaggaaacuguggcuaugaaagagaaguguaaauuugggaugacauccacuaucccaucuggacauguguggcgaaacaccuggaaucccgucuccugcucccuggcgaccgucaaaaugaaagaguguuugaggggcaaacugauauaucuuaugggcgauagcacaaucagacaguggauggaauacuucaaagccuccaucaauacauuaaaaucaguggaucugcaugaaucugggaaacuccagcaccagcucgcaguugauuuagaucggaauauuaauauccaauggcaaaaguacuguuacccuuuaaucggaucuaugacuuauucagugaaagaaauggaguaccuuacccgggccauagauagaacaggcggggagaaaaauaccguuaucgugauuucccugggucagcacuuucgccccuuucccaucgacguauuuauaagacgugcccuaaacgugcauaaggccauccagcaccuccuguugagaaguccagauacaauggugaucauuaagacugagaauauccgcgagauguacaacgacgcugaacgcuuuuccgacuuccauggcuacauccaguaccugauuauaaaggacauuuuucaggacuuaucagucaguauuaucgacgccugggauaucaccaucgccuacgguacuaauaacguucaccccccccaacacgucgucggcaaccagaucaacauccugcuaaacuauauuuguuag

SEQ ID NO: 14113 - RNA, 1845 nt, Artificial Sequence
  Description of Artificial Sequence: Synthetic coding sequence
auguggauggcaugguguguugccgcccugucuguuguugcaguaugcgggacuucacaugagaccaauacuguucugagggugaccaaagaugucuuaucaaaugccaucucaggaaugcuucagcaguccgacgcccugcacucagcuuuacgugaaguaccacucgguguaggugacauucccuacaacgacuuccacgugaggggaccaccuccagucuacacuaacgggaaaaaacucgauggcaucuaccaguauggccauaucgaaaccaaugacaauaccgcucaacugggcggaaaguaccgauauggggagauccuggaguccgaagguucuauaagagacuuaagaaacaguggguaucguucagccgagaaugcguauggcggacaccguggccugggaagguauagggcugcaccugugggaagacuccacagaagagagcuucagccuggagagauuccuccuggagucgccacuggcgcgguggggccugggggacuguuggggaccggcggcauguuggccgcagacggaaucuuggccggucaggggggccuauuagggggcgguggucuucugggugaugggggucuucuugggggaggagggguccucggaguccugggcgagggggguauucugucuacuguccaaggcauuaccggccuacguaucguugaauuaacccugccgagagugucaguuaggcuucugccugggguuggcgucuaccugucccuauacacuagagucgccaucaaugggaaaagcuuaaucggauuccuggauauagccguugaggucaacaucacugcuaagguacgccugacaauggauagaaccggcuaccccaggcugguuauagagagaugugauacauugcuaggaggcaucaaagugaaauuacucagaggacugcugcccaaccuggucgacaaucugguuaaucgcguccuggccgauguguuaccugaccugcugugcccgaucgucgacgucgugcuuggccuggugaaugaccagcucgggcuaguugauagcuuaauuccacuuggcauucucggcuccgugcaauauacuuuuaguagucugccucucguaaccggagaauuuuuggaauuggaccucaauacacuggugggagaagccggcgggggacugauugacuacccucucggauggccggcugugagcccaaaacccaugcccgagcugccacccaugggagacaacacuaagucccaauuggcuaugucugcuaauuuucucggcuccgugcucacccuccuucaaaaacaacaugcacuggaccucgauauaacuaauggcauguuugaagaacuuccaccacugaccacugccacccucggugcucuuauacccaaaguuuuucagcaauauccggaaucuugcccacugaucauccguauucagguucucaacccgcccucagugaugcuccagaaagacaaggcccuggucaagguuuuggcuaccgcugaggugauggugucacagccaaaggaccuggagacaacaauuugucugaucgacguggacacagaauuccuagccagcuucucgacagagggugauaaacuuaugauagaugcuaaguuggagaaaaccucauugaaucuaaggaccuccaacguuggaaauuucgauauuggucugauggaaguucucguggaaaaaauuuucgaucucgcguuuaugccugcuaugaaugccguuuuagggucaggcgugccacucccgaaaauccuuaacauugacuucuccaaugcugauauugacguacuggaagaucugcuuguucugagcgcuuag

SEQ ID NO: 14114 - RNA, 1431 nt, Artificial Sequence
  Description of Artificial Sequence: Synthetic coding sequence
augcagccuguuaugcucgccuuguggucuuugcugcugcuuuggggccucgcaacuccuugucaggaacugcuugaaaccguagggacccucgcucgaauagacaaagacgaacuugguaaagcuauacagaacucacucguaggagagcccauccuacagaauguacugggauccgugacugcaguaaaucguggauuacugggauccggcgggcugcucggcggcggggggcuauuaggccacggaggaguguuuggggugguggaggagcuguccggccucaaaaucgaggaauuaacccugccuaaaguccuccucaaauuauugccgggauucgguguccagcucagucugcauacuaaaguuggaaugcauugcagugggccuuugggcggucugcugcagcuggccgccgaagucaacgugacaucaagggucgcauuagccgucaguagccgggguacaccuauccuuauuuugaaaagauguagcacacuuuuaggucauauaagccucuucucaggacuucuccccacuccucuguuugguguuguagagcagauguuguuuaaggugcuuccuggccugcucuguccagucgucgauagcgugcuggggguagugaacgaacuccuuggagcuguguugggacuaguuagucucggugcccugggauccguggaauuuucucuugccaccuuaccccuuauuuccaaccaauauaucgagcuggacauaaauccaauagugaaaucuguggcuggcgacauuauagacuuuccaaaaucaagggcuccugccaaggucccuccaaagaaagaccauacaucccagguaaugguuccacucuaccucuucaauaccaccuucggucuguuacaaacuaauggugcacuggacauggauaucacaccugaacuggucccuucugacguacccuugacuaccaccgaccucgcugcccuauuaccugaagccuugggaaagcugcccuugcaucagcaacuauuauuguuucuucgcgugcgcgaggccccuaccguuaccuuacacaauaaaaaagcccucgugucucugcccgccaacauucauguccuuuucuauguccccaagggcacucccgaguccuuguucgaacugaauucagugaugaccguccgcgcccagcuugcccccuccgccacaaagcuccacaucagcuuaucauuggaaagacugucggugaagguggcaagcuccuucacucaugcuuucgacgggucuagguuagaggaaugguugucccauguugucggcgcaguauacgcuccgaaacuaaauguagcucuggacgucggcauuccccucccaaaagugcuuaauauuaacuuuucuaauucggugcucgagaucguggagaacgccgugguacucacaguugccucauag

SEQ ID NO: 14115 - RNA, 585 nt, Artificial Sequence
  Description of Artificial Sequence: Synthetic coding sequence
augcaagacgcacccuugucauguuugaguccaacuaaauggucaucugucagcuccgcggacucuacugaaaaguccgcaaguggcgcuggaacucggaaccugcccuuccaguuuugccuccgucaagcguuacgaaugaaagccgcagguauccucacucuuauugguugucuugugaccggagccgagucaaaaaucuauacaagauguaagcuagcaaaaaucuucucucgagccggucuggacaauuacuggggcuuuucccugggaaauuggauuuguauggcguacuacgaaagugguuacaacacaacagcucaaacuguacucgacgacggcagcauagacuacggcaucuuucagauuaauagcuuugccuggugccgacgcgggaaacugaaagaaaauaaucacugucauguggcuuguucggcgcugauuacagaugaccugacagacgcuauaaucugcgcaagaaaaauugugaaggaaacacaagguaugaacuauuggcagggauggaaaaagcauugcgaaggaagagacuuguccgaauggaaaaaaggaugcgaggugagcuag

SEQ ID NO: 14116 - RNA, 1266 nt, Artificial Sequence
  Description of Artificial Sequence: Synthetic coding sequence
augggauucuugucacccauuuaugucaucuucuuuuucuucggagucaaaguacacugucaguacgaaacuuaccaaugggacgaggacuacgaucaagagccggacgacgauuaccaaacaggauuucccuucagacagaacguugacuauggagugccauuucaucaguacacccucggcugcguaagcgaaugcuuuugcccuacuaacuucccgucuuccauguacugcgacaacagaaagcugaagacaauuccaaauauuccuaugcacauccagcagcuguaccuccaguuuaaugaaauugaggccgugacggcgaauuccuucaucaaugcuacucaccugaaggagaucaaccuuucgcauaacaagauuaaaucccaaaaaauugacuauggcguguuugccaaauuacccaaucuguuacaacugcaccuugaacauaacaaccuggaggaauuuccauucccccuacccaaaagcuuagagcgacuucuacuaggguauaaugaaaucucaaagcuucagacuaacgcaauggauggacucguuaaucucacaaugcucgaccuaugcuauaauuaccuccacgacucccuccuaaaggacaaaaucuucgccaagauggaaaaacugaugcaacuaaauuuaugcagcaauaggcuggaaucgaugccacccggacugccuuccucccucauguaucucucacuugaaaacaacucuaucucaucuauaccagaaaaauauuucgauaagcugccaaaacugcacacauugagaaugagccacaauaagcugcaagauaucccguauaacauauuuaaccucccaaacaucgucgaguugaguguuggccauaauaagcugaagcaagccuucuauauuccuagaaaucuggaacaucuuuaccuucagaacaacgagaucgaaaagaugaaucuuacuguuaugugcccgucaaucgaucccuugcacuaccaucaccuaacauacauucggguugaucagaacaaacuuaaggaaccuauuucuucauacaucuuuuucugcuuuccucacauccauacgaucuacuacggggaacagcgcucgacaaacggccaaacuauucaacucaagacacagguauuuaggcguuuuccagacgaugacgaugagucugaagaccaugacgacccugacaaugcucacgaaucacccgaacaggagggagccgagggccauuuugaucugcacuauuaugaaaaccaggaguag

SEQ ID NO: 14117 - RNA, 252 nt, Artificial Sequence; identical to SEQ ID NO: 12478
  Description of Artificial Sequence: Synthetic coding sequence

SEQ ID NO: 14118 - RNA, 2559 nt, Artificial Sequence
  Description of Artificial Sequence: Synthetic coding sequence
augcucccuacggaaguuccccagucccaucccgggccaagcgcacuguuauuauuacagcuucuucucccuccuacuagcgccuuuuucccgaacauuuggucucuccuggcagccccagggucaauuacacaucaggaccucacugaggaagccgcacugaaugugacgcuacaacuguuccuggagcagccuccaccaggccgccccccacucagacucgaagauuuucuuggacggacucuacuggccgacgaccuguuugcugcauacuuuggucccggaucaucucgucgcuuccgggccgcccucggggaaguuucccgcgccaaugcugcacaggacuuucugccaaccagucguaacgaccccgaucugcauuuugacgccgaaagacugggucaaggccgagcccgucuggucggagcucuccgcgagacuguugucgccgcgcgugcacuggaucauacacuagcucgccagcgccugggcgccgcccuacaugcccugcaagacuuuuauucccacucuaauuggguugaguugggugaacagcagccacacccucaccuuuuguggccucgccaagaacuucagaauuuagcccagguggcugacccuacuugcucagauugcgaagaacuuaguugcccacgaaauugguuaggcuucacuuuguuaacaucuggguacuuuggaacacaucccccaaaacccccuggaaagugcagccauggcggccauuuugacaggaguucgucucagcccccuagggguggcauuaauaaagauucuacaucacccggcuucuccccccaucacaugcugcaccuucaagcugcuaaauuggcuuuauuggcauccauccaggcuuucagcuugcuacgaucucgucucggggaccgagacuucucacgguuacuagacauuacucccgcuucgaguuuaagcuucgugcuggauacaaccggaucuaugggagaagaaaucaacgccgccaaaauccaggcuaggcaccucgucgagcagcgccggggcucgccaauggaaccuguccauuauguucucgucccauuucacgauccugguuucggacccguguuuacgacuucugacccugacucauucuggcagcagcugaacgagauccaugccuuagguggaggagaugagccagaaaugugccugucugcgcugcaauuagccuugcuucauacaccaccccuguccgauauuuuugucuucacugacgcuagcccaaaagaugccuucuuaaccaaccaaguggaaucuuugacacaggaacggcgaugucgggugacauuucugguuacugaggauacgucaagaguucaaggacgcgcaaggagggaaaucuuauccccauuaagguucgaaccuuacaaagcagucgcacuggcgagcggaggcgaggugauauuuacgaaggaccagcacauuagagacgucgcugcuaucgucggugagucaauggccgcucucguaacacuaccacucgauccuccgguggucguucccgggcagccccuaguguuuucaguagacggucuucuucaaaagaucacuguacgcauucauggggauauaaguucguucuggauaaaaaacccggcuggagugagucaaggacaggaggaaggaggcgggccacuggggcacacacgacgcuucggacaguuuuggauggugaccauggaugaccccccucaaacagguacaugggagauucagguaacggccgaagauacacccggcguuagagugcaagcccagacaagcuuagacuucuuauuccacuucggcauacccauggaggacgggccucaccccggcuuguauccacucacccagccaguugccggucuacaaacccaacuccuggucgaggucaccgggcuuggaucgcgcgcgaauccuggggacccccagccucacuucagccacguaauacuuaggggcgucccugaaggagcugaacuaggccaggucccgcucgagccaguuggacccccugaaagaggccuccuagccgcuuccuugucuccaacucuccuuaguacuccuaggccauucucucuugagcugaucggucaagaugccgccgggagaagacugcaucgcgccgcaccucagcccaguaccguugugccugugcugcuugagcucuccgguccuaguggcuuuuuagcuccuggaaguaaagucccucucucccuuagaauugccaguuuuuccgggccccaggauuuggacuugcgaacguuugucaacccuuccuucuccuugaccucuaauuugaguagggcccauuuagagcuaaaugagagcgccuggggacgccuuuggcucgaagugcccgauucugccgcgcccgacuccguggucauggugaccgucacugcagguggccgcgaagccaauccaguuccaccuacccaugcuuuccuuagacugcucgucagugcuccagcuccacaaguacguaaucauuauuucccuucccagggcccugcucaccaucccuacagguugauauag

SEQ ID NO: 14119 - RNA, 2676 nt, Artificial Sequence
  Description of Artificial Sequence: Synthetic coding sequence
auguugccaaccgagguuccccaaagucauccaggaccuucugccuugcugcuucuccagcugcuguugcccccaaccuccgcguucuuuccaaacauuuggucgcuccuugcugcacccggaaguaucacgcaccaagaccuuacggaagaagcugcccugaacguuacacuucaacucuuucuagagcagccuccuccuggacguccuccgcucagacucgaggauuuucucggcaggacacuucucgccgacgauuuauuugcagccuacuucggccccggaucaagccgccgguucagagcugccuugggugaagucuccagggcuaacgccgcccaggauuuccuaccuaccucaagaaaugaccccgaucuccacuuugacgccgagaggcucggccaaggucgugcaagacucguuggggccuugagggagacggucguagcagcgcgggcauuagaucauacacucgcacgucaaagacugggcgcagcauuacacgcucugcaggauuucuacucucauucaaauuggguugaacuuggagagcagcagccacacccacaccugcuuuggccaagacaggaguuacagaacuuagcacaaguggcugauccuacuugcagugauugcgaggaauuguccugcccacgaaacuggcucggcuuuacucuccuaacauccggauauuuuggaacucaccccccaaaaccaccuggcaaauguagccauggcggacauuuugauagaaguucaucccagccuccaaggggagggaucaauaaagacuccaccucccccggcuuuagcccacaccacaugcuucaccuccaggccgcuaagcucgcucuguuagccuccauucaggccuucucccugcuccgcagcagacucggagaccgggauuucucuaggcuucuugauauaaccccagcauccuccuuaagcuucguccuggacacaaccgguaguaugggagaagaaauuaaugccgcaaaaauccaggcgagacaucugguugaacagagacgcgguagucccauggaaccaguccauuacgugcuagugccuuuucaugacccuggcuucgggccuguguucacuaccuccgaucccgacagcuucuggcagcaacucaaugaaauacaugcacugggagggggcgacgagcccgaaaugugucugucugcucugcagcuggcucugcuucauacuccaccucuuuccgauauuuucguuuucacugacgcuagccccaaagaugcuuuucucacaaaucaagucgagagccugacccaggaacgccgcugcagagugaccuuccuugucaccgaagauacuucaagaguucagggacgcgcgaggcgcgaaauucugucuccccuaagauuugagccuuacaaagccgucgcccuggccucaggcggagagguaauauucaccaaagaucaacauauacgggacguggcagccaucguuggcgaaucuauggccgcccucgucacucuuccguuagauccuccaguugucgugcccggacagccucugguguucuccguggauggacuccuucaaaaaauaacagugagaauacauggggauauuucgagcuuuuggauuaagaaucccgccggcguuucucaaggccaagaagaaggugggggaccacucggccacacucguagauuuggccaguucuggaugguaacaauggacgauccuccccaaacugggaccugggaaauccagguaaccgcagaggacacaccaggaguucgcgugcaggcucagacuagccuagauuucuuauuccauuuuggcaucccgauggaggaugggccucauccuggacuuuacccucucacucagcccgucgcuggacugcagacucaacuccugguggaggucaccggucuggggucgcgggcuaacccaggcgauccucagccccauuuuucccacguuauacuccgcggaguacccgaaggagccgaacugggccagguaccucucgaaccagucgguccccccgagagaggauugcuagcagcuagccuaagucccacccuacucucuaccccacgaccguucucucuggaguugaucggucaggaugcggcaggcagaagguuacaucgggcagcaccgcaaccuucaaccgucgucccuguguuguuagaguuauccggccccuccgguuuccuggccccgggcagcaaaguucccuuaucccuaagaauagcuaguuucuccgggccccaagacuuagaccucagaacuuucgugaaccccucauuuagucugacauccaaucucucucgcgcccauuuggaauugaaugaaucagcauggggucggcugugguuagaaguucccgauagcgcggccccggacucaguugugauggucacggucaccgcaggugggcgagaagcuaaucccguaccacccacucacgcauuucugcgguuacugguuucagcucccgcuccccaagaccgacauacgacccccacuggcucaucugauccaauacugaccacugcuacaccugccuuuucuccuuuuacccuggucacacaggguagagccggagccggauuagccgccggaucacccugguggggaacaguaggagguguucuacucuugcuugggcuggccucuugguag

SEQ ID NO: 14120 - RNA, 552 nt, Artificial Sequence
  Description of Artificial Sequence: Synthetic coding sequence
augguccgaaucuggacuacaauaaugauuguuuuaauucuccuacugcgaauuggaccaaacaagcccagucugucaggucgccaggcuccagcucaggcucaaacaucagaucucgugccuucccuguuuccuuuagggcugugggcccccggguuuugcaccuggagcucaccugaugaagacaaacguccacgaaaaccuguuccuggcacaggcaaucgggacuccgggacacguagaagacuucaggaugcuaccgaacaagacccucgaccugggaaugacguugccucagcugaaacagcaggccccccuucgcccucuggaauuagagcgcaagacagagcaccccgccaucgaagagccccaccugccaggaugccaguugccccagcacccagcgccgauggggagccgcuacaagaacagggaggcggacuguuucaucgaacuagaucuguguacaauggcuuggaguugaauacuuggaugaaaguggagagacuguucgucgaaaaguuucaucagaguuuuucacuggacaacuag

SEQ ID NO: 14121 - RNA, 444 nt, Artificial Sequence
  Description of Artificial Sequence: Synthetic coding sequence
auggcaggccccgccggcagccaaucucugggcccauuaugcuuucacagcuccccgcaagcccuauacacaguucuccugauugugcuggugaugaugagcuugguguuuggaaaauucgucccugugaacugggaacccccccagccccugcccuuuccuaaauacuugagaugcuacagaugccuacucgaaacaaaagagcucggcuguuuacuaggcucugacauaugucugacacccgccgguuccucuugcaucacacuacacaagaagaauucauccgggucugaugugauggugucagacugccgaagcaaagagcaaauguccgacuguaguaacacucguaccuccccaguguccggauuuuggauuuuuagucaguauuguuucuuagacuuuugcaaugacccccaaaaccgcggccuguauacaccuuag

SEQ ID NO: 14122 - RNA, 447 nt, Artificial Sequence
  Description of Artificial Sequence: Synthetic coding sequence
augcaaaccuucccuguggcuggagcacuugaccccgcuauccuggacacaaguaguccccaagcacuguacacuguccuccugauugugcuagugaugaugucccuaguuuucggaaaguucgugcccgucaauugggagcccccucagccccugccauuuccuaaguaucuucgauguuaucgcugccuucuagagaccaaagagcugggcugucugcuggguuccgacaucugucugacaccugccgggucaucguguauuacucuccacaaaaagaacucgagcgggucugacgucauggucagcgacugucgcucgaaggaacagaugagcgacuguucaaacacaaggacuucuccuguaagcggauuuuggauauuuagccaauauugcuuuuuagacuuuuguaaugauccccaaaaccgaggacuguauacccccuag

SEQ ID NO: 14123 - RNA, 606 nt, Artificial Sequence
  Description of Artificial Sequence: Synthetic coding sequence
augaaggugcacaugcuuguugggguuuugguuauggugggcuucacaguugguaaggugccagugccagauauuaggacaugucacuucugcuuaguugaggaccccucugugggaugcaucuccggaagcgaaaagugcacgauuuccucauccagucuguguauggugaucacaauuuauuaugacgucaaaguccgcuucaucgugaggggaugcggccaguacaucucuuaccgaugucaggaaaaaagaaauacuuacuucgccgaauacugguaucaggcucaauguugucaguaugacuacugcaauucuuggaguucuccacaguugcaaagcucccucccugagccccaugaccgcccacuggcccuaccucuauccgacucccagauccaaugguucuaucaagcgcugaaccuguccuuaccucuacccaacuuccacgccggcacagagccugacggucucgaccccauggucacacucucacuuaaccuggggcuguccuucgccgaacucagacgcauguaucucuuucugaauuccucuggucuccucgugcuuccacaggcaggccuguuaacuccacaccccagcuag

SEQ ID NO: 14124 - RNA, 345 nt, Artificial Sequence
  Description of Artificial Sequence: Synthetic coding sequence
augcuugggggugaagaggcccggcccaauucauggccguggcaggugucguuacaauauagcuccaauggacagugguaccacacuuguggaggaaguuuaauugcuaauagcugggucuugacagcugcgcauugcauacggcaaauaaucaaagcacauaaaguccuccagcgcugcucucuuauccuguucuuuguccgcgaucuuugcucaagucaauuagaauuaaccggugugucugcaggcucaucagggaucuauagagugaugcuuggucagcauaaucuguauguugccgaauccgggucguuggccgugucugugucuaaaaucgucguuuag

SEQ ID NO: 14125 - RNA, 810 nt, Artificial Sequence
  Description of Artificial Sequence: Synthetic coding sequence
augauaagaacacuguuauugaguacccuaguagcgggugcuuuguccugcgggguuaguacguaugcaccugauaugucccggaugcucggaggcgaagaagcgagaccuaacucuuggccauggcaggucucucuucaguauaguuccaaugggcagugguaccacacaugugguggaucucuuauagcaaauucgugggugcuuacugcagcucauugcaucucaucaucgggcauauaucgcgugaugcuuggacagcacaaccucuauguggcggaaagcggaucucucgcugugucagugagcaaaauaguaguccauaaggacuggaauagcgaccaggugucaaaaggcaaugauaucgcucuguugaaacuugcuaaucccgugagccuaaccgauaaaauccaacucgcuugucucccuccggccggaaccauccuuccuaacaauuaccccugcuauguuaccggaugggguagguuacaaacaaauggggcccugcccgacgaccugaaacagggucagcuccuugugguggauuaugcaacuuguuccaguucaggaugguggggguccacugugaagacaaacaugaucugugccggcggugacgggguaauuuguacauguaacggggauucaggagggcccuuaaacugucaggccucagacggccggugggaaguucacggcauugggucguuaacaucaguccugggguguaacuauuacuacaagcccucuauuuuuacacgcgucucaaacuauaaugauuggauuaauagcgucauugcuaauaacuag

SEQ ID NO: 14126 - RNA, 567 nt, Artificial Sequence
  Description of Artificial Sequence: Synthetic coding sequence
auguuucaccagauuugggcagcccuacuguacuuuuacggaauuauccugaacuccauuuaucagugucccgaacauucccaacuaacaacgcugggcguggacggcaaagaguuucccgagguucacuuaggccaaugguacuucauugccggagcugccccaaccaaagaggaguuagcgacauucgauccgguggacaacauuguguucaauauggcugcaggcuccgcaccuaugcaguugcaucuaagggcaaccaucagaaugaaagauggacuuugcguaccucguaaguggauauaucaccugaccgaaggaucaacagacuugcgaaccgagggccgcccagacaugaaaaccgaacuguucuccuccuccugucccggaggcauaaugcucaaugagacuggccaagguuaucagcgcuuccucuuguauaacaggucaccccacccccccgaaaagugcguggaggaauuuaaaucucugaccagcugccuggacuccaaggccuuccuguuaacccccagaaaccaggaagcaugugagcucagcaauaacuag

SEQ ID NO: 14127 - RNA, 390 nt, Artificial Sequence
  Description of Artificial Sequence: Synthetic coding sequence
auggcugccggauccgcacccaugcaguugcacuuacgggcuacuauuagaaugaaagacggccuuugugucccgagaaaguggaucuaucauuugacugaggggucuacagaucucagaacagaagggagaccagauaugaagacggaacuauucuccaguucuuguccaggcggaauuaugcugaaugagaccggacaaggguaccaacgauucuuacuguacaacaggucaccgcaccccccggaaaaaugcguagaagaguucaagucauugacuucgugccuggauuccaaagcuuucuuacugacaccaagaaaccagggcaaggggcuuaagucacacaagaccggacucggguuaacaaagagcucaggcgugaccggauag

SEQ ID NO: 14128 - RNA, 351 nt, Artificial Sequence
  Description of Artificial Sequence: Synthetic coding sequence
auggcugccggauccgcaccaaugcaacuacacuugcgcgcuacaauucggaugaaagacggucuuugcgugccuagaaaauggaucuaccaucucacagagggaaguaccgauuuacgaacagaaggccgaccugacaugaagaccgaacuauuuuccucaucaugccccggagggauuaugcuaaaugagaccggucagggcuaccagcgcuuccuccuguauaaccgcucuccucacccuccugaaaagugcguagaggaauuuaagucccucacaucuugccucgauagcaaggcuuuucuucuaacaccccggaaucaggaagccugcgaacucucaaauaauuag

SEQ ID NO: 14129 - RNA, 435 nt, Artificial Sequence
  Description of Artificial Sequence: Synthetic coding sequence
augauuagaacgcuucugcucaguacucucguggcuggcgcuuugagcugcggcgacccaacauacccuccauaugugacccgggugguaggcggugaggaagcuagacccaauucuuggccauggcaagugucccuccaguacucuucuaacggcaaaugguaucauaccugcggaggcagcuuaaucgcaaacucgugggucuugaccgcggcacacugcauaucacagagcaugguccagugugcucacaaggugcuucaaagauguagccuaauccuguuuuuuguaagggaccuguguucaucucaacuggaacuuacaggggugucagcuggcucaucacguaccuacagaguaggccuggguaggcacaaccuuuauguggcagaaucgggcuccuuggccgugagcguuucuaaaaucguuguuuag

SEQ ID NO: 14130 - RNA, 204 nt, Artificial Sequence; identical to SEQ ID NO: 12491
  Description of Artificial Sequence: Synthetic coding sequence

SEQ ID NO: 14131 - RNA, 231 nt, Artificial Sequence; identical to SEQ ID NO: 12492
  Description of Artificial Sequence: Synthetic coding sequence

SEQ ID NO: 14132 - RNA, 267 nt, Artificial Sequence; identical to SEQ ID NO: 12493
  Description of Artificial Sequence: Synthetic coding sequence

SEQ ID NO: 14133 - RNA, 255 nt, Artificial Sequence; identical to SEQ ID NO: 12494
  Description of Artificial Sequence: Synthetic coding sequence

SEQ ID NO: 14134 - RNA, 2631 nt, Artificial Sequence
  Description of Artificial Sequence: Synthetic coding sequence
augggacccgaagcacugucuucccuccuacugcuuuuguuaguagcuuccggcgacgcagacaugaagggucauuucgacccagccaaaugcagguacgccuugggcaugcaggaucgcacgaucccagauagcgacauuucagcaaguagcagcuggucugauuccacagccgcccgacacucgagacuggagucgucagacggcgauggagcuuggugcccagcuggauccguguuuccaaaagaggaagaguaccuucaagucgaccugcaacgauugcaccugguggcucucguugggacccaaggcagacaugcuggcggacuagguaaggaauuuucacgaaguuauagacugagguauagucgggauggcagacgguggaugggauggaaagaucgguggggccaggaagugaucuccgguaacgaagacccugaaggaguggucuugaaggaccugggcccaccuaugguggcccggcuugucagauucuauccaagagcggacagggugaugagcgugugccuacgagucgagcucuauggcugucuuuggcgagacggacuucuaagcuauacugcgccugucggacagaccauguaucuaucggaggcaguuuaucucaacgauaguacauaugauggucauaccguggguggauugcaauacggcgguuugggacaguuggccgacggcgugguaggucuagaugacuucagaaaaagccaagaguuacgcguuuggcccggcuaugauuauguugguuggucaaaucacagcuucucaucaggguacguggagauggaguucgaguuugauaggcuccgcgcuuuccaggccaugcaggugcacugcaauaacaugcauacucuuggggcccgacugccagggggcguggaaugcagguuuagacgcggucccgccauggccugggagggcgaaccuaugcggcauaaccugggcggcaauuugggcgauccucgggcccgggcuguaagugugccccuaggaggacguguggcucgguuucugcagugccgguuucuuuuugcuggcccuuggcuccucuucuccgaaaucucuuucaucuccgaugucgucaauaacuccuccccagcccucggagguacguuuccacccgcaccuugguggccccccggcccaccccccacaaacuucaguaguuuggaacucgaaccgagaggccaacagccuguagcaaaggccgagggcaguccuacagcuauucugaucgggugucuuguugccaucaucuugcucuugcugcugauuauugcuuugaugcucuggcgccugcacuggaggagacuucugagcaaagcagaaaggagagugcucgaggaggaauugaccgugcaccucagugugccaggugacacuauccugauaaacaaccguccuggccccagagagcccccgcccuaccaggaaccacgaccuagaggcaacccaccccacuccgcaccauguguccccaauggcucugcguacucuggcgacuauauggaaccugagaagcccggcgccccuuuguuaccccccccaccacagaauucugucccgcauuacgcagaggccgacauugugacccuucagggaguuaccggugggaacaccuaugccguaccagccuuaccaccaggagccguuggggacgggccgccucguguggacuuccccagaagccgacugcguuucaaagaaaaacuuggcgaaggacaguuuggcgaagugcaucuuugugaaguugauagcccgcaagaccuggugagccuugacuucccccuuaacguucggaaaggucacccucuccuggucgccgugaaaauuuuacgccccgaugccacaaaaaacgccagaaacgauuuccuaaaagaagugaaaauaauguccagacugaaagaccccaauaucauccgauuguugggugugugugugcaggaugacccuuuguguaugauuaccgauuauauggagaauggcgaucugaaucaguuucuuuccgcccaucagcuggaggacaaagcggccgaaggagccccgggagaugggcaagcugcucagggcccaacaauuucauauccgaugcuacugcauguagcggcccaaauugccucuggcaugagguaucuagcaacacugaacuucguucaucgggaucuggccaccagaaauugucucgugggugagaacuucacuaucaaaaucgcagacuucggaauguccagaaacuuauaugcaggagauuacuacagagugcaaggaagagcgguucugccgauaagauggauggcaugggaguguauacucaugggaaaauuuacuacugcuagcgacgugugggcuuuuggaguuacccugugggagguauuaaugcucugucgcgcucagccuuuugggcagcucaccgacgagcaaguuaucgagaacgcuggagaauuuuuuagagaccagggcagacaggucuauuuaucacguccacccgccuguccucagggccuguacgagcucaugcuccgcuguuggucgagggaaagcgaacagaggccaccauuuucccaacugcacagauuccucgccgaggacgcgcugaacacuguuuag

SEQ ID NO: 14135 - RNA, 2742 nt, Artificial Sequence
  Description of Artificial Sequence: Synthetic coding sequence
augggacccgaagccuuaagcucccuucucuugcuccuguuagucgcuuccggcgaugcggacaugaagggacacuucgaccccgcuaaauguagauacgcauuggguaugcaggaucguacuauuccagauuccgacaucuccgccaguaguaguuggucagauucaaccgcagcucgacauucccgacucgaaaguagcgacggugauggagccuggugucccgcaggaaguguuuucccuaaggaagaagaguaccugcagguggaccugcagagacuccaccugguggcauuagugggaacacaggggagacaugcgggaggcuuggguaaagaguuuucucgcaguuaucggcugagauauuccagggacggccggagguggaugggauggaaggauagguggggucaggaaguuauuucugggaaugaagacccugaggguguggugcucaaggaucuggggcccccaauggucgcgagacuuguaagguuuuaucccagagccgaucguguaaugucagucugccuccgcguugagcuauaugguugccuuuggcgagacggacugcuaucuuacacugcaccaguuggccagacgauguacuugagugaggccgucuauuuaaacgauagcacuuaugacggacacacagugggaggucuacaguaugguggucuggggcaguuggcagacggcguggugggacuggaugauuuucgaaaaagucaggaauugcggguguggccuggguacgauuacguagguuggucuaaccacuccuucagcagcgguuacguggaaauggaauuugaguucgaucgacuuagagccuuucaggcgaugcagguccauuguaacaauaugcauacgcugggagcucgccugccuggaggcguggaguguagauucagaagaggcccugcuauggcgugggaaggcgaacccaugaggcauaaucugggcgguaaucucggagacccccgggcuagggcggugagcgugccccuuggaggucguguagcucgauuccugcaaugucgguuccuuuucgccggaccauggcuuuuguucagcgaaaucucguuuaucagcgacguagucaauaauuccagcccggcacucggcggcacauuccccccugcucccugguggcccccggggccaccaccgacaaacuuuuccagccucgagcuagagccucgcggacaacagcccguggccaaagcugaggguucaccaacagcuauccugauuggcugucuaguggccauaauucugcugcuccuauuaauaauagcccugaugcuguggagacuucacuggcgcaggcugcugucuaaagccgaacgaaggguguuggaagaggagcuaacugugcaccucagcguucccggagauacuauacuuauuaauaaucgccccggcccucgcgagccaccaccauaccaagagccccgaccaagaggaaaccccccucauucugcuccaugcgugccaaauggauccgcacucuuauugucuaauccugcuuaccgccugcuucuggccacuuacgcucgaccaccacggggacccggaccaccaacuccagcuugggcaaagccaaccaacacacaggcauauuccggagauuauauggaaccggaaaagcccggcgcaccuuugcuuccaccuccaccucagaacucugucccacauuacgccgaagccgauaucgugacucugcagggagugacgggaggcaauaccuaugccgugccugccuugccacccggcgcagucggagaugggccgccccguguggacuuucccagaagucgauugcgauuuaaagagaagcuuggagagggccaauuuggagagguacaucugugugaaguggauucaccccaggaccuuguaagccuggauuucccucugaauguccguaaggggcauccguugcugguggccguaaagauucuuagaccggaugcaacaaagaacgcccguaaugauuuccuaaaagaaguuaagauuaugucaagauuaaaagauccaaauaucauucggcugcugggcguguguguccaggaugauccacugugcaugauuaccgauuacauggaaaacggcgaucuaaaucaauuucugucugcucaucagcuggaagacaaagccgccgagggggcuccuggggauggccaggccgcacaggguccuaccaucucuuauccaaugcuccugcaugucgcugcacaaauugccuccggaaugcgguaucucgcuacccuuaacuucguccaucgggaccuggcgacucguaauugucuuguaggggagaauuucacgaucaaaaucgccgacuucggaaugucccgaaaucuguaugccggcgacuacuauagaguucaagguagagcaguucugccuauccgcuggauggcgugggaauguauacucaugggaaaauucacuacggccagugaugucugggccuuuggagugacccugugggaagugcugauguuaugcagggcucaaccuuuuggacagcugaccgacgagcaagugaucgagaaugccggagaauuuuuucgagaccagggacggcagguguaccucucaagacccccugcguguccucagggccuguacgagcugaugcugagguguuggucccgugaaucagagcagagaccccccuuuucacaacuucaucgauuucuagccgaggaugccuuaaacaccguguag

SEQ ID NO: 14136 - RNA, 2631 nt, Artificial Sequence
  Description of Artificial Sequence: Synthetic coding sequence
augggaccugaggcccucaguucucuccugcugcuucugcugguugccucaggugacgccgauaugaaaggccauuuugaucccgccaaauguagguacgcauuggggaugcaagaccgaacaaucccugauucugauauuucugccaguagcucuuggagugacagcacugcugcccgccacagucggcuggagucuucagauggugacggcgccuggugccccgcagguagcguguuuccaaaggaagaggaauaccugcaaguugaucugcagaggcuacaucuuguugcacucguggggacccagggacgucacgcaggcggacuaggaaaggaguuuucucgcagcuauaggcugcgguauaguagggacggcagacgauggaugggcuggaaagauaggugggggcaggaagugauuucggggaacgaggauccugaaggcguggugcuaaaagaucugggaccuccuaugguggcuagacugguucgguucuauccaagagccgaccgggugaugucagugugucuucgcguagagcuguauggaugucuguggagagauggguuacucucauauacagcuccugucggucagacgauguaucucucagaggcuguguacuugaacgacucaaccuacgacggccacaccguuggaggcuuacaauauggcggucugggacagcuggccgacggcguggucggacuugaugacuuuaggaagagccaggagcugcguguuuggcccggauacgauuacguaggauggagcaaccauucauucagcaguggcuauguugagauggaauuugaguucgaucgucuuagagcauuucaagcgaugcagguccacuguaauaacaugcauacccuuggcgcgcgcuuaccaggagggguugaaugucgauuuagacgcgguccugcaauggccugggaaggugagccaaugcggcauaauuugggggguaacuugggcgacccucgggcucgcgcaguaagcguuccgcuggguggcaggguagcccgguucuugcagugcagguuccuguuugcuggucccuggcuccuauucagugaaaucucuuucaucucagauguggucaauaacucuagccccgcucuugguggcacauuuccuccagcuccaugguggcccccgggcccccccccuacuaacuucucauccuuagagcucgaaccucgcgggcagcagccaguggcaaaggccgaaggcagccccacagcgauucuaaucggaugucuggucgcaaucauccuccugcuucuccuuaucauugcccucauguuauggagacuccacuggcgaaggcuacuguccaaggcagagcgaagaguccuugaagaagaacuaacaguacaccugagcgugcccggugauacuauacucauaaacaaccgcccuggcccccgggaaccccccccuuaccaagaaccgcgcccucggggaaauccuccacacagcgcuccgugcgugccuaacggcucugcuuauucaggcgacuacauggaacccgaaaagccaggcgccccccuccuacccccaccaccgcaaaacucugucccccacuacgccgaggccgacauugugacguuacagggugugaccggaggcaauaccuaugccguuccagccuugccaccaggggccgugggagacgggccacccaggguggacuuuccucgcucuagacugcgcuuuaaggagaagcugggagaaggucaauucggagaaguccaccucugcgaaguggacagcccucaggaucuggucagucuggauuuuccccucaacgugagaaagggccacccacugcuggucgcuguaaaaauacugcgcccugaugcuacaaaaaacgcccggaacgacuuccugaaagaaguaaagaucaugucccgccugaaagacccaaauaucauccgacucuuaggcguguguguccaggacgacccuuuaugcaugaucacagauuauauggaaaacggcgacuugaaccaguuuuuguccgcacaucaguuagaagauaaggcugcugaaggcgcccccggcgauggacaggcugcacaagggccuacuauaucguauccuauguuacuacacguggccgcucagaucgccuccggaaugcgguaucuggcuaccuugaauuuuguucaucgggaccuggcaacucggaacugccuuguuggagaaaauuuuacuauaaaaauugcugacuucgggaugucacggaaccucuacgcuggagauuacuauagaguucagggccgcgcaguccugcccauucgcuggauggcuugggagugcauucugaugggaaaguuuacaacagcgucagacguuugggccuuuggcgugacacucugggagguguuaaugcuguguagagcccagccuuuuggccagcugacggaugagcaagucaucgaaaaugcuggagaauuuuuccgagaucaaggacgccagguauaucuaucaaggccgccagccuguccacagggacuguaugagcuuaugcuccgguguugguccagagagucugagcaacguccuccuuuuucccagcuacaccgcuuucucgccgaagacgcccuaaauaccguauag

SEQ ID NO: 14137 - RNA, 2631 nt, Artificial Sequence
  Description of Artificial Sequence: Synthetic coding sequence
auggggccggaagcuuuguccucucuacugcucuuacuacucguggcgucuggugaugccgacaugaagggacauuuugacccugcaaaauguagauaugcccugggaaugcaggaccgaacgauuccagacucugauaucucagcguccagcucuuggucugauuccacugccgcgcgacauagucgcuuggaaagcucagacggggacggcgcauggugccccgccggaucagucuuuccaaaggaggaagaguaucugcagguagaccuucaacgccuucauuuaguggccuuaguggggacucaaggaaggcacgcaggaggucuaggcaaggaauuuaguagaucauacagguugagguacucccgggauggucgacgauggauggguuggaaagaucgauggggccaggaagugauuuccggcaacgaggaucccgaagguguggugcugaaagauuugggacccccuauggucgcccgcuuagugagguucuacccacgagccgaucgggugaugucugucugcuugcgcguggaguuguauggauguuuauggcgggauggucuccuuucuuacacggcccccgugggacagacuauguacuugagcgaggcaguauaccugaacgauaguacauacgacggccauacaguaggcggacugcaauaugggggcuugggccaacuggcggauggcguagucggacuggacgacuuuagaaaaucccaggaacuccggguuuggccgggauacgauuacgugggauggagcaaucauuccuucaguucugguuacguugaaauggaauucgaguucgacagacucagagccuuccaagcgaugcaggugcacugcaauaacaugcacacacuuggggcaagacuaccaggcggcguggaauguagauuccgaagagguccggcaauggccugggaaggggaacccaugagacacaaucucggaggaaaucuuggggauccuagagcgcgggcugugagcgucccucugggcggccgcguggcacgcuuucugcagugucgguuuuuguucgcuggucccuggcuccuguuuagugaaauuucuuuuauaagugauguggugaacaauagcagcccugcucuuggcggcacauuuccuccugcacccugguggcccccagguccccccccuaccaacuuuucuagucuugagcuagagccgagaggucagcagccaguggcaaaggcagaaggaagccccacagccaucuuaaucgggugccucgucgccauuauuuuguugcuucuccugauuauugccuugaugcucuggcgccuacacuggaggaggcuucuguccaaagcugagcgacgcgugcuagaggaagaacucacagugcaucuuagcgugcccggcgacacaauccugaucaauaaucguccaggcccacgcgaaccaccgccguaccaggaaccccguccucgagggaacccaccucauagcgcuccaugcgugcccaauggcagugcuuacucaggggauuauauggagcccgaaaagccaggggccccccugcuuccgcccccgccucaaaacucagucccccauuaugcagaggccgauaucgugacauuacagggcgucaccggugggaauacguaugcggugcccgcguuaccuccgggggcagugggcgauggaccgccaagaguggacuuuccuaggucaagguugcgauucaaagagaagcucggagaaggucaauucggcgaagugcaccugugugaaguagauuccccccaggauuuggugagucucgauuucccacugaacgucaggaaggggcacccauuacugguugcugugaagauacugagaccugacgccacuaagaaugcucgcaaugacuuuuugaaagagguaaaaaucaugucuaggcuaaaagaccccaacaucauccgacuccucgguguguguguacaagaugauccccucugcaugauuaccgacuauauggaaaacggcgaccucaaccaauuucugagugcucaccagcuggaggauaaggcugcugagggggcaccaggggacggucaagcugcucaaggcccuacgaucagcuauccaaugcuuuuacacguugccgcccagauugcaaguggaaugagauaccuggcaacccuaaacuuugugcaccgcgacuuggcuaccagaaacugccuggugggagaaaacuuuaccaucaagaucgcugacuucgguaugucuaggaauuuguaugccggcgacuacuacagagugcaggguagggcuguccuuccgaucagauggauggccugggaguguauuuugaugggcaaauucaccacggcuagugacguaugggccuuuggcgucacguuaugggagguccugaugcuuugcagagcccagcccuuuggacaguuaaccgaugagcaaguaauagaaaaugcuggcgaguucuuucgagaccagggccggcagguguaucugagucggccgcccgccugcccucaaggccuguacgaguuaaugcugagauguuggucgagggaaucagagcaacgccccccuuucucccagcuccaucgcuuccucgcagaagacgcacugaauacaguguag

SEQ ID NO: 14138 - RNA, 2760 nt, Artificial Sequence
  Description of Artificial Sequence: Synthetic coding sequence
augggucccgaagcccuguccucuuugcuucugcuccugcugguagccucuggcgacgccgauaugaagggucacuucgauccagcaaaguguagauacgcccuggguaugcaagaccgcacaaucccagauuccgacauuuccgcaagcucaaguugguccgacucaacugcugcucggcauucucguuuagaguccucugauggugauggcgcuugguguccagcugguuccguguuucccaaagaagaggaguaccugcaaguugacuugcagcgauuacaccuggucgcccucgugggaacucagggcaggcacgcggggggacugggaaaagaauuuucucgaagcuaucgguugagauauagcagggauggccguagauggaugggcuggaaggaucggugggggcaagaagugauuagcgggaaugaggauccugaagggguggugcugaaggaccuggggccucccauggucgcacgguugguaagauuuuaucccagagcagacagagucaugaguguuugccugcgcgucgaguuauacgguugucuguggcgggauggacuccugaguuacacagccccagucggacagaccauguaucuaucagaagcuguguaccuuaaugacagcaccuacgauggucauacugugggcggccugcaguacggcggacucggacaauuggcggacggaguggugggucuugaugauuuccgcaaaucucaggagcugcgcguguggcccggauacgacuacguagguuggaguaaccauucuuucaguucagguuacguggagauggaguucgaguucgacagguuaagggccuuucaagccaugcaaguucacuguaacaacaugcauacccuuggcgcucggcucccuggaggcguggagugccgguuucgaagaggccccgcaauggcuugggaaggagagccuaugcgccacaaccucggggguaaucuaggagauccccgggcucgagcggucagugucccacucggugggcggguugcgcguuuccuccaauguagauuccuauuugcaggaccguggcuucuauuuagcgaaaucucuuuuaucucagacguggugaauaacucuucgcccgcccuugguggaaccuuuccuccugccccgugguggcccccgggccccccucccaccaauuucucguccuuggaacuugaaccuaggggccaacagccgguggccaaggcugagggcucuccaaccgcaauccugauuggcugucuggucgcuauuauccuucugcugcuucuaauaauugcucucaugcuauggcgccuccauuggcgcagacuuuuguccaaagcugaaaggcggguccucgaagaagaguuaaccgugcaucugagcgugccuggggauacaauuuugaucaacaaccggccaggcccccgcgaaccaccuccauaccaagaaccaagaccuagagggaauccuccccacagcgcuccuugcgugcccaauggaucugcacugcuuuuguccaacccagccuauagacucuugcuagccacauacgcucgacccccacggggccccggcccaccaacccccgcuugggccaaaccgacaaauacccaggccuacucaggggacuauauggaaccugagaagcccggcgcacccuugcugccgccgccuccccaaaacuccgucccgcacuacgcugaagccgauaucgugacuuuacagggcguuacuggagguaacaccuacgcgguccccgccuugccucccggggccguuggggacggaccuccacgggucgauuucccuagaucacggcuccgauuuaaggagaagcugggcgaaggacaguucggugaaguucacuugugugaggucgacagcccccaagaucuagucuccuuagauuucccauugaacgugaggaagggacauccacuccuuguggcggugaagaucuugaggccagacgccacuaagaaugcaagcuucagucucuuuagccguaacgacuuucugaaagaaguuaagauaaugagcagacucaaggacccaaacauaauucgguuguugggcgugugugugcaggacgauccccugugcaugauuacagauuacauggagaauggcgaccugaaccaauuccuuuccgcacaucaauuagaggacaaagcugcugaaggggcaccuggagauggacaagccgcacagggacccacaaucucuuaccccaugcuucuucaugucgcugcacagaucgcuagcggcaugcgguacuuggcuacccuuaacuucgugcaccgcgaucuggcuacaagaaacugucucgugggggaaaacuucacuaucaagauugcagauuucggcaugaguaggaaccuguacgccggugauuacuacaggguccaaggucgggcgguacugcccauacgcuggauggcuugggaguguauacuaaugggcaaauuuaccacugcgagugauguuugggcuuuuggcguuacgcuuugggaaguucugaugcugugccgcgcgcagccauuuggccaacugacagaugaacagguaaucgaaaacgcuggugaauuuuuccgcgaccagggcagacaggucuauuugucaaggccuccagcuuguccacagggccuauacgaacucauguugagauguuggagccgcgaaucugagcaacgcccacccuuuucacaacuucaccgcuuccucgcugaagaugcuuuaaacacuguuuag

SEQ ID NO: 14139 - RNA, 1041 nt, Artificial Sequence
  Description of Artificial Sequence: Synthetic coding sequence
augcuaaagaaaccccuauccgccguuaccugguuauguauuuucaucguugcguuuguaucccaucccgccuggcuccagaagcuuagcaaacacaaaacaccagcacagccccaacucaaagcagcgaacugcugugaggaagugaaagagcugaaggcucaggucgccaaccuauccucacugcugucagaacuuaauaaaaagcaggaacgugauugggugagcgucguuaugcaagugauggaauuggaaucuaauagcaagaggauggaaucgagguuaaccgaugcagagucaaaauauucggaaaugaauaaucagauugauaucaugcagcuucaagcagcccagaccgucacgcagacuuccgcggacgcaauuuaugacuguucuagcuuguaccagaaaaauuauagaauuucgggcgucuacaaacuccccccagaugacuuucucggauccccagaguuagagguguucugcgauauggaaacaagcgguggcggguggacaauuauccagcguagaaaaucugggcuagugucuuuuuacagggacuggaaacaauacaaacagggauuuggguccaucaggggcgacuucuggcuggguaacgaacacauucacagauugucuagacaaccgacacgccucagaguagaaauggaggacugggaaggaaauuugcgcuacgcagaguauagccacuuugucuuaggcaacgaauuaaauuccuaucggcuguuucucgggaacuacacuggcaauguagguaacgacgccuugcaguaucacaauaacaccgcuuuuaguaccaaagauaaggacaaugauaauugucucgauaaaugugcucagcugcggaaaggaggcuauugguauaacuguugcacggauucaaaccugaacggcguauacuaucgguuaggagaacauaauaaacacuuggacggaauuacaugguacggauggcauggcagcacauauucacugaaacgggucgagaugaaaauucgaccagaagacuuuaaaccuuag

SEQ ID NO: 14140 - RNA, 1056 nt, Artificial Sequence
  Description of Artificial Sequence: Synthetic coding sequence
augaaaggcagggcuguguccuuugacccccuugccugccagggccuaaacgcuucuccaggaucccugacuucuccgcuccgucguauuaggucacugaccggacgggaaguuuugacuccuuucccaggacuaggcaccgcggcugccccugcucaggguggcgcacaucucaaaccccacagucuggugcucccaauuacugcuuuaccucccccuccacuggcccucagaggccgccaggcuacauccaagcucccaccuuuccuguccuccccauucccucccagccugugucccugggugccugacccugguuucaaggagacggcuuucuuguacgcugugagcagcgccgcgcugacacauacauuagcccgcgccugcucugccggacggauggagcgauguacuugugaugacucgccaggacucgaaagcaggcaggcuuggcagugggggguaugcggcgauaaccugaaauauaguaccaaauuucuuagcaauuuccucgguaguaaaagagggaacaaagaucugagagcuagagccgacgcacauaacacccauguuggaaucaaggccgugaagagcggacuucgaaccaccuguaaaugucacggcguauccggcucuugcgccguccguaccugcuggaagcagcuuaguccguuuagggaaaccggucaagugcugaaacuccguuacgauagugccgucaaggucaguucugccacaaaugaagcucugggacgccuagaacugugggcaccagcgcggcaagguucacuaaccaaggggcuggccccucgcuccggcgaucugguguacauggaagacucucccucuuuuuguagaccuucaaaauauuccccuggaacagcugggagaguuugcucuagggaagccucaugcaguucacuguguugugggcggggauaugauacccaaucuagacuaguugcauuuuccugccacugccagguucagugguguugcuacguugagugccagcaaugcguccaggaagaguuggucuacacuuguaaacacuag

SEQ ID NO: 14141 - RNA, 462 nt, Artificial Sequence
  Description of Artificial Sequence: Synthetic coding sequence
augaagcaccugagaccccaguucccacugauccuggcgauuuauuguuucuguaugcugcaaauccccaguuccggauucccccaaccgcucgccgauccuuccgacggucuugauauuguccaacucgaacaacucgcuuauugcuugucccagugggcgccucucucacgucagccuaaggauaaccaagacauauacaagagauuccuguuccauuauucucgcacccaagaagcgacucacccggucaaaacaggcuuuccuccagugcacccguugaugcauuuggcugccaaauuagccaaucgccgcaugaaaaggauacugcagagaggauccgggacugccgccgucgauuuuacuaagaaagaccauacugccaccuggggccgccccuucuuucuuuuccguccacgcaauggucgcaauauugaagaugaagcccagauucagugguag

SEQ ID NO: 14142 - RNA, 765 nt, Artificial Sequence
  Description of Artificial Sequence: Synthetic coding sequence
auggcagcagcauccgccggagccacaagacuguuacuccuucuguuaauggcuguagcagccccuucucgggccagaggcucuggaugcagagcggguacgggcgccagaggcgcgggagcagaggggagagaaggugaggcauguggcacaguagguuuacugcuugaacacaguuucgaaauugaugauucugcaaauuuuaggaagcgcgggucucuccuguggaaucaacaagacgggacacucagccugagucaacggcagcucucagaagaagaacguggccggcuucgcgauguagcagcucucaacggccuguaccgagugcgaauucccaggcgcccuggugcccuggacggcuuggaagcaggaggauaugugagcucauucgugccugcauguagccuugucgagagccaccuaagcgaccagcuuacucuccaugucgauguggccggcaacgucgucggggucagcguugucacacauccaggcggaugccgagggcacgaaguugaggaugucgacuuagaguuauucaauaccaguguucagcuccaaccaccgacaacggcucccggcccugaaacagcagcuuuuauugagagguuggaaauggaacaggcccagaaagcaaaaaacccacaggaacagaagagcuucuucgcaaaguauuggcauaucauccuuggcggggcaguucuccugacugcauuaagacccgcagcacccggcccagccccacccccccaggaagcuuag

SEQ ID NO: 14143 - RNA, 810 nt, Artificial Sequence
  Description of Artificial Sequence: Synthetic coding sequence
auggcagccgcuuccgcaggggcuaccagguuauuacuccuauugcugauggcaguagccgccccauccagggcaagaggaucaggcugccgugcggguacuggugcgcggggcgcgggugccgaggggagggagggcgaagccuguggaaccgugggacuccuacuugaacacucuuuugaaauagaugacuccgcuaacuuccggaagcgagggagccugcuuuggaaucagcaagaugguacccucucucucucacagaggcagcuaucagaggaagaaagaggacgauugcgagauguggcugcgcugaauggacuguauagagugcggaucccgagaagaccuggcgcucucgacggccucgaagcuggcggcuaugugagcucuuucgugccagccuguucccucgucgagucucaucucucugaccaacugacauuacauguggacgucgccgggaaugugguaggagucucuguggugacucauccaggggggugccguggccaugaaguggaggauguggaucucgaguuguuuaauacaagcguucagcugcaaccgccaaccacugccccuggucccgaaacugcggcuuuuauagagagguuggaaauggagcaggcacagaaggcuaaaaacccucaagaacagaagaguuucuucgcuaaguacuggauguacauuauuccagucguauuauuccucaugaugagcggagcaccagauacuggaggccaaggagggggugggggcgggggaggaggggguggaagugguagauguugcgugccgccaucacucuag

SEQ ID NO: 14144 - RNA, 480 nt, Artificial Sequence
  Description of Artificial Sequence: Synthetic coding sequence
auguccaguccucagagacguaaagccaugcccugggcccugucucuccugcuaaugggauuucagcuguuggucacuuaugccuggugcuccgaggaggaaaugggcggaaacaacaaaaucgugcaagauccaauguuuuuggcuaccguagaauucgcguuaaacaccuucaacguccagucuaaggaagaacaugcuuaccggcuguugcgcgugcugagcagcuggcgugaagacagcauggacaggaaauggagaggaaagaugguguucucaaugaaucugcaacugcgucagacggugugcaggaaguucgaggacgacauugauaacugccccuuucaggaaucgcucgaacugaacaacgucagacaaggaaucucauucccccaagugcacaguugcggaugcugcauggguuguggggugggaacaggugccgcagauaaagcuauaccccgcgacaaaggaaaauag

SEQ ID NO: 14145 - RNA, 1737 nt, Artificial Sequence
  Description of Artificial Sequence: Synthetic coding sequence
augcuccugcugcuucuucucgcuccccuauuccuccgaccucccggcgccggcggugcccagacucccaaugccaccucugaggggugccaaaucauucacccucccugggagggcggcauucgcuaucgcggcuugacacgagaccaaguaaaggccauuaauuuccuaccuguugauuaugaaauugaauacguaugucggggugagagagaagugguugguccaaaagugcgaaagugucucgcuaauggguccuggacagacauggacacuccaucacguugcgugcguauauguagcaagaguuacuugacccucgagaauggcaaaguguuucugacagguggcgaccugcccgcucucgacggagccaggguggauuuucgcugugaccccgacuuccacuugguaggcucuucaaggaguauauguucucagggccaguggagcacaccaaaaccccauugccaagucaaucguacaccacacuccgaacgcagagccguuuacaucggagcccuuuuuccaauguccgggggguggccaggaggccaggccugccagcccgccguagagauggcgcucgaagauguuaauucuagaagagacaucuugcccgacuacgaacucaagcugauccaccaugauagcaaaugcgacccaggacaggcuacgaaguaucuuuacgaacugcuguacaacgauccaauaaagauuauacucaugccaggguguucaaguguaagcacucucguggcugaagcggcgcguauguggaaccuaauugucuuaagcuacggaagcaguucacccgcccucucuaaccggcaaagauucccuaccuuuuuucgcacccacccuucagccacacugcacaacccuacccgcguaaaacuguucgagaaauggggcuggaagaaaaucgccacaauccagcagacgacagaaguauucacuagcacacucgacgaucuagaggaacgcgugaaggaggcuggaauagaaaucacuuuuaggcaaucauucuucagugauccugcgguaccaguaaaaaaccugaagagacaagaugcaaggauuaucgucgggcuguucuacgaaacugaggcacguaaggucuuuugugagguguacaaggagcggcuuuuugggaaaaaguaugucugguucuugauagggugguacgccgacaauugguuuaagauauaugauccuucuauuaauuguaccguggaugagaugacugaagccguggagggccacaucacgacggagauuguaaugcuuaacccagcaaauacuagaagcauaucuaauaugacuagccaggaguuugucgagaaguuaacuaagcgcuugaagcgccacccagaagaaacaggugguuuucaggaagcucccuuggcuuaugaugcaauuugggcauuagcccuggcccugaacaaaaccaguggugguggaggcagaucuggcgugcgacucgaagacuuuaauuauaauaaccagacaauaacagaccaaaucuaucgugccaugaauucauccucauuugaggggguuuccgggcaugucguuuuugacgcuucaggaucccggauggccuggacuuuaauugagcaauuacaaggcggaucguauaaaaagaucggcuacuaugacagcaccaaagaugaucugagcugguccaaaacugauaaauggaucguaauaagccguacucacucacccacuuag

SEQ ID NO: 14146 - RNA, 444 nt, Artificial Sequence
  Description of Artificial Sequence: Synthetic coding sequence
augcuaggccucccuuggaaaggagguuuaucuugggcacuuuuacugcuucuccuggguucccagauauuacuuaucuacgcauggcauuuucacgaacagagagacugugaugagcacaacguaauggcccgcuaucucccagccacuguggaauuugccguccacacauuuaaucagcagaguaaggacuacuaugcauaucgccucggacacauucugaauagcuggaaagagcaaguagagucgaagacuguguucaguauggagcugcugcucggaagaacuagaugcggcaaauucgaagacgacauugauaacugccauuuucaggaaucuaccgagcugaauaauacuuuuacauguuuuuucacaauuucaacacggcccuggaugacacaauuuucucucuugaauaagaccugccuggagggcuuucauuag

SEQ ID NO: 14147 - RNA, 444 nt, Artificial Sequence
  Description of Artificial Sequence: Synthetic coding sequence
augugguccuuacccccaucccgagcucugagcugugccccgcuccugcuacucuuuagcuuucaguuucugguaaccuacgccuggcgguuucaagaagaagaagaauggaaugaucagaaacagauugccguguaucugccaccuacgcucgaauucgccguguacaccuuuaacaagcaaucaaaggacugguaugcauacaaauuaguccccgucuuagcguccuggaaggaacagggguacgauaaaaugacauucucuaugaaccuacaacugggaagaaccauguguggcaaguucgaggacgacauugauaauugcccguuccaagaaucuccugaacuuaacaauacuuguaccuguuucuuuaccaucggcaucgaaccguggcgcacaagauucgaccuguggaacaagacauguucuggcggacacucauag

SEQ ID NO: 14148 - RNA, 2535 nt, Artificial Sequence
  Description of Artificial Sequence: Synthetic coding sequence
augggaccaggcgcuccauucgcacgcgugggguggccgcugccauugcugguuguuauggccgccggcgucgcuccugugugggcuucacauucuccccaccuccccaggccacacucuagggugccuccccacccuucaagcgaaagacgagccgucuacauuggugcccucuucccaauguccggaggauggccuggaggccaagcuugccagccugcaguugaaauggcccuggaagacgugaauagccgucgagauauucucccugacuacgaauuaaaauugauacaccaugauagcaaaugcgaucccggucaggcuacuaaauaccuguacgaacugcucuacaaugacccaaucaaaauuauucugaugcccggaugcuccagcgucucuacacuuguggccgaggccgcccguauguggaaucuaauuguguuguccuacggcucaucuucuccggcccucagcaauaggcagcgauuuccaaccuuuuuucgcacgcaccccucugcuacccugcacaaccccacccgagugaaacuguuugagaaguggggauggaagaaaauugcuaccauccagcaaaccaccgaagucuucacaaguacgcucgaugaccuggaagagaggguuaaagaagcagggauugaaaucacauucagacagucauucuuuagcgaucccgcugugccgguuaaaaaccugaaaaggcaagaugcccggauuauugucggauuguucuaugaaacugaagccagaaaaguauucugugaggucuacaaggagagguuguucgggaagaaguacguaugguuccugaucggaugguacgcagauaacugguuuaagauauaugauccuucaauuaauuguacgguggacgagaugaccgaagcaguggagggccauauuacaacugaaaucgugaugcuaaauccggcuaauacuagaucuauuuccaacaugacaucucaggaguuuguggaaaaacuuacaaaaagacugaaaagacacccugaagaaacgggcggguuucaagaagcgccacuggcuuaugaugcaaucugggcacuugcucuggcacuaaacaagacauccggaggggggggacggucaggaguacgucuggaagauuucaacuauaauaaucaaacaaucaccgaucagaucuaucgggcuaugaauucaaguucguucgaagggguuucaggccacgucgucuuugacgccuccgggucgcggauggcuuggaccuuaauagagcagcuccaaggaggaagcuacaaaaaaaucgguuauuacgacaguaccaaggacgaccuuucauggucuaaaacagauaaauggaucggcggauccccuccagcugaucagacucucguuaucaaaacauucagauuucuuucucagaaacuguucauauccguaagcguucugucuucccuggggauuguacuggccgucgucugucucaguuucaacauuuacaauagccacgucagauacauucagaauucccagccaaaccugaacaauuugaccgccguuggcuguucacucgcucuggccgcuguguuuccccucggccuggaugguuaccacaucggucgcaaccaguuucccuucgugugccaggcuagacuguggcucuugggccuggguuucuccuugggcuauggcuccauguucacaaagauuugguggguacauacuguuuuuacuaagaaagaagagaaaaaggaauggcgaaagacccuagaaccguggaagcuguacgcaaccguaggucuucuagucgguauggauguacucacccuggccaucuggcagaucguugacccacuacaucgcaccauagagacguuugcuaaagaggaaccaaaggaggacauugacguuuccaucuugccucaguuagagcacuguucuaguagaaagaugaauacauggcugggcaucuuuuaugguuacaagggccugcugcuguugcuuggaauauuucuagcauacgaaacuaaaucagugaguaccgaaaaaauuaaugaccacagggcugugggcauggccaucuacaacguggccgucuuauguuuaauaacagcacccgugaccaugauucugucaucccagcaggacgccgcauucgcauuugccagccucgcuauuguguuuucgucguacaucacacuuguuguucuguucguuccgaagaugagacgucuaauuacaagaggcgaauggcaaagcgaagcacaggacacgaugaagaccggaucuucaacaaacaacaacgaggaagagaaaagcaggcuucuggagaaggaaaaccgcgaacuugaaaagauuauagccgaaaaagaagagcgggucucugaacuuaggcaucagcuccagagcagacaacaacuucgaagcagacgccacccaccuacacccccggagcccagugguggccugccccgggguccaccugaacccccugacagacucucaugcgacggcucacgaguacacuugcuuuauaaguag

SEQ ID NO: 14149 - RNA, 2700 nt, Artificial Sequence
  Description of Artificial Sequence: Synthetic coding sequence
augcugcugcugcuacugcuagccccccuguuucucaggccccccggugcaggaggcgcgcaaacuccuaaugcaacaagugaaggaugucaaaucauccacccaccaugggaaggcgguauccguuaucgcggguuaacacgggaucaggucaaggcuauuaacuucuuaccaguggauuaugagaucgaauacgugugccgaggggagagggagguggugggccccaaagugcggaaguguuuggcgaacggcucuuggacugacauggacaccccuaguaggugcguaaaccggaccccccacagcgaaagacgugccguguacauuggugcccucuuuccaaugucggguggcuggccuggaggucaagccugccagccugccguugagauggcacuggaagacgucaauucuagaagggauauucugccggacuacgaguuaaagcuuauucaucacgauucuaagugcgaccccggacaagcgacaaaguaccuguaugaacuguuguauaaugacccuauuaaaaucauccuuaugccuggcuguuccuccgugagcaccuuaguggcagaagcugcacgcauguggaaucuuauuguccucagcuauggaucuaguuccccagcccugucuaaccgucaacgauuccccaccuuuuucagaacgcacccaucugccacguugcacaaccccacacgcgucaaacuguuugaaaaguggggguggaaaaagauugccacaauccaacagaccacggagguguucaccucaacccucgacgacuuagaggaacggguuaaggaggcaggcauagaaauuacauuucgccagucauucuuuucugaccccgccguacccgugaagaaccuuaaacgccaagacgcccgcaucaucgugggcuuauuuuaugagaccgaagcuagaaaaguauucugugaaguguacaaggaacgacuguucgguaagaaauacgucugguuuuugauuggcugguacgcugauaacugguuuaagauauaugauccuagcauuaauugcacaguugacgaaaugaccgaggccguggagggacacaucacuacagaaaucgucaugcuuaaccccgcgaacacgagaucuaucucuaacaugacaucccaggaauucgucgagaagcugacgaagagacucaaacggcauccugaggagaccgguggguuccaggaagcaccacuagcuuacgacgcaaucugggcucuagcucuggcacucaacaaaacaucuggaggcggaggccgaagcggcgugaggcuggaagauuuuaacuacaauaaucagacaaucacagaccaaauauacagggccaugaacagcaguaguuuugagggcgucuccggacaugugguguucgacgcuucugggaguaggauggccuggacauuaauugagcagcugcagggagggagcuauaaaaaaaucggcuacuacgauaguacuaaggaugaccuuucaugguccaaaacagauaaauggaucggaggaagucccccugcugaccaaacauuagugauuaagacauuccgguuucuuucccagaaacucuucauuucggugucaguucugucuucucucgguauuguguuggccgugguaugcuuauccuuuaacaucuacaauagucacguucgguauauacaaaauucucagccaaaucugaacaaucugaccgccgucggcugcucacucgcccuggccgccgucuuccccuuggggcucgauggcuaucacaucggcagaaaccaauucccuuucgugugccaagcaagguuguggcugcuagggcuuggauuuucucugggauauggcagcauguucacaaagauuugguggguccacacgguguuuacaaaaaaagaggaaaaaaaggaauggagaaagacgcuugagccuuggaaacuuuacgcuaccgucggccuguugguuggcauggacguccugacccucgcuaucuggcagaucgucgaccccuugcacagaacuaucgaaaccuucgcuaaggaagaaccuaaagaagauaucgaugucaguauacucccucaacucgaacacuguaguaguaggaaaaugaauacuugguuggguauauuuuacggcuauaagggccuccugcuacuuuuggggauuuuucucgcauacgaaaccaaguccguuucaaccgaaaagauaaaugaccacagagcugugggcauggcuaucuauaauguggcgguccuuugucugauuacugcccccgugaccaugauccucucaagccaacaggaugcugccuucgcguucgccagucuagcuauugucuucucauccuauauaacccuaguuguucuauuugugccaaagaugcgacgccugauuacccgaggugaauggcaguccgaagcacaggauacaaugaaaacuggaucuuccacaaacaacaaugaagaggagaagucccgccugcuugaaaaggaaaacagagaguuggagaaaauaauagcugaaaaggaggagagagucagugaauuaaggcaucaauuacagagucgccagcagcugagguccaggcgacaccccccuaccccuccugaaccauccggcgguuugccgagagggccaccugagccccccgaccgucugucuugcgauggaagcagaguccaccugcuguacaaguag

SEQ ID NO: 14150 - RNA, 2886 nt, Artificial Sequence
  Description of Artificial Sequence: Synthetic coding sequence
augcuguuacuccugcugcuggcaccuuuguuucuucguccuccaggagccggcggugcccagacacccaaugccacuucagaggguugucagauuauucauccuccaugggaaggaggaauucgguauagaggucugacucgugaucaggugaaagcuauuaacuuccugccagucgacuacgagauugaauacgucugcaggggcgagagagagguagugggccccaaagugcggaagugccucgcuaacggcucuuggacagauauggauacccccucacgaugugugcguauaugcuccaagucauaccuuacccucgagaaugguaaaguuuuccugacaggaggagaccuucccgcccucgauggcgcucgcguagauuuccggugcgaccccgacuuccacuuaguagguagcucucgauccaucuguucacaggggcagugguccacccccaaaccucacugucaagucaauaggacaccacacagcgaacggcgcgcugucuacaucggggcacucuuccccaugucuggcggauggcccgggggucaagccugccaacccgccguggagauggccuuggaagauguaaauagccggagagacauccuacccgauuaugagcugaaauugauucaccaugacaguaaaugcgauccuggccaggcaacaaaguaucuguaugagcugcuuuacaacgacccaauuaaaaucauccugaugcccggcugcucuagcguguccaccuuagucgcagaagcagcacguauguggaaccucauuguccucagcuauggcuccucaagccccgccuuguccaaccgccagagauuucccacuuucuuuagaacacacccuagugcuacgcuccacaacccaacuagagugaagcuguucgagaaguggggcuggaaaaaaauugcuacaauacaacagacuacggagguuuucacaucuacucuggaugaccuggaagaaagggugaaggaggcagggauugagaucacuuucagacaaucuuucuuuagugaccccgcuguacccgucaaaaaucugaaacggcaggacgcccgaaucauaguugggcuguuuuacgaaacugaggcccggaaggucuuuugugaaguguacaaagaaaggcucuucgguaagaaauaugugugguuccuaaucgggugguacgcagacaacugguucaaaaucuaugauccuucaaucaacuguacuguugaugaaaugacugaagccguugaagggcauauuaccacagagauugucaugcugaauccagcuaacacaaggucuaucucgaauaugacaagccaggaguucguugagaaacucacaaagcgacucaaaagacacccugaggaaacuggcggauuccaagaggccccauuggcuuacgaugcaaucugggcucuggcucuagcguuaaauaagacuagcgggggaggagggaggucaggggugaggcuagaggacuucaauuauaacaaucagacuaucaccgaccagaucuaccgggcaaugaauagcagcaguuucgaaggcgugagugggcauguaguauucgaugccagcggcagccgaauggcuuggacacuaauagaacagcuucagggcgggucuuacaagaaaaucggcuacuaugauucuaccaaagacgaccuuucauggucuaagacugauaaguggaucggcggcagccccccagccgaccagacacucguaaucaagacguuuagguucuugucgcaaaaacucuucauuagugugagcguacuguccucauuaggaauaguccucgccgugguuugccucagcuuuaacaucuacaacagucauguuagauacauccaaaauucacagccaaacuuaaacaaccuuacagccgugggauguagccuugcucuugcagcaguuuuuccccuaggacuagauggguaucauauugggcguaaccaguuccccuuugugugucaggccagacuguggcuauugggcuugggcuuuucauugggcuacggcagcauguucacaaaaauaugguggguccacaccgucuuuacuaagaaagaagaaaaaaaagaguggcgcaagacccuugaacccuggaagcuguaugcuaccgugggccuacucguagggauggacgugcugacacuagccauuuggcagauagucgauccuuuacaucgaaccauugaaacauuugcaaaggaagaacccaaagaagauauagaugugaguauccuaccacaguuggaacauugcucuucuagaaagaugaauacauggcuggggauuuucuacggcuacaagggauuacuguuacuacuggggauauucuuagcguacgaaacgaaauccgugaguacugaaaagaucaaugaucaucgcgccgucgguauggccaucuauaaugucgcuguucuguguuugaucaccgcgcccgugaccaugauccucaguucccaacaggaugccgcauuugcuuuugccucccucgccauuguguucagcucauacauaacacucgugguccuguuugucccgaagaugcggaggcugauuacccguggagaguggcaguccgaagcgcaagauaccaugaaaaccggaagcucuacaaauaauaaugaagaagagaagagucggcucuuggagaaggagaaccgugagcuagaaaaaauuauugccgagaaagaggaacguguuucggagcucagacaucagcuccagucccgacaacagcugcgaucccgaagacacccacccacuccgccagaaccguccggaggcuuaccacguggaccaccagagccaccagacagacuuucaugugauggaucaaggguccacuugcuguacaaauag

SEQ ID NO: 14151 - RNA, 882 nt, Artificial Sequence
  Description of Artificial Sequence: Synthetic coding sequence
augaauaaucuguccuucucagaacuuuguugccucuucuguugcccccccugucccggcaagauugcaagcaaguuagcuuuucugcccccagauccuacuuacacucucaugugcgaugaaagugguucuagauggaccuugcaucucagugaacgcgcugauuggcaauauuccucucgcgagaaagaugcaaucgaauguuuuaugacccggacaagcaagggcaaccgaauugcaugcauguucgucagaugcucccccaacgccaaguauacccuuuuguuuagccacggaaacgcggucgacuugggacaaaugaguaguuucuauauuggucugggcucuagaauaaacugcaacauuuuuaguuaugacuacagcggcuauggcgccuccagcgggaagccaacggaaaaaaaucuuuacgcagauauugaagcggcuuggcuggcccugcgcacacgauaugguauuaggccagaaaacgucaucaucuauggacagagcaucggaacuguucccuccgucgaccuugcugcaagauacgaauccgcggccgugauccuccauagucccuuaacauccggcaugcgcguugccuuuccugacaccaagaaaaccuacugcuucgacgcauuuccaaauaucgauaaaaucucuaaaauuaccagccccgugcuaauuauacacggaaccgaggaugagguuauugauuucucacacggguuagcauuguucgagagaugucaacgcccaguggagcccuuguggguggaaggggcagggcacaaugacguggagcuuuacggucaguaccucgaaaggcugaaacaguuuguaucccaggaacuggugcaaaagcauaaagaggguaaguag

SEQ ID NO: 14152 - RNA, 1155 nt, Artificial Sequence
  Description of Artificial Sequence: Synthetic coding sequence
augugguaugucagcacucgcggaguugcccccagagugaacuuugaaggugcucuuuuuucuggcuaugccccugacgguggccuguucaugcccgaagaacucccccaacucgaccgcggcacauuaugucaguggucaacucuaucguacccuggucucgucaaggagcugugcgcacuguuuauuggcuccgaacuucucccuaaagacgagcugaacgacuugauugaucgcgcuuucucccgauuuagacaucgcgaaguaguacaccugagccggcuuaggaacggccuaaacguucuggagcuguggcauggcgugaccuacgcauucaaagaccugucacuuagcuguaccacucaauuccugcaguacuuuuuagagaagcgagaaaaacacguuaccgugguggugggcaccucuggcgacacuggcagcgcggccaucgaaagcguucagggagccaaaaauauggauaucaucgugcugcucccuaaaggacauugcacaaaaauucaagaacuccaaaugacaaccguacuaaagcaaaacgugcacgucuuuggcguggaggggaauagcgacgagcuggacgaacccauuaagacuguguuugccgaugucgccuucguaaaaaaacacaaucuuaugagucuuaauagcaucaauuggagccgcguucuggugcagauggcucaccauuuuuucgcauauuuccaguguacuccgagucuagauacacaucccuuacccuuagucgaaguggucgugcccacgggugcugcagggaaccucgccgccggauauauagcccaaaaaaucggacugccaauccgccugguggucgcaguuaaccgcaacgauauaauucauagaaccguucaacagggagacuuuucucugagugaggcugucaaaucuacccuggcuuccgcaauggauauacaggugcccuauaacauggaaagaguguuuuggcuuuugagcgggucugacucccagguuaccagggcccucauggaacaauuugagcgcacccaaagcgugaaucuacccaaagaauuacacaguaaacacucucccguccugccucgucccugccuuugcagucaagugccuggcaguuguccugguuguuggcccgaccccuag

SEQ ID NO: 14153 - RNA, 2889 nt, Artificial Sequence
  Description of Artificial Sequence: Synthetic coding sequence
augcuuaggagaccugcaccagcacuggcaccugccgcgcggcugcuacucgccggucuuuuaugcgggggcggcgugugggccgcucgugucaacaaacacaaaccuuggcuagaaccuaccuaucacggcaucgucaccgaaaacgacaacacuguacuacuggacccucccuuaaucgcgcuugacaaggaugccccgcugcgguuugcugaaagcuuugaagugacugugacaaaagaaggcgaaauaugcggcuuuaagauccacggccagaacguccccuucgacgccgugguaguugauaaauccacuggcgaagguguuaucagaaguaaagagaagcuggacugugaguuacagaaggauuacucuuuuacuauccaagcauacgacugcgguaaaggccccgauggaaccaacguuaagaaaucacauaaggcaacaguacacauucaggugaacgacguuaacgaauacgcucccguguuuaaagagaagaguuacaaagcaacagucauugaaggaaagcaguaugacaguauacucagaguggaagcuguggacgcugacugcuccccucaguucucccaaaucugcucauacgagaucaucaccccugacgucccauucaccguugacaaagauggguauauaaaaaauacagaaaaguuaaauuacggaaaggaacaccaauauaagcucacugucacagccuaugauugcgggaagaaaagagcaacagaagacguccucguuaaaauuucuauaaagccaacaugcacaccaggcuggcagggcuggaauaaucggaucgaauacgaacccggcacuggggcacuugcugucuucccaaauauucaccuggagacuugcgacgagcccguggcuuccgugcaggccacuguggaacuugaaaccagccacauugguaaaggcugugauagggacacuuacucagaaaagagccuucaucgacugugcggcgcugcugcggguacugccgagcucuugcccucccccucuggaucucucaauuggacuaugggucugccaaccgacaacgggcacgacagcgaucaggucuuugaauucaacggaacccaagccguccggauucccgauggggucgugucugugagccccaaagaacccuuuacuaucucuguguggaugcggcacggacccuuugggcgcaagaaagagaccauccuaugcagcagcgacaaaaccgauaugaauagacaccacuacucccuuuacgugcacgguugucguuugaucuuuuuauuuagacaggauccuagcgaagagaaaaaguaucgccccgccgaguuucacuggaaauugaaccaaguuugcgacgaagaauggcaucauuacgugcugaacguggaauuuccaucuguaacccucuacguggacggaaccagucacgagcccuuuaguguuacagaggacuacccccugcacccuaguaaaauugagacacaacucguugugggggccuguuggcagggcggagaccuucauaugacacaguucuuucgcggaaaccucgccgggcuuacacugagaucuggcaaacuggcagauaaaaagguuaucgacugucucuauacuuguaaggagggucuggauuugcagguacuugaagauuccggaaggggcguacagauucaggcucaucccucccagcucgucuugacccuggaaggagaagaucuaggagagcuggauaaagcgaugcagcacauuagcuaucugaauucccgacaauucccaaccccuggcauucgccggcucaagaucaccuccacuaucaaaugcuucaacgaagcaacuuguauuucaguuccuccaguggauggcuaugugauggugcuccaacccgaagaaccaaaaauaucccugucaggcguccaccacuucgcuagggcugcuuccgaguuugagucaucugaaggcguguuccuguucccggaauugcguaucaucucaaccauuacacgggaaguagagccggagggcgauggagcagaagauccuacuguucaggaaucucucgugucagaagaaaucguccaugaccucgacaccugcgaggugacaguggagggagaggaauugaaccacgaacaggaauccuuggagguagacauggccaggcuacagcagaaggguaucgaagugucgucaucagagcuagguaugaccuuuaccgguguggauaccauggccaguuaugaagaaguguugcaccuccuuagauacagaaacuggcacgcacgcucacuccucgaucgaaaguucaagcucauuuguucugaguuaaacggaagguacauaucaaaugaauuuaagguagaagucaacgucauccauaccgccaacccuauggaacaugcuaaucacauggcugcacaaccucaauucguucaucccgagcacagaucauucguagaucuaucaggccauaaucuggccaacccccauccauuugccguggucccaagcacagccacuguuguuaucguugugugugugucauuccuuguguucaugauuauacuuggaguauucagaaucagggccgcucaccgacggacaaugcgcgaucaggacacaggaaaagaaaaugaaauggacugggacgacuccgcccugacgauaacagugaaccccauggagacuuacgaggaccagcacagcagugaagaagaggaagaggaggaggaggaggaagagagugaggacggggaagaggaggaugacaucacaagugcagagucagagaguucggaggaggaagagggugagcaaggcgacccgcaaaacgcaacuagacagcagcagcuggagugggacgauucuacguugaguuacuag

SEQ ID NO: 14154 - RNA, 2946 nt, Artificial Sequence
  Description of Artificial Sequence: Synthetic coding sequence
augcuccggaggccugcuccugcccuggcccccgcagcuagguugcuccuggccggucuccuuuguggcggcggggugugggcugcuagagucaacaaacacaaacccuggcuggaacccacuuaucauggaaucgugacagagaacgacaacaccguauugcucgacccccccuugauugcuuuggacaaagaugcuccccugagguucgcugaguccuucgaaguaaccgugaccaaagaaggugaaauuugcggauucaaaauccauggccagaacguuccuuuugacgcuguggugguagauaaguccacaggagaaggugucauucgaagcaaggaaaaacuugauugugaauuacaaaaagacuauaguuuuaccauucaggcuuacgacugcggaaaagggccugacggcaccaacguaaagaaaucccacaaggcaacaguacacauccaggugaaugauguuaaugaguacgcgcccgucuuuaaagagaagucauauaaggcuacagucauagaagguaaacaguaugauuccauucuucguguggaagccguugacgcggauugcagcccacaguucucccagauauguucauacgagauuauuacuccggacgugccauuuacggucgacaaagacggauauauuaaaaauacagagaaguugaauuacgguaaggaacaccaauauaaauugacagucacagcuuaugacugcgggaaaaaaagggcaacagaagacguacuuguuaagaucagcaucaaaccaacguguacaccuggcuggcagggcuggaacaaucguaucgaauacgaaccgggcacuggugcccuggcuguuuucccuaauauacaccucgaaacuugugacgaacccguagcgaguguccaggcgacaguagaacuggaaacaagccauauuggaaagggaugcgaucgagacacuuacucagaaaaaucucugcaccgacuguguggagccgcagcugguacugccgagcuccuccccuccccuagcggaucacugaacuggaccauggggcuucccaccgacaacggacaugauuccgaucaggucuuugaauucaaugguacacaggcuguuaggauacccgauggcguagugagugugucuccaaaggaaccauucacgauaagcguguggaugcggcauggcccauuuggcaggaaaaaggaaaccauuuugugcaguuccgauaaaacggacaugaauagacaccacuauucccuuuacguccauggcugucgcuuaaucuuucucuuucggcaggaucccagugaagagaaaaaauauagaccagcugaauuccacuggaaauuaaaccaggugugcgacgaagaguggcaccacuauguccugaauguugaguuccccucagucacuuuguauguagauggcacaucucacgaaccuuucucagucacagaagauuauccccugcauccaucuaaaaucgagacucagcuggugguuggugcaugcuggcaggaauuuuccgguguugagaacgacaacgaaacugaaccuguuaccguagccucggcaggaggcgacuugcacaugacccaauuuuuccgcggcaacuuggcaggcuuaacacugagaucaggaaaguuagcugacaaaaaaguuauugacugucuauacaccuguaaagagggacuggacuugcagguauuggaggauucagggagaggaguccagauacaggcccaccccucucagcugguccugacccuggaaggagaagaccucggcgaguuggacaaggccaugcagcauauuagcuaccucaacucacgccaauuuccuacgccugguauaagaagacucaaaauuacgaguacgaucaagugcuuuaacgaggccacauguauuaguguccccccuguagaugguuauguaaugguccuccaaccugaagaacccaagauuagccugagcggcgugcaccacuucgcacgcgcagcgagcgaguuugaauccagugaaggaguguuccuguuuccugaacuccgcaucaucucaacaaucacacgcgaagucgagccagagggugacggagcggaggacccuacuguccaagaaucccuaguguccgaagaaaucgugcacgaucuugacacaugcgaggucacugucgagggcgaagaacuuaaucaugaacaggagucauuagaaguugacauggcuaggcuacagcaaaagggcauagaaguuagcaguagugaguuggggaugacuuucacagggguagauacuauggcuucauaugaggagguuuuacaucugcucagguaucgcaacuggcacgcacggaguuuacuugauagaaaguucaaauugaucugcagcgaauugaauggaagauacaucaguaacgaauuuaagguugaagucaaugucauucacaccgcuaacccaauggaacaugcuaaccacauggcagcccagccccaguucguccacccagaacauaggucuuuuguggaccucuccggacacaaccuagccaauccccauccuuuugccguggucccguccacagcaaccguugugauaguugucugugucagcuuccucgucuuuaugaucauacucggagucuuucgcauuagggcggcgcaccgacgcacaaugcgggaucaggacacaggaaaagagaacgaaauggauugggaugacagcgccuugaccaucacagugaacccaauggagacauacgaagaccagcacagcucugaagaggaggaagaagaggaagaagaagaagaaagugaggacggagaggaggaggacgacauuaccagcgccgaaucugaaucuagcgaagaggaagaaggcgagcagggagacccucagaacgcgacaagacaacagcaauuggaaugggaugacuccacuuuaucuuauuag

SEQ ID NO: 14155 - RNA, 678 nt, Artificial Sequence
  Description of Artificial Sequence: Synthetic coding sequence
augagcggcuguucgaaaagguguaaguuaggauucgucaaguucgcucagaccaucuucaaguuaaucaccgggacccuuuccaaggauaaaauagaggacgagcucgagaugacaauggugugccacagacccgaaggacuggagcagcuggaagcccaaacaaacuuuacgaaacgagaacugcaaguccuguacagaggauucaaaaacgagugcccauccgggguggugaacgaggacacuuucaagcagaucuaugcacaguuuuucccccauggcgaugcauccaccuaugcacacuaucuauuuaacgcguuugacacaacucagaccggaagugucaaauucgaggauuuuguaacugcacuaaguauuuugcugcgggggacaguacaugagaagcuccguuggacuuucaaucuguacgauaucaacaaagauggguauauuaacaaggaagagaugauggacauugucaaagcaaucuaugauaugauggggaaauauacauauccaguccugaaagaagauacuccuagacagcacguugacguguuuuuucaaaaaauggauaagaacaaggacggaaucgugacucuugaugaauuccuagaaaguugccaggaggacgauaacauuaugagaucccuucagcuguuccaaaaugugauguag

SEQ ID NO: 14156 - RNA, 420 nt, Artificial Sequence
  Description of Artificial Sequence: Synthetic coding sequence
auguacaagcuggcauccugcugcuuacuguucaucggcuucuuaaauccauuacugaguuugccucugcuggacucccgcgagaucuccuuucaguuaucagccccacaugaggacgcaagauuaaccccugaagaguuggagagagccagucugcugcagauucucccggaaaugcucggggcugaacgcggugacauucucaggaaggcugacuccaguacuaauaucuucaacccacgcggaaauuugcgcaaguuccaagacuucuccgggcaagauccaaauauccugcucucccaccuccucgcccgaauuuggaaaccuuacaaaaagcaaagaaggaagcuccgacaggaccucagacuguggaagaaagaaccuggucuccggauuuucaagaacuacguguggguuuag

SEQ ID NO: 14157 - RNA, 879 nt, Artificial Sequence
  Description of Artificial Sequence: Synthetic coding sequence
auggaagugaccgcgguggccacccagggagguuauggaucuagcgacuggguaacaaguuaucugcugauguucagugauggaggcagaaacuggaagcaguacaggcgagaggagucaauuugggguuuccccgguaauaccaaugcggacagugucguucacuacagauuacaaccaccuuucgaggcaagauuucuuagauuucugccauuagcuuggaacccucgggggagaauuggcaugaggaucgaggucuaugguugcgcauacaaaagcgaggugguguauuucgaugggcagucugcccuacucuauagacucgacaagaagccucuaaagccaauaagggacgugaucagucugaaauucaaagcaaugcagucuaacgguauucuccuacaccgggaaggccaacacgguaaccacauaacauuggagcucaucaaaggcaaacuaguguuuuuuuuaaacucagguaacgccaaacuuccauccaccauugcuccugugacucugacgcuggggagccuuuuagaugaccaacacuggcacucagugcugaucgagcuacuggauacccaaguuaacuucaccguagauaagcauacccaccacuuccaggcuaagggcgauaguaguuaucucgaccuuaauuucgaaauuucauucggcggaauuccaaccccuggccguucccgggccuuccgacgcaaaucauuucauggcugucuugaaaacuuguauuacaacggaguggauguaacugagcuggcgaagaaacacaagccacaaauucugaugauggaauuggcucauggccuccaggaccaaaaucugaagaucucucugacugucugucaccaaacaacccaguag

SEQ ID NO: 14158 - RNA, 783 nt, Artificial Sequence
  Description of Artificial Sequence: Synthetic coding sequence
augaagacuucugacgguuucaccuugaacgcugaguccuauguauccuucacaaccaagcuagacaucccaacagccgcgaaguacgaauacggcgugccuuugcagacgucugacagcuuucuuagauuucccuccucccugacuuccucucucugcaccgauaauaacccugccgcuuuucuggugaaccaagccguuaaaugcacucgcaaaaucaaccuggagcagugcgaagagaucgaggcccuuaguauggccuucuauagcucacccgagauacugcggguuccugauagccgcaagaaaguaccaauaaccgugcaaaguaucgugauucagagccucaauaagacccugacccgaagagaagauacagacgugcuccaacccacauuaguaaaugcugggcauuucucacugugcgugaaugucgugcuggaaguuaaauacucacuuaccuauacagaugccggagaagugacuaaagccgaccucaguuucguacuggggacugucucuuccguuguggucccccugcagcaaaaguucgagauucauuuucuccaaaccgacuggucaaguccgguuagugcucggaguacggaaggcgaggaaccagcaguaggaccagguuugccuagacugagggguccauucuggaaguucccgggcccugggcacgccggacuuggugcccacccacuccaccacccaguuauucaacaggagggauuucuuccagcaccuagaggauucggguaucgaagcgaagucgacuag

SEQ ID NO: 14159 - RNA, 3624 nt, Artificial Sequence
  Description of Artificial Sequence: Synthetic coding sequence
auggcuagugucgccugggcuguacucaaagucuuacugcugcuccccacacagaccuggaguccagucggcgccggaaauccuccugauugugacgccccucuugccagugcgcuuccacgcuccucauuuucaaguaguagcgagcucucuaguucccacggaccuggauuuagcagauugaaccggcgagacggcgcagggggauggaccccccuaguuucaaauaaauaccaguggcuacagaucgaucuuggagagaggauggagguuacggccguagcuacccagggaggguacgguagcagcgauuggguuacauccuauuuacugauguuuagugaugggggaaggaauuggaagcaguaccggcgagaggaaaguauaugggguuuuccugguaacaccaaugccgacucugugguucacuauagacuucagcccccauucgaagcccgguuccugagauuucuuccacuggcauggaauccucguggacgcauaggaaugaggauagagguauauggcugcgcauacaaaucagaaguggucuauuuugacgggcagucugcacuccuguauaggcuugauaagaaaccacugaaacccauccgggacguuauaagcuugaaauucaaggccaugcaauccaaugguaucuuacuucauagagagggccagcacggaaaccacaucacgcuugaacucauuaaaggaaaacucguuuuuuuucugaacucuggcaacgcaaaauugccgucaacgauagcgccaguuacccuaacucugggcucacuacucgacgaucaacacuggcauucuguccucauugaacuucucgauacacaagugaauuucaccguggacaagcauacacaucacuuccaggcgaaaggagacaguuccuaccuagaccugaauuuugaaauaucuuucggaggcauuccaaccccaggucggucacgugcauuuagacguaagucuuuccauggguguuuagaaaaucuguauuacaacggugucgacguaacugaacuggccaagaagcacaaaccgcagauccucaugaugggaaaugugucuuuuucauguccccagccccaaaccguaccugugacguuccuuuccagucgauccuaccuggcucugccuggaaauuccggagaagauaaagugucuguuacuuuucaguuuagaacuuggaaccgcgcuggacaccuacucuucggagagcuuagaagaggcucuggcuccuucguucuguuucuaaaagauggaaaacugaagcugucucucuuccagccaggccaaucuccucggaacguuacggcaggggcuggauuaaacgacggucaguggcacucugugucuuuuucugccaaauggagccacaugaaugucgugguagaugacgauacugcuguccagccucucguggccgugcuuauugauagcggggauacuuacuacuuugggggcugucuugacaauucgucuggaucagggugcaagucgccuuuggguggauuucaaggaugccuaagguugaucacaauuggagacaaagcgguagaucccauccugguccagcagggugcccucgguagcuucagagaccugcaaauagacucuuguggaauaacugaucgaugccuucccucauauugcgaacaugguggugaaugcucucaguccugggacaccuucucaugugauugucugggaacgggguacaccggcgagaccugucauagcagucuguacgagcagucgugcgaggcccauaagcauagagguaacccauccggacuguauuacaucgacgcugacggcucaggaccacuugggccuuuuuugguuuacugcaacaugacugacgccgccuggacuguggugcaacacggcggacccgaugcugugacucucaggggcgcgccaucuggacacccacggagcgcagugaguuuugccuaugcugcaggagcuggacagcugagauccgccguuaaucuugccgagaggugcgagcagagacuggcccucaggugcggaaccgcacgcagacccgauucccgagacggcacgccccuaagcuggugggucggccgaacaaaugagacucauacguccuggggcggcagccucccggacgcacagaaaugcacaugcggcuuagaagggaauuguauugacucccaauacuacugcaacugcgaugcuggucggaaugaauggacaucggauacaauuguuuuaucucagaaagaacauuuaccugucacacagaucguaaugacggacgcuggaaggccucauagugaagcugcuuacacgcugggcccauuguugugucgcggagaccagagcuucuggaauucugccagcuucaacaccgaaaccucauaccuacacuucccugccuuucacggagaacuaacagccgauguauguuuuuuuuuuaaaacgacuguuagcuccggggucuuuauggagaaccuuggcaucacggacuucauccgcaucgagcuccgggccccuaccgagguuacauuuuccuuugaugucggaaacggacccugcgaaguuaccgugcagagccccacacccuuuaaugacaaccaauggcaucacguccgcgcagaaagaaaugugaaaggcgccagucuucagguggaucagcuaccacagaagaugcaaccggcuccugccgauggccacguucggcugcaacuuaauucacaauuauucauugagauuagcgcuuauuuugccacaggaagcucaaugacuuaccacuuucaggagcauuacacacugucagaaaauucaucuagccuagucaguucucuccacagagaugugacccuaacccgggagaugaucacgcucagcuuuaggaccacacgcacccccucacugcuccuuuacguuucuaguuucuacgaagaauauuuaagcgucauccuagcuaacaacggcagcuuacagaucagauauaaacuagaccgccaccaaaaccccgacgcuuuuacuuucgacuuuaagaauauggcagacggacagcuccaucaggugaagauaaauagagaagaggcuguagucaugguugaagucaaccaaucuacuaagaaacaggugauucugucuucagguacggaauuuaacgccguuaaaucacucauacucggcaaaguguuggaggccgccggugccgaucccgauacuaggagggccgcaaccucugguuuuacaggcugucugagcgccguccguuuuggccgagccgcuccucuaaaggcugcccucagaccgucaggcccuucacgcguuacaguccgaggucauguggcaccaauggcucgaugugcagccggugcggcaucugggucaccagccagggaacucgcaccccgacuggcagggggagccggucgcucaggccccgcagacgaaggagagccacuuguaaaugccgauagaagggacagcgcugucauuggcgggguaaucgcuguuguuaucuuuauucuccuguguauaaccgccaucgccauccgaaucuaucaacagcggaaacugagaaaggaaaacgaaucgaaggucagcaaaaaagaggaguguuag

SEQ ID NO: 14160 - RNA, 2238 nt, Artificial Sequence
  Description of Artificial Sequence: Synthetic coding sequence
auggccuccguagccugggcuguauuaaaagugcucuugcuucuaccuacucagaccuggucaccuguaggcgcuggaaacccucccgacugcgaugccccgcucgcgucagcacugccgcggucaagcuuuagcuccagcucugaacucuccuccucccacggacccggauucucucgccugaaucgacgcgauggagcggguggcuggacuccccucguaucaaauaaauaccaaugguuacagaucgaccuaggagaaaggauggaggugacugcaguagcgacgcaggggggcuacggauccagcgauugggugacauccuaccucuuaauguuuagcgacgggggccgcaacuggaagcaguaccggagggaagagagcauauggggguuuccugguaauacuaaugccgacucuguugugcauuacagacugcagccuccauuugaagcacgguuucugagguuccugccucuugccuggaauccuagagguagaauuggcaugcgaauugagguguauggaugugcuuauaagucugaggugguguacuucgauggccaaucugcucugcuguauagacuagacaagaaaccucugaagccaauccgggacguuauuucccucaaauuuaaagcgaugcaauccaacggcauccuucuucacagggagggacagcacggaaaucacauaacgcuagaacugauuaaaggaaaacuuguguucuuccugaauucugggaaugccaaauuacccucuacaaucgcuccagugacucucaccuugggcucucuacuagacgaccaacacuggcauagcguacucaucgaauugcuugacacccagguaaacuuuacgguugauaagcacacacaccauuuucaggcaaaaggugauucauccuaccuggaucugaauuuugagaucucuuuuggaggaauuccaacccccggacggagucgcgcuuuccgacgaaaauccuuucauggcugccuugagaaccuguauuacaacggagucgacgugacugagcuugcuaagaaacacaaaccucagauacugaugaugggcaauguuagcuucuccuguccacagccucagacagugccgguuaccuuucugucuucucguucuuaucucgcccuaccugggaauucaggugaggauaaaguuuccguuacguuucaguucagaacuuggaaucgagcuggccaucuguuauucggagaacuucgaagaggguccggcucuuuuguacucuuuuugaaggauggaaagcugaaacuaucacuguuucagccaggacaaagcccaaggaacgugaccgcuggagcgggcuugaaugacggccaauggcacucuguuuccuucagcgcuaaauggagucauaugaauguugucguugaugaugauacagccgugcaaccucucgucgcuguucuaauugauucaggcgacaccuauuauuuugguggauguuuggauaauucaucaggguccggcugcaagucaccguuggggggguuccaaggcugccuucgacucauuaccaucggagacaaggccguagaucccauucucguucaacaaggugcauugggaagcuuucgagaccuccagaucgauucaugcgguauuacugacagaugucuaccaagcuacugcgagcacggaggagaguguucccaaagcugggacacguuuucuugcgacugccuagggacaggauauacaggcgaaaccugccacuccucucuguacgaacagucaugcgaggcucauaaacaucgcggaaauccuucuggacuguauuacauugacgcagacgguaguggcccacucggucccuucuuggucuauuguaacaugacagaugccgcuuggacagucgugcagcauggcgggccagacgcugugacacugaggggcgcgccuuccggucauccccgcagcgcagucucuuuugccuacgcggccggagcaggccaacucagaagcgccgucaaucuagccgagcgaugugagcagcggcucgcccucagaugcggaacagcucgaagacccgauaguagagauggaaccccacugagcugguggguuggacgaacuaaugagacacacacuucuuggggagggagcuugccugaugcacagaagugcacuugugggcuggaagggaauuguauagacucucaguacuauuguaauugugaugccggacgcaaugagugguag

SEQ ID NO: 14161 - RNA, 549 nt, Artificial Sequence
  Description of Artificial Sequence: Synthetic coding sequence
auggagccgcaacugggaccugaagcugcugcacuucgacccggcugguuagcccuucuccucugggugucagcccugucaugcucuuucucacugcccgcgagcaguuuaaguucucuuguaccucaagugcgcacauccuacaacuuuggcaggaccuuccucggacuggauaaauguaaugcuugcauuggcaccucaaucuguaaaaaauucuuuaaggaggaaauacgauccgacaacuggcuggccucccaucuaggccucccucccgacucccuucucucauaccccgccaauuauagcgaugacaguaaaauauggagacccgucgagaucuuuagguuggucucuaaauaccagaaugagaucagugauagaagaauaugcgccucggcuagcgcacccaaaacauguagcaucgagagaguacuuagaaagacagaacgauuucagaaguggcuccaagcaaaaagguugaccccagaccuuguccaggauugucaccagggccagcgagagcuaaaauuccugugcauguugagguag

SEQ ID NO: 14162 - RNA, 282 nt, Artificial Sequence; identical to SEQ ID NO: 12523
  Description of Artificial Sequence: Synthetic coding sequence

SEQ ID NO: 14163 - RNA, 387 nt, Artificial Sequence
  Description of Artificial Sequence: Synthetic coding sequence
augggcaagucggcgucuaaacaauuccauaacgaaguacugaaagcucauaacgaguauagacaaaagcacgggguuccaccucugaaacucuguaagaaucugaauagagaagcacagcaauacuccgaagcacuggcuaguaccaggauccucaagcacucacccgaauccagucguggacaguguggcgagaaucuggcaugggcaaguuacgaccagacaggccacuuuacggcaaugguauggaaaaacacuaagaaaaugggcguuggaaaagcgagugcgucagacggcaguucauucgucgucgcgcgcuacuuuccagcagggaacgucgugaacgaaggguuuuucgaagaaaauguguugccuccaaaaaaguag

SEQ ID NO: 14164 - RNA, 465 nt, Artificial Sequence
  Description of Artificial Sequence: Synthetic coding sequence
auggguaaauccgcuuccaagcaguuccauaacgagguguuaaaagcacacaaugaguaucggcagaaacaugggguccccccgcugaaacuuugcaagaaccuuaauagagaagcccaacaguacagugaagccuuagcauccacuagaauccugaaacacagccccgaaaguagcaggggccaauguggggaaaacuuggccugggccucauacgaucagaccggcaaagagguggcagaccgaugguacucugaaauaaaaaauuauaacuuccagcagcccgguuucaccagcggcaccggccacuucaccgcaauggucuggaaaaacacuaagaaaaugggaguuggcaaagcgagcgccuccgacgguagcagcuucgucguugcuagguacuucccugcaggcaauguagucaaugaaggauuuuucgaagaaaacguucugccccccaaaaaguag

SEQ ID NO: 14165 - RNA, 831 nt, Artificial Sequence
  Description of Artificial Sequence: Synthetic coding sequence
auggauaguucacgagagcccacacugggcaggcucgacgcagcuggauuuuggcagguguggcaaagauuugaugcugacgagaaaggauacauagaagaaaaagagcucgacgcguuuuuccugcacaugcugaugaaacuuggcacagacgacacaguuaugaaagcuaaccuucauaaggugaaacagcaguuuaugaccacgcaagaugcaaguaaggauggcagaauccguaugaaggagcuggccggaauguuccuuucugaggacgagaauuuucugcugcuguuucgaagagagaacccccuggacagcuccguggaguuuaugcagauuuggaggaaauacgacgccgacuccucaggcuuuauauccgcugcugaauugcgaaacuuccuuagagaucuguuccuccaccacaaaaaagcaauauccgaagcuaaacuggaggaauacacaggaaccaugaugaagaucuucgaucgaaauaaagauggccggcuagaccucaaugaccucgcaaggauccuggcccuccaagagaacuuuuuguuacaguucaagauggacgcaugcucaaccgaagagagaaagagggauuuugaaaaaaucuucgcguacuacgacguaagcaagacuggcgcgcuugagggacccgaagucgacggauuugugaaggauaugauggaacucgugcagccuucuauaaguggcguugaccuagacaaauuuagggagauacuccugaggcacugugacguaaacaaagauggcaagauacagaaaucagagcuggcacucugccucggccucaaaauaaacccauag

SEQ ID NO: 14166 - RNA, 216 nt, Artificial Sequence; identical to SEQ ID NO: 12527
  Description of Artificial Sequence: Synthetic coding sequence

SEQ ID NO: 14167 - RNA, 1287 nt, Artificial Sequence
  Description of Artificial Sequence: Synthetic coding sequence
augaagccuaugcuaaaagacuuuuccaaccuccuauuggucgugcugugcgauuauguucucggcgaagcagaauaccuuuuacuuagagaaccgggacaugucgccuugucuaaugacaccguuuauguggauuuucaguacuucgacggggcaaauggcacacugcggaaugugucgguucuacuccuggaagcaaacacuaaucagacuguaacaaccaaguacuugcuuacaaaccagagucaggguacguuaaaauucgaauguuuuuacuucaaagaagcuggagauuauugguucacuaugacacccgaagccacagacaauagcaccccuuuccccuggugggagaaaucugcguuuuugaagguugaguggccagucuuucauguugaccugaauagaagugcaaaggcagccgagggaacguuucaagugggccuguucacuagccagccucuuugcccguuucccguggauaagccuaauauugugguggaugucaucuuuacgaauuccuuacccgaggcccgcagaaauucucgacaaccgcuggagauacguacaagcaaacgcaccgagcucgcacaggggcaguggguggaauucggcugugccccauuaggaccagaggccuacgugacuguaguguugaagcuucugggacgugacaguguaaucacaucuaccggcccaaucgaucuagcccagaaauucgguuacaagcucgugaugguaccagaauugaccugcgaaucuggagucgaaguaacagugcucccccccccguguaccuuuguucaaggcguggugaccgucuucaaggaagccccuagauacccaggcaaaaggacaauccaccuugcggagaacucccugccacugggcgagcggcggaccauauuuaauuguacacuguucgauaugggaaaaaacaaguauugcuuugauuucgggauuucaucccggucgcacuucuccgcaaaagaggaauguaugcuuauucagaggaauacagaaacauggggucuuuggcagcccuggagucagugcuccgcaacauguggagauggagugagagaacgacgucgcguuugucugacuagcuuuccuuccuccccuguaugcccugguaugagucuggaagccucccuguguagccucgaagagugcgcaggacguuucaggagcuguugcccuggcuggucagcuaugguaagguccagacugacuaacuccgccucuagaguucaagcuauucuuuugccccaaccgcuugcauag

SEQ ID NO: 14168 - RNA, 312 nt, Artificial Sequence
  Description of Artificial Sequence: Synthetic coding sequence
augaagcugugcgugacugucuugucacucuuagucuugguugcugccuucugcucccuugccuuaucugccccuaugggcuccgacccgccuaccgccugcugcuuuagcuauaccgcucguaaacuuccucgcaacuucgugguggacuauuacgaaaccucaagccugugcucccagcccgcaguggucuacagggaaucagccucaucagcagcgccaggaagaaucccaagcacccgagcagccccccacggaccuuggagugguagagguaggugccugccucaggccagagacaaggcccgguag

SEQ ID NO: 14169 - RNA, 279 nt, Artificial Sequence; identical to SEQ ID NO: 12530
  Description of Artificial Sequence: Synthetic coding sequence

SEQ ID NO: 14170 - RNA, 282 nt, Artificial Sequence; identical to SEQ ID NO: 12531
  Description of Artificial Sequence: Synthetic coding sequence

SEQ ID NO: 14171 - RNA, 1869 nt, Artificial Sequence
  Description of Artificial Sequence: Synthetic coding sequence
augggaaagagcgaaggacccgucgguauggucgaaucugcuggacgagccggacagaagcguccagguuuucuggagggaggucuguuguugcuacugcuucuggugacagcagcucuuguggcuuuaggagugcuguaugccgacagaagaggaaagcagcugccucggcuggccagccgccuguguuuuuuacaagaagaacguaccuuugucaagcggaaaccucguggaaucccagaagcucaagaggucucagaggucugcacuacaccaggaugcguuauugccgcugcccgaaucuuacaaaacauggacccuacuaccgagccaugugacgauuucuaccaauucgccugugguggguggcuucgcagacacgugaucccugaaacaaacagccgcuauucuauuuuugauguccuacgugaugaacucgaggugaucuugaaaguugagcuggaaacccaacucgccaaggccacuguuccacaagaagaaaggcaugacgugaucgcucucuaccaucgaauggggcuugaggagcugcagucccaguucggccugaagggguuuaauuggacucuuuuuauucagacgguuuugucaagugugaaaaucaagcuccuuccagaugaagaggucgucguuuacgggauccccuaucuacagaaucuugagaauauaauagacaccuacucggcucggacaauccagaacuaccuuguuuggcgcuugguucucgaucgcauugggagccugucccagcguuuuaaggauacccguguuaauuaucggaaggcauuauucgggaccaugguggaagagguuagauggagagagugugugggauaugugaacagcaauauggagaaugccgucgggucgcuguacgugagggaggccuuuccaggggacuccaaauccauggugagagagcucauugacaaagucagaaccguguuuguagagacuuuggacgaacugggauggauggaugaagagaguaagaaaaaggcccaagaaaaagcuaugucuauaagagagcaaauuggccacccugauuacauccuugaagagaugaaccgccgcuuggacgaagaguauaguaaccucaacuuuucagaggauuuguauuucgaaaacagccugcagaaccucaagguuggcgcccagcgaagcuugcguaaauuacgagagaaaguugacccuaaucucuggauuaucggcgccgccguuguaaacgcguuuuauucgcccaacagaaaucagauuguuuuuccagcuggaauccuucaaccuccauucuucucuaaagaacaaccacaggcucugaacuucggcggcauuggcauggugauuggccaugaaauaacucacggauucgaugacaauggcagaaacuuugacaagaacgggaauaugauggauugguggagcaacuuuaguacacagcacuucagagagcagagcgagugcaugaucuaucaguacgguaauuauagcugggaccuggcugacgaacaaaacgugaaugguuucaauacccuuggggaaaacauagcugauaacggagggguuagacaggcuuauaaagcuuaucugaaauggauggcugaaggcggaaaggaucagcagcuaccaggacucgaccuaacccaugagcaacuuuuuuucauuaacuaugcacagguauggugugguuccuauagacccgaguuugccauucaauccauuaaaaccgacgugcacucaccccugaaguauaggguacuuggcucacuccagaauuuagcggccuucgcugauaccuuccacugcgccagaggaacaccuaugcauccaaaagaacgaugucgcguuugguag

SEQ ID NO: 14172 - RNA, 2340 nt, Artificial Sequence
  Description of Artificial Sequence: Synthetic coding sequence
augggaaagagugaaggcccuguaggcaugguggaaucugcuggacgggccggacaaaaacgcccaggauuucuagaggggggucugcucuugcucuugcuucuugugaccgccgcacuggucgcccuagggguucuguacgccgaucgcagagggaagcaacugccucgacuugcuaguagauugugcuucuugcaggaagaaagaacauucguaaagcguaaaccaagggggauuccagaggcccaggaagucagugaagucuguacuacccccggaugcgugaucgcugccgcacgcauucugcaaaauauggauccuaccacugagccgugugacgacuucuaucaauuugcuugcggcggaugguuaagacgccaugugauuccagaaacaaacaguagauacagcaucuucgaugugcucagagacgaguuggagguuauucugaaagcgguucuugaaaacagcacagcuaaggaccgcccugccguggaaaaggccagaaccuuauaccgaucuugcaugaaccaauccguuaucgaaaagcguggaagccagccacuccuggauaucuuggaggugguggggggauggccuguggcuauggacagauggaaugaaacugugggccuggagugggaauuggaacgucaguuagcccucaugaacagucaauuuaaucgccgcguacucauagaucuauuuaucuggaacgacgaccagaacucaucaaggcacauuaucuauaucgaucagccaaccuuggggaugccuagcagagaauacuacuuuaauggagguagcaauagaaagguacgagaggcauaccuccaguuuaugguuaguguggccacgcuucuuagagaggacgccaaucugcccagagauuccugucugguccaagaggacaugguacaaguccuggagcucgagacacagcucgcuaaggccaccgucccucaggaagaacggcacgacgucauugcucucuaucaccgcauggggcuugaagaacugcagucccaauuuggacucaaggguuucaacuggacacuguuuauccagaccguccucuccuccguuaagauaaaguuguugccggacgaagaaguggugguuuacgggauaccguauuuacagaaucuggaaaauauaaucgauaccuauucagcuagaaccauccaaaauuauuugguuuggagacuggugcuggaucgcaucggaagucugagucagagauuuaaagauacgcgugugaauuacaggaaggcccuguucggcacuauggucgaggaggugagguggagagaaugcgucggauacguaaauagcaauauggaaaaugccguaggaagccuguauguucgcgaagccuuccccggcgauaguaaaaguauggugcgggaacugaucgauaaaguacgcacuguuuucguggaaacauuggacgagcucgguuggauggacgaggaaucaaagaaaaaagcacaggaaaaggcgaugucgauaagggaacaaauuggucaucccgauuacauucuugaagagaugaaccggaggcuggaugaagaauacucuaaucuaaauuucucugaagaccucuauuucgaaaauucucugcaaaauuuaaagguuggcgcacagagaagccuucgcaaauuaagagagaaggucgaccccaaucuguggauuauaggcgccgccguuguuaaugccuucuacagcccaaaccguaaccagaucguuuucccugcaggaauuuugcagccuccauuuuucucuaaggaacagccucaggcucugaauuucggcgggauuggcaugguuaucgggcaugaaauuacccacggcuuugaugacaacgggagaaauuucgauaagaacggaaauaugauggacugguggucaaauuucucgacccagcauuuucgagaacagucagaaugcaugaucuaucaauacggcaacuacucaugggaccuugcggacgaacagaacgugaauggauucaauacauuaggcgagaauauugcggacaacggcgggguuaggcaggccuacaaggcauauuuaaaauggauggccgagggggggaaggaucaacagcuucccggccucgaccucacccacgaacaguuauuuuucauuaauuaugcccaaguguggugcggaaguuacaggccagaguucgccauucagaguaucaaaacagaugugcacucuccacucaaguaucggguccugggcagucuucaaaaccuugccgcuuuugcggauacauuccacugugccagggguacaccaaugcauccuaaggaaagguguagaguuugguag

SEQ ID NO: 14173 - RNA, 258 nt, Artificial Sequence; identical to SEQ ID NO: 12534
  Description of Artificial Sequence: Synthetic coding sequence

SEQ ID NO: 14174 - RNA, 657 nt, Artificial Sequence
  Description of Artificial Sequence: Synthetic coding sequence
augggcaggguguuccucacaggagagaaagcaaacuccauuuugaagagauauccaagagcaaacggguuuuuugaagaaauccgccagggcaacauugaacgcgaauguaaggaggaauuuuguacuuuugaagaagcaagggaggccuucgagaacaacgagaagacuaaagaguuuuggucgaccuauacuaaggcucaacaaggcgaguccaaccgggguagcgacugguuucaauucuauuugacuuuuccacugauuuuugguuuauucauuauucuucuggugauauuccugauauggagaugcuucuugcgcaauaaaacaagaagacagacaguaaccgaaggacacauacccuucccccaacaccuuaauauuauuaccccuccccccccaccugaugaaguguucgauucuagcggcuugucacccgguuuccuuggguacgucgugggccgcuccgauagugugaguacucgccucagcaauugcgauccuccucccacauaugaggaagcuacuggccagguuaaccuucagcguuccgaaaccgaaccacaccuggauccucccccugaauaugaggacauaguaaacucuaacuccgcauccgcaauuccaauggugccagucguaacuacuauaaaauag

SEQ ID NO: 14175 - RNA, 1365 nt, Artificial Sequence
  Description of Artificial Sequence: Synthetic coding sequence
auggcucgccccaacaaguuucuacuuugguucugcuguuuugcuuggcugugcuuucccauaucccucggaucacaagcgucuggcggagaagcucagaucgcugcuucagccgaauuggaaucuggcgcgaugccguggagccuguugcagcacaucgacgaacgcgaccgcgccggccuucugccagcccuuuucaagguucugagcguaggcaggggcggcagucccagacuucaaccggauaguagggcacuccacuacaugaagaaacuguauaaaacauacgccacaaaggaaggaauccccaagucuaaccgaagccaccucuauaauaccgugcgacuguuuaccccuuguacucgucacaaacaggcgcccggcgaucaaguuaccggcauccuucccucgguggagcugcuuuucaaucuagauaggauaacuacagucgaacacuuguuaaagagcguuuugcucuacaacaucaacaauuccgucucuuuuaguucagcggucaaaugugugugcaaucugaugaucaaagagccuaaauccucaucacguacacuuggacgggccccuuacagcuuuaccuuuaauucucaauuugaauuugggaaaaaacacaaauggauucagauugaugugacuucccugcugcagccccucguugccucaaacaaaagauccauacauaugaguaucaauuucaccugcaugaaagaccagcucgaacaucccucugcucagaacggccuauucaacaugacccucguaucuccaucgcugauacucuaccugaacgacacuucugcacaggccuaucacagcugguauagccugcauuauaagagaaggcccucucaaggacccgaccaagaacgcucccuuagugccuaucccgugggcgaagaggcugcagaagaugggcggagcagccaccaccgccauagaagaggacaagaaaccgucagcagcgagcugaaaaagccacugggucccgccucguuuaaucucagcgaauauuuccgccaguuucuccugccacaaaaugaaugugaacuacacgauuuccgccuguccuucagucagcuaaagugggacaacuggaucguggcuccacaucgguauaauccuagguacugcaagggcgacuguccaagagcuguuggucauagauacgguuccccaguucacaccaugguccaaaauaucauuuacgaaaaacuggauuccagcguuccccgcccaaguugcgucccugccaaauauaguccacuguccgugcucaccauugaaccugacgguuccaucgccuacaaagaauaugaagacaugauagccacaaaaugcacgugccgguag

SEQ ID NO: 14176 - RNA, 417 nt, Artificial Sequence
  Description of Artificial Sequence: Synthetic coding sequence
augaccuggcggcaagcaguucuauugaguuguuuuagcgccguuguguuauuaagcauguugagggagggcacuucagucucggugggaacuaugcaaauggcgggggaggaggccucagaggacgcuaagcagaaaaucuuuaugcaggaauccgaugcuucuaauuuucuuaagagacggggaaagcgguccccuaagaguagagaugaggugaauguugaaaaccgccagaagcuccgcgucgacgaauuacgaagagaauauuaugaagaacagaggaaugaauuugaaaacuuuguugaggaacagaaugaugagcaggaagagaggucgagggaagcgguagaacaguggcgucaauggcauuacgauggucuucacccaagcuaccuuuacaacagacaucacacauag

SEQ ID NO: 14177 - RNA, 729 nt, Artificial Sequence
  Description of Artificial Sequence: Synthetic coding sequence
auggcccuuaagaauaaauuuuccugccuauggauccuggggcucugucugguugcaacaacaucuaguaagaucccgaguauuacagacccccacuuuaucgacaauuguauugaggcacauaacgaauggagaggcaaaguuaacccccccgcugccgacaugaaguauaugaucugggacaaaggccucgcaaaaauggcuaaggcaugggcuaaucaguguaaguuugagcacaacgauugucuggauaaaucuuauaagugcuaugccgcuuuugaguaugucggugagaauaucuggcugggggggaucaaaaguuucacaccaagacacgccaucaccgcaugguacaaugaaacacaguuuuacgauuuugacagccugagcuguagccgagugugcggacauuacacacaguuagugugggccaacaguuuuuacgucgggugugcuguugcaauguguccaaaucugggcggcgcuagcacggcuaucuuuguuuguaacuacgggcccgccgggaauuuugccaauaugccgccuuaugucagaggggaaucuugcucuuuaugcagcaaggaagagaaaugcguuaaaaaccugugucgaacaccacaacucauuauccccaaccagaaccccuuccuuaaaccuaccggccgggccccccaacaaacagccuuuaauccauucagccugggcuuccuguuacugcgcauuuucuag

SEQ ID NO: 14178 - RNA, 813 nt, Artificial Sequence
  Description of Artificial Sequence: Synthetic coding sequence
auguuaaggcagcuccucuuagccgcucucugucucgccgggccuccugcuccugcucgagcuugucaacugcccucagaguggcgcccccugagcgagggaugccgcgcugagcuugccgaaaccauuguguacgcacguguucucgcgcugcaccccgaggcucccggccuguacaaccacuuacccuggcaguaccaugccggucaaggcggauuguuuuacucugccgaagucgaaaugcuaugugaucaggcuugggguucaaugcucgaaguuccugcuggguccagacugaaucugacaggacugggauacuuuucuugccacucccauacuguugugcaagacuauaguuauuuuuucuuuuugcguauggacgaaaacuacaaucuacugccucauggggugaauuuucaggaugccauuuuucccgauacucaggagaauagacggauguucaguagccuauuucaauucaguaauugcagccaaggacaacagcucgcaacauucagcucugauugggagauccaggaggacagccggcugaugugcucauccgugcaaaaggcacuguucgaggaggaggaucacguaaagaagcuacaacaaaaagucgcuacauuggagaagcggaauaggcaguuacgugaacgggucaaaaaagugaagcggagucuacgacaggcccggaaaaaggggagacaccuugaguuggcuaaucaaaaacugucagaaaagcuugccgcaggcgccuugccccacaucaaugcucggggucccguccguccaccauaucuuagagguuag

SEQ ID NO: 14179 - RNA, 438 nt, Artificial Sequence
  Description of Artificial Sequence: Synthetic coding sequence
auggacgaaaacuacaauuuacugccucacggcgucaacuuucaagacgcuaucuuccccgauacacaggagaaccgucggauguuuaguagucuauuccaauucaguaacuguucccaaggucagcagcucgcaacuuucagcuccgacugggaaauucaggaagacucucggcucauguguuccuccguacagaaggcccuuuucgaggaggaagaccacguuaaaaagcugcagcagaagguugcuacacucgaaaaaaggaacagacaguuaagagaaaggguuaaaaagguuaaaagaaguuuaagacaggcacggaaaaagggaagacaucuggaacuggcuaaucagaaacuuuccgagaagcuggccgcaggcgccuugccccauaucaacgcuagaggucccgugagaccaccauacuugagaggauag

SEQ ID NO: 14180 - RNA, 1830 nt, Artificial Sequence
  Description of Artificial Sequence: Synthetic coding sequence
auggaguugggaugcuggacacaauuagggcuuacuuucuugcagcuuuuacuuauauccagccugcccagagaguacacagugaucaacgaagcaugcccaggggcggaguggaacaucaugugcagagaaugcugcgaauacgaccagaucgaaugcguauguccgggaaaacgcgaggucgugggguauacaaucccuuguugucguaacgaggagaacgaaugcgauucuugucugauacacccuggcuguacaauuuucgagaacuguaagaguugucguaaugggucuuggggcgggacauuagacgauuuuuauguaaagggauuuuauugcgcagagugcagagcaggaugguauggaggugauuguaugccauguucuuccagcccuuguuuccaugacgguacaugcguguuagauaaagccggcucauauaagugugcuugccuggcagguuauaccggacagaggugugaaaaccuucuggaggagagaaauuguagcgaccccgggggccccgucaaugguuaccagaaaaucacggggggaccgggcuuaaucaacggcaggcacgccaagauugguaccgugguaaguuucuucugcaacaacuccuacguuuuguccgguaaugagaagcgcaccugccagcagaauggggaaugguccggcaaacaaccgaucuguauuaaagcaugcagggagccaaaaauuucagaccuggucaggcgcagagugcuuccuaugcagguccaguccagagaaacuccauugcaccaguuguacucagccgcguuuuccaagcagaagcuccagagugcaccuaccaagaagccagccuugccuuuuggggaucugccaaugggauaucaacacuuacauacacagcuccaguacgaauguauuaguccauucuacaggaggcucggaagcuccaggcguacaugccugagaacaggaaaaugguccggucgcgccccuagcugcaucccuaucugugguaagauugagaauaucacugcccccaaaacucagggacuaagauggccguggcaggccgccaucuacagaaggaccucuggagugcaugacgguucuuuacacaaaggugcaugguuucugguuugcagcggagcauugguaaaugagcgaacugucguaguggcugcucauugcgugacggaccuuggcaaagucacuaugauuaagaccgccgaucuuaaaguuguacucgggaaguucuaucgcgaugaugaucgagaugaaaagacaauacaaucccuccaaaucagcgccaucaucuuacacccuaauuacgaucccauccugcuugaugccgacauugcuauccugaaacugcuggauaaggcaagaaucucaacucgcguucagcccauuugccuggccgccucuagagaccucucgacaucuuuucaagagagccacaucaccgucgcaggguggaacgugcuggcugacguacggaguccaggauuuaaaaacgauacgcuucggagcgguguugugaguguaguugacagccuuuugugugaagagcagcaugaggaccauggaauccccguuucugucaccgauaacauguucugugcuucuugggagcccacugcuccuucugauaucuguacagccgagacugguggcauagcagcagugaguuucccaggccgggccuccccagaacccagauggcauuuaaugggucuggugucuuggucauacgacaaaacuugcucccacagacuaagcacugcguuuaccaaagugcuuccauucaaggauuggauugagcgcaacaugaaauag

SEQ ID NO: 14181 - RNA, 2163 nt, Artificial Sequence
  Description of Artificial Sequence: Synthetic coding sequence
auggaacuggguuguuggacccagcuuggccucacuuuuuugcagcuucucuuaauuagcucccugccuagagaauauacgguuaucaaugaagcauguccgggagccgaguggaauaucaugugcagagaaugcugugaguacgaccaaauugagugcguaugcccagggaagcgggaggugguaggguacaccauuccauguuguaggaacgaagagaacgagugugauucuugccugauucauccaggaugcacaaucuucgaaaacugcaaaaguugccgaaacggaucauggggaggaacucuagacgacuuuuaugugaaaggauucuacugcgccgagugucgugcgggcugguaugggggcgacuguaugcgaugcggccaaguguugagagcaccuaagggucagauacuacuggagagcuauccgcuuaaugcacauugugaguggacuauccaugcaaaaccaggauuugugauucagcuccgcuucguaaugcugucauuggaguuugauuauaugugucaguaugacuauguugaaguaagggauggggauaaucgggacggucagaucauuaagaggguaugugguaacgaaagacccgccccaauucaguccauagggucaucgcugcacgugcucuuccauucugacgggucuaagaacuucgauggguuucaugccaucuacgaagagauuaccgccugcagcucuucucccuguuuccacgaugggacaugugugcucgacaaagccggaucauauaaaugcgcuugcuuagcugguuacaccggacagcguugugagaauuugcucgaagaaagaaauugcuccgauccaggggggccagucaauggcuaccagaagauuaccggugggccuggccucauuaacggaagacacgcuaagauugguacgguaguuuccuucuucugcaauaauuccuacguccuguccggaaacgagaagcgcacaugccagcagaacggggagugguccggaaaacagccaauauguaucaaggcaugccgagagccaaaaauaucugaucuugugaggagacgaguacugcccaugcaaguccagucucgcgaaaccccauugcaccagcuguauucugcugccuuuaguaaacaaaaacuucagagcgcacccacaaaaaagccugcccuccccuuuggugauuugcccaugggcuaucaacaccugcauacacaguugcaauaugaaugcaucagcccuuucuauaggcgauuaggaucauccagacgcacaugccuaagaacuggaaaauggagcggucgugcuccaucaugcauucccaucuguggcaagauugaaaacaucaccgcgcccaaaacccagggucugagauggcccuggcaagcagccaucuaccgaaggacaucuggcguacaugauggaucucuucacaagggcgcuugguuucucguguguucuggggcucucguuaaugaacgcacaguggucguugccgcgcauugcgugaccgaucuuggcaaagugacaaugaucaagaccgccgaccucaaaguggugcuagguaaguuuuacagagacgaugacagagacgagaagacgauucaaagccuacaaaucucugcgauuauccuccaccccaauuacgacccaauauuacuagaugccgauauagcuauccugaaacuguuagacaaggcaagaauaucaacaagagugcagccuaucugccucgcugcaucaagagauuugucuacuucuuuucaagagucacauaucaccgucgcgggcuggaaugugcuagccgacgugaggagcccagguuuuaagaaugacacacuaaggucaggcguuguguccgucguggacucccuccugugcgaggaacagcacgaagaucacggcauaccugucagcguaacagauaacauguucugcgcuucuugggagccuaccgccccaucagacauauguacagccgagacaggugggauugcugccguaucauuccccggacgagcaucaccggaacccagauggcaucugauggguuugguaucuuggagcuacgacaaaaccuguagccaccgacugucuacugcauucacaaaagugcugccuuuuaaagauuggaucgaacguaauaugaaauag

SEQ ID NO: 14182 - RNA, 1134 nt, Artificial Sequence
  Description of Artificial Sequence: Synthetic coding sequence
auggaagccuuacugcugggugcugggcuacuucuaggagccuacguguugguauauuauaaccucgugaaagcaccacccuguggggguaugggaaaccucagaggaaggacagcagucguuacuggcgccaacagcggaauugguaaaaugaccgcacuggagcucgcuaggcgcggggcucgcguagugcuggccugcaggucucaggagcggggagaagcagccgccuucgauuuacgccaggaaagugggaacaaugaagucauauuuauggcacuggauuuggccucguuggcuucugugcgcgccuucgcuacugcuuucuugaguucugagccacgccuggacauucuuauucacaaugcuggcauuucuucguguggccggacgagggaagcuuuuaauuuguuacugcgggugaaccauaucggcccauucuuacucacacaucuguugcucccaugucugaaagcuugugccccaucuagaguugucgugguggcuucugccgcacauugccggggacgccucgacuuuaagcgccuggaucgucccgucgucgguuggcgucaggagcugagggccuaugccgauacaaagcuugccaacguacuauuugcuagagagcuugccaaccaacuugaggcuacgggcgucaccugcuaugccgcacacccaggccccguuaauucagaacuguucuugcgacauguuccaggguggcuuagaccccuucugcggccuuuagccuggcucgugcuucgggcaccucgggguggugcucagacgccauuauacugugcuuugcaggagggaaucgaaccacuuucaggucgcuacuuugccaauugucacguggaggaagugcccccggcagcccgggaugauagggccgcucacagauuaugggaagcgucaaaacgccucgccggccucggcccaggagaggaugcagaaccagaugaggauccacagucugaggauucugaagcuccauccucacucaguaccccacauccugaagagcccaccgugucucagcccuacccaaguccacagagcagucccgaccugagcaaaaugacccauagaauccaggcaaagguugaaccagagauucagcugucauag

SEQ ID NO: 14183 - RNA, 381 nt, Artificial Sequence
  Description of Artificial Sequence: Synthetic coding sequence
augaucuccuuccacgugaucuuucugucacuuggucgggguaaacuauucuuaccugucaauuucugcuuucuuaaacuuaaaaacucccaaguuaggaucccgaaagacuuuacauguaauuugcacguucucuuccguacagugcagggugaggaucgaaacaccauguucagggggcacuggagcauuuacaguagaaacuucccgcucgcuguuguccccgccuacgugacugaagacggcaagaauacuagucauagagcuuccggccaguucugcaaugcucuuucucaaggcgaaauaccuuccucccugcaauuggugaauagcuaugcccucgaaccccggacugacaugccuuguaacuuucugacauag

SEQ ID NO: 14184 - RNA, 876 nt, Artificial Sequence
  Description of Artificial Sequence: Synthetic coding sequence
auggcagugacauuaagucuuuuguuggggggcagaguuugugcugcugugacacgcugcgguuucgcuacccgaggaguggccggucccggccccaucggcagagagccggacccugacucugacugggaaccugaagagcgcgaauuacaggaaguggaguccacacuaaaacgacagaagcaggccaucagauuccaaaagauucgccggcagauggaggcacccggcgcucccccacggacccugacaugggaggcaauggagcagauccgguaccugcacgaagaauucccugaauccuggucggugccacggcuggcagaaggauuugauguuucuacugacgucaucaggaggguacugaaaucuaaguuucucccuacucuggagcagaaacugaagcaagaccaaaaggugcuaaagaaggccggauuggcucauucacugcagcauuuaaggggauccggaaauacgaguaaguuguuacccgccggacauagcgugucaggaagucuucugaugcccggccaugaggcaucuucaaaagacccgaaccauaguacagcacugaaaguaauugaguccgauacccacagaacgaauaccccaaggagaagaaaaggaaggaauaaagagauccaggacuuggaggaauccuucguaccggucgcagccccccugggacacccgcgagaacuccagaaguacaguucugauagcgaaucaccacguggcaccggguccggcgcucuacccucgggccagaaacuggaagagcugaaagcggaggaaccugauaacuuuagcuccaaagugguucaacgggggagagaauucuucgauaguaaugguaacuuucuguacagaaucuag

SEQ ID NO: 14185 - RNA, 2541 nt, Artificial Sequence
  Description of Artificial Sequence: Synthetic coding sequence
auguuuaaguguuggucuguuguacugguuuugggcuuuaucuuucuggaaagcgagggcaggccuacaaaggagggcgguuacggacuaaagagcuaccaaccccugaugcgacuuaggcauaaagagaagaaccaggagucgagucggguaaaaggcuucaugauucaagauggucccuuuggcuccugugaaaauaaauauugugggcucgguaggcacugcgucacaagccgcgagacugggcaagccgaaugugcauguauggaucuguguaaaaggcauuauaagccugucugcggcagcgacggcgaguuuuaugagaaucauugcgagguucaccgcgccgccugccucaagaaacagaaaauuacaaucguucauaaugaagacugcuuuuuuaaaggagauaaauguaagaccacugaauacucuaaaaugaagaacaugcuuuuagauuugcagaaccagaaauauaucaugcaggagaacgagaaccccaauggagaugauauuucacggaagaaguugcugguggaccagauguuuaaauacuucgaugcagauuccaauggccucgucgacaucaacgaacugacgcaggugaucaagcaggaggagcuggguaaagaccuuuuugauugcacucuguaugugcuccuuaaauaugaugauuuuaaugccgacaagcaucuagcucucgaggaauuuuaccgggcuuuucagguuauacagcuuucucugccagaagaucagaaacugucaauuacugcagcuacugucggacagagcgcuguucugucuugcgcuauacaaggaacucuaagaccuccuaucaucuggaaacguaauaauauaauuuugaauaaucucgaccuugaagauauuaacgacuuuggagaugacggaucccuauacauuacuaaggucacaacaacacauguugguaauuauaccugcuaugcagauggguaugagcagguuuaucagacucacauuuuucaagucaaugucccuccagugauccgcguguauccagaaucacaggccagagaaccaggagucaccgccucucuaagaugucacgccgaggguauaccaaaaccccaguuaggguggcuaaagaaugguauagacauuacaccaaaacuaaguaaacagcucacccugcaagcuaacggaucugaggugcacauuucgaacgugcgguacgaagauaccggggccuauacauguauugcgaagaacgaagcagguguugacgaagauaucaguagccuguucguggaggauuccgcccggaagacacuggccaacauuuuauggagagaggaaggacuagggauagggaauauguuuuacguuuuuuacgaagacggcauuaaggugauccagccuaucgaaugcgaauuucagcgacacaucaaacccucagagaaacugcugggguuucaggacgagguuugucccaaggcugaaggagaugaagugcagagaugcgucugggcgagcgccguuaaugucaaggacaaauucauuuauguggcccaacccacucuggaccgcguacugaucguugauguccagucucaaaaagugguucaagcagugucuacagaccccgugccagugaaauugcauuacgauaagucacaugaucagguuuggguucugucuuggggcacccuggaaaaaacaucaccaacucugcagguaauuacacucgccuccggaaacguuccccaccauaccauccacacccagccuguggguaaacaauucgaccggguugaugacuuuuuuaucccuacaacuacccugauaaucacccacaugcgguucggguucauacuccacaaagacgaagcagcucuacaaaaaauagaucuagagaccauguccuauaucaagacgaucaaccugaaggauuacaaauguguuccccaauccuuagccuauacacaucuaggaggcuacuacuucaucgguuguaaaccugacucuaccggugcgguguccccacaggucauggucgacggagucacggauucaguuauuggcuucaacagcgaugucaccgguaccccuuacguuagcccagacgggcacuacuuaguaucaaucaacgaugucaaagguuuggugagaguccaguacaucacuaucaggggcgagauccaagaggcauucgacaucuauaccaaccuacacaucucugaccuggcuuuccaacccucauucacagaggcucaucaauacaacauauauggcuccucuagcacucagacugaugucuuguuuguugaacucucaagcgguaagguuaaaaugaucaaaucucugaaggaaccccugaaagcggaggaauggccauggaaccgcaaaaaucgccaaauucaagauuccggacucuuugggcaguaucucaugacaccuagcaaagacagucucuucauuuuggauggacggcucaauaagcugaacugcgagauuacagaaguagagaaggggaacacaguuauuuggguuggugaugcuuag

SEQ ID NO: 14186 - RNA, 291 nt, Artificial Sequence; identical to SEQ ID NO: 12547
  Description of Artificial Sequence: Synthetic coding sequence

SEQ ID NO: 14187 - RNA, 1971 nt, Artificial Sequence
  Description of Artificial Sequence: Synthetic coding sequence
augcguacaguaguucuaaccaugaaagcaaguguuauugaaauguuccuagugcugcuggugacaggcguucauagcaacaaagaaaccgcaaagaagauuaaaagaccaaaguucaccgugccucaaaucaacugcgacguaaaggccgggaagaucaucgacccggaauucauuguaaagugcccagcaggaugccaggauccuaaguaucauguauacgggaccgacguuuacgccaguuacagcucaguguguggcgcggccgugcacucaggagucuuagacaauaguggaggaaagaucuuaguccggaaagucgccggccagucuggcuauaaggguucauauucaaauggaguccagagucugucacucccgcgcuggagggagagcuuuauuguucuugaguccaaacccaaaaagggcguaacuuauccaucugcccucacguauuccucgaguaaguccccugcagcccaagcuggugaaaccacaaaggccuaccaaagaccuccaauucccggaacaaccgcucaacccguuacacugaugcagcuccuugccgucaccguugccguggcaacuccuacuacucucccuaggcccuccccauccgcagcaagcacgaccuccauaccgagaccccaguccguugggcauagaucucaagagauggaccuguggucgacggcuacauauaccucuucccagaacaggccccgcgcagacccuggacucguccccaaagaagaacucagcacucaaucauuggagccagugucucugggggacccaaauuguaagaucgaccuaucauucuuaaucgacgguaguaccuccaucgguaagcggcgcuucagaauccagaaacagcuacucgcugacgucgcacaagcccuggacaucgggccggccggaccacuaauggggguggugcaauacggggauaauccugccacucacuuuaaccuuaagacacacaccaauucuagagauuugaagacugcgaucgaaaagauuacucaacggggcggacuuaguaauguggggagagcuauuaguuuugugacaaagaacuucuuuucaaaggccaacggcaaccgaucuggcgcuccgaauguaguagucgugaugguugacggguggccaaccgacaagguugaggaggcuucuagauuggcacgggaaagcgguauuaacaucuucuucaucacuaucgagggcgcagcagagaaugaaaagcaguauguuguagaaccaaauuuugcaaauaaggccgugugucgaacaaacggguucuacucucuccacguccaauccugguucggucuccacaaaacucugcagccacuuguuaagcguguaugcgauaccgaucgacuugccuguagcaagaccugccugaacucugccgauaucggguuuguuauugauggguccuccuccguggguacugggaauuucaggacuguucuacaguuugucacuaaccucacuaaggaauuugaaauuagcgacacagacacaagaaucggcgccgugcaguauacuuaugagcagcgauuggaauucggauuugauaaauauagcucaaaaccugauaucuugaaugcuaucaaacggguuggguacugguccggcgguacaucuacuggcgcggcaaucaauuucgccuuagaacaguuauuuaagaagucuaagccuaauaagagaaaauugaugauucugauuacagauggccggagcuacgaugacgugcgcaucccagccauggcagcgcaccugaagggggugaucaccuacgccauuggaguggccugggcagcccaagaagaacuggaaguuauugcgacucauccagcccgggaucauaguuuuuucguugaugaauuugacaauuugcaucaguacgugccccgcauuauccagaacaucugcaccgaauuuaauagucagccacgcaauuag

SEQ ID NO: 14188 - RNA, 2082 nt, Artificial Sequence
  Description of Artificial Sequence: Synthetic coding sequence
augcgcaccguggucuugacuaugaaagccucugugauagaaauguuucugguuuugcuggugacuggaguccauuccaacaaagagacagcuaagaagauuaagcgccccaaauuuaccguaccccagauaaauugugaugucaaagccgguaaaauuaucgauccugaauuuaucguuaagugcccagcugguugucaggaucccaaguaucauguguauggaaccgauguauaugcaaguuacucuucugugugcggggccgcugugcacucaggcguauuagauaacagcggagggaaaauccucguaagaaaggucgcuggacaaagcggguauaaaggauccuacuccaacggagugcaaucucugucucuaccgagauggagagaaagcuuuaucguucuugagucuaaaccuaaaaagggaguuacguacccaucugcccucacauacucauccagcaaguccccagcugcacaggccggcgaaacuacaaaggcauaccaaaggcccccuauccccggaaccacugcccagccaguaaccuuaaugcagcugcuagcugucacgguugccgucgccacaccaacaacccugccacgucccucaccguccgccgcgucaacgaccagcauuccccggccccagucugugggucaccggagucaagagauggaccuuuggagcacagcuaccuauaccagcucacagaaucgcccuagagccgauccaggcauacaaagacaagauccgagcggugccgcauuccaaaaacccguuggagcagaugugucauuaggugaaauggacucuuggaagccuggaagcgugcuguuggacgaaggccuugucccuaaggaggaacucagcacacagucucucgagccuguuucccuaggagaucccaacugcaaaauugacuuauccuuucugaucgacggguccacaagcaucggcaagcggagauucagaauccagaaacaauugcuggcagaugucgcacaggcccuggauauuggaccagcagggccuuugaugggugugguacaauacggagauaauccagcaacucauuucaaccugaagacucauacaaacucacgagaccucaaaaccgcuauugagaagauaacccagagaggggggcuaucuaaugugggcagagcaauuucuuuuguaaccaaaaauuucuuuucuaaagccaauggaaauagaucgggagcuccaaacgucgucguaguaaugguggacggcuggccaacagauaaaguugaagaggcuucacguuuagcacgggaaagcgggauuaauauauuuuucauuacaauugaaggagccgccgagaacgagaaacaguaugugguugaacccaauuucgcaaauaaagcagugugucgcaccaauggauuuuacucccuacacguccagucaugguucggccugcacaagacgcugcagccccuggugaagagagucugugauacggaucgucuagcaugcaguaagaccugucugaacuccgcugacaucggguuugucauagauggcucuuccuccgugggaaccggcaauuuuagaacaguuuuacaauucgucacuaaccucaccaaagaauuugaaauuuccgacacagauaccaggauuggggcaguucaguacacuuacgagcagcggcucgaauucgguuucgauaaguacaguucuaagccugacauacuuaaugcgaucaaaagaguuggguauuggucaggaggcaccagcaccggagccgcuaucaacuucgcacucgaacagcuguucaagaaaaguaaaccuaacaagcguaaacuuaugauucucaucacugacggacggucuuacgacgaugugcguauaccugccauggcugcucaccuuaagggcgugaucacauaugcaaucgguguggcuugggcagcccaagaggaacucgaaguuauugcaacacacccagcccgagaucacucuuucuucguagaugaauucgauaacuuacaucaguauguaccuagaaucauccagaauaucuguaccgaauuuaauucucagccaaggaauuag

SEQ ID NO: 14189 - RNA, 555 nt, Artificial Sequence
  Description of Artificial Sequence: Synthetic coding sequence
auguucugucuguugcaucuguguuucuaucuugcgaauuucgccagcagcaucaaaagaacccaugcaguaaacggaugcuguggauugcagaugaucgcccugugggcacaauccuccgguaacgccgaugcucgaguggaggagauacuugcaggagaagagagacgucuggccgcacuccucggaucucagggcaugcgguuuugggugugccuagcagcuugucgggccaugugggggcuugcagcgaggaggggaagagcagaagauaguaguaguuccccaguggaugccuccaaguuccccuggagaggcggucagcauagaaccacaaugaugccaugucuguugagaguuggaguuuuucgaccuugucacguccgcccuacuggggacccuuccugugaugugcagccaccucgacuggguuuuagcagggugccugauacgcaggucgcuuuuuaugguaguggucacugggauccaacucccuuuagugugcacucuuguuucuuuaauuuccaaguuagaaaaauuauuuuucugcuguag

SEQ ID NO: 14190 - RNA, 864 nt, Artificial Sequence
  Description of Artificial Sequence: Synthetic coding sequence
augacaucagcugcccacuauuauccuaaacucaugucaauaaugggcaacguuuugagauucuuaccugcuuuuguccgaaugaaacaacugaucgaggagggguaugucggugagccucucgugugcgaggugcaaguccauggggguucccuccucggaaaaaaauauaauuggagcugcgaugaccugaugggcggcggcgggcuccacuccgucgggaccuacauuauugaucuccucacuuuuuuaacuggccagaaagcugucaaagugcacggacucuugaaaaccuuuguaaagcaaacggaccacaucaagggaauucggcagaucacaucagacgacuucugcaccuuucaaaugguucuagaaggcggaguuuguuguacagugacacugaacuucaauguacccggugaauucaagcaagaugugaccgucguuggaucggcagguaggcuacuugcggugggcacagaccuguauggccagaggaauucagcgcccgagcaagaacuccugguccaagacgcgacccccguauccaauucucuguuacccgaaaaagcuuucucggacauaccuagcccuuaucugcggggaacuaucaagaugaugcaggcaguucggcaggccuuucaggaucaggacgacagacguaccugggacggccgcccccucaccauggcagcuacauucgacgacugucuuuacgcgcuaugcguagucgacacuauuaaaagaaguucacaaacaggagaauggcagaacaucgcuaucaugaccgaagaaccugaguuaagucccgccuaccugauaagcgaggcaaugcguaggucucggaugucgcucuauuguuag

SEQ ID NO: 14191 - RNA, 1173 nt, Artificial Sequence
  Description of Artificial Sequence: Synthetic coding sequence
augcuacccggaguggguguguuuggaaccucacugacugcuagaguaauuauuccccuccugaaagaugagggauucgccguaaaagcuuuaugggguagaacacaggaggaagccgaggagcuggcuaaagaaaugagcgucccuuuuuacacaagcagaaucgacgaggucuuacugcaccaagacguugauuugguguguaucaauuugccaccuccccucacacggcagauagcggugaagacguuaggcaucgggaaaaaugugaucugcgaccguacagcgacuccuuuggacgcauuuaggaugacgagcgcugcacauuauuauccaaagcugaugucaaucauggguaacguccucagauuucuacccgcguucguuaggaugaaacagcugauagaagaggguuacgucggagagccucuggucugcgaagugcagguucacggaggaucucugcugggaaagaaauauaacuggaguugcgacgacuuaaugggaggcggaggccugcacucuguggguacauacauaaucgauuugcugacuuucuugacggggcagaaggcgguaaaaguucacgggcuacuaaagacauucguaaaacagaccgaucacauuaaagggauuaggcagauaaccagcgaugacuuuugcacuuuccagauggugcuggagggcggaguauguuguaccgugacacugaacuucaaugucccaggcgaauuuaagcaagacgugaccguugugggcagcgccggccgacuccucgcuguagguaccgaccuguaugggcagcgaaacucagcccccgaacaagaacuacuuguccaggaugcuaccccaguuucaaauucuuuguuaccugagaaggcauuuagcgauaucccaucacccuacuuacgcggcacaaucaaaaugaugcaggccguccgccaagccuuccaggaccaggaugaucgccgaacuugggauggacgaccucugacuauggcagccacauuugaugacugccuuuacgcgcugugcgugguggauacuauaaaacgaucgucucagaccggggaauggcaaaauauugcuauuaugaccgaggagccagaacugucaccugccuaucucaucagugaagcuaugcggagaucucggaugagucuuuauugcuag

SEQ ID NO: 14192 - RNA, 5718 nt, Artificial Sequence
  Description of Artificial Sequence: Synthetic coding sequence
augcagucgagauuacuccuguugggugcacccggagggcauggcggucccgccuccaggagaaugcggcuacuuuuaagacaggugguccagcgccgcccaggaggggacagacagcggcccgagguuagacuucugcacgccggaucaggggccgacaccggugauacggucaauauaggcgauguuagcuauaagcuaaaaauuccaaagaaucccgaacucgugccucagaacuacaucagcgauucucuagcccaaucaguugugcagcaccuucgguggaucaugcaaaaggaucugcugggccaagaugucuuccuuauuggaccaccuggcccccugagacguagcauugcuaugcaauaccuggagcucacuaagcgggaaguugaauacaucgcucucaguagagacaccacggagacugaccugaagcagaggagggaaauucgcgccgguacagcuuuuuacauagaccagugugccgugagagccgcuaccgaaggaagaacucugauccuugaaggacuagaaaaggccgaacgcaauguguuaccugugcugaacaauuuacucgagaaccgcgaaaugcaguuagaggacggccguuuucugaugagcgccgagcguuacgacaaguuacugagagaucacaccaagaaagagcucgauagcuggaaaauuguucgugucuccgaaaauuuuagagugaucgcccuuggucugcccguuccucgcuacucugguaacccgcuggauccaccacuuagaucuagauuccaggcacgggacaucuacuaccuuccuuuuaaagaucaacugaagcugcucuauucgaucggugcuaacguauccgcagagaaagugucucaauuauugagcuucgcgacuacuuuguguucacaggaaucgagcacacugggucuccccgacuuucccuuggauucccuggcugcugcaguccaaaucuuagacagcuuuccaaugaugccaaucaaacacgcaauucaguggcucuacccuuauuccauacugcugggccaugaagguaagauggccgucgaggguguucugaagagguuugagcuccaggauagcggaucuuccuugcucccaaaagaaaucguaaaaguagaaaagaugauggagaaucacguuucgcaagccucugucacuauuaggauugccgacaaggaggugaccaucaaaguccccgcuggcaccaggcuucucagucaaccaugcgcgagcgaccgauucauucagacucugagucauaagcaacugcaagccgaaaugaugcaaucccauaugguuaaagauauuugccuaaucggaggaaaaggcugcgggaagacaguuaucgccaagaauuucgcugacacccucggcuauaauauagagccaaucaugcuuuaccaggauaugaccgcaagagaucugcugcagcaacgguacacccucccaaacggcgauaccgcguggcgcagcuccccguuaguaaacgccgcccucgagggcaagcuggugcuucuugacgggauucaccgaguuaaugcaggaacucuugcugucuugcaaagacucauacacgaccgggaguugagccuguacgacggcucacggcugcuuagagaagacagauacaugcguuugaaagaggaauuacaacugucagacgagcagcugcaaaagcgaagcauuuucccuauucauccuucuuucagaauaauugcacuugcagaaccccccgugauagguagcaccgcucaucagugguugggccccgaauuccugaccauguucuucuuccacuauaugaaaccacucgugaaaucagaggaaauccaggugauuaaagaaaaggugccgaacguuccccaagaagcccucgauaagcuauuguccuucacccauaaacuuagagagacacaggacccaacggcccagucacucgcugccuccuugaguacccgacaacugcugcgcauuagccggagacugucacaauaccccaaugagaaccuucauagugcagugaccaaagcuugccugagcagguuccugcccucauuagccagaucugcacuugagaaaaaucuggccgacgcuaccauugagaucaacaccgaugacaaucuagaaccggaacucaaggacuacaaaugcgaggugacgucugguacucucaggaucggcgccgugucugccccuaucuacaaugcucacgagaaaaugaaaguaccugauguucuauucuaugacaauauucaacacgucaucguuauggaggacaugcucaaggauuucuugcucggugagcaucuccuuuuagucgggaaucagggcguggguaaaaacaagaucguggaccgcuucuuacacuuacucaacagaccacgugaguauauucagcugcauagagacacaaccgugcaaacacuuacccuucagcccuccgugaaagacggacuaauuguuuaugaagacucaccccucgugaaggcagugaagcuuggacacauucuggucgucgacgaggcagauaaggccccuaccaauguaaccuguauacucaagacuuuaguugagaauggugagaugauccucgccgauggacggcggauaguagccaacagcgccaacguuaacgggagagaaaacgugguggugauucacccugauuuuagaaugaucgugcucgccaauagaccuggguucccuuuccugggcaaugauuuuuuugggacccuaggcgauaucuuuuccugccaugcggucgauaauccuaagccacacuccgaauuagaaaugcuccggcaguacggaccgaacgugccugagccuauccuucaaaaguugguugcagcguuuggugaacugagaagccuggcugaucagggcauuaucaacuaucccuauagcacucgcgagguugucaauauagugaaacaccuccaaaaguucccgacugagggccuuuccucuguugugcgcaauguauucgacuucgauuccuacaauaaugauaugcgagaaauucugauuaauacucuucacaaauaugggauuccuauuggcgccaagccaacaagcgugcagcuggccaaggagcugacucuucccgagcaaacuuucauggguuacuggaccaucggacaagcuagaaguggcaugcaaaaauugcuguguccugucgaaacccaucacauugauaucaaaggaccggcccugauuaauauacaagaguacccuauugaacgucacgaggaacgaucgcugaauuucaccgaggaaugugcuagcuggcgaaucccgcucgacgagauuaauauuauuugugauauugccaccucucaugagaacgagcagaacacacuauauguagugacuugcaaucccgccucucuguauuuuaugaacaugacuggcaagaguggauucuucguugauuuuuuugacauauuuccucgaaccgccaauggaguguggcauccuuucguuacaguagcuccacuaggcucaccccuuaaagggcaggucgugcugcacgagcaacagaguaacguaaucuugcuccuugauacuacgggcagagccuugcaccgucucauauuaccuagcgaaaaguuuaccagcaagaagccuuuuugguggaauaaagaagaagccgagacauacaagaugugcaaggaauucucacacaaaaauuggcuaguguucuauaaggaaaaggguaacuccuugacuguuuuggauguguuggagggacgcacucacacuauaagucuuccgauuaaccugaaaaccguguucuugguagccgaagauaaaugguugcucguagaaagcaagacaaaccagaaauaccuguugaccaaacccgcccacaucgaauccgagggaaguggugugugccagcuguacguccugaaggaggagccccccucgaccggcuuuggaguaacccaggagacggaguuuucaaucccccacaaaauaucuagugaccaguuauccuccgaacaccucagcucugcuguugagcaaaagauugcuagccccaauagaauuuuaucagacgaaaaaaauuacgcaacuauuguaguugguuuccccgacuuaaugagcccaagcgaaguguauucuuggaagcggccaucaagucugcacaagagaagcggaacagacaccuccuuuuaucggggcaaaaaaaagagagguacuccgaaacaguccaauugcgugacccuucucgauacaaaccaaguaguacgaauccugccccccggcgaggugccacuuaaggacauuuacccaaaggacgugaccccaccacagaccagugguuacauagaaguaacugaccuccagagcaagaaguugagauauauaccaauaccccgcagcgaaagccugucuccuuauaccaccuggcugucgacaauuagugauacugaugcgcugcucgcugaaugggauaagagcggaguuguaacaguagacaugggcggucauauacguuugugggagacgggacuggaacguuugcagcggucacugauggaguggagaaacaugauaggccaggaugauagaaacaugcaaaucacaaucaauagggacucaggggaagaugugagcucaccuaaacaugggaaggaggaccccgacaacaugccucaugugggcggcaacaccugggccggaggcacaggagguagagauacagccggacugggugggaaagggggcccuuaucgcuuggaugcuggucauaccgucuaccagguaagucaggcagaaaaggaugcagugccugaagaagugaaaagggccgcuagagaaauggggcagagggcuuuucagcagaggcucaaagaaauucagaugagugaauacgacgcggcaacauacgagagauuuucaggagcaguacggcgccaggugcauagccugcguauuauucucgauaaucugcaagcaaaaggaaaggagagacaguggcuuagacaccaggccacgggggagcuagaugaugccaagaucauugauggauugacaggggagaaggccauauacaagaggcggggcgagcuugagccccagcuaggaagcccacagcaaaaaccuaagagauugaggcuggugguugaugugucaggaaguauguaucgcuuuaacagaauggacggccgguuggaacguacgauggaagccgugugcauggugauggaggccuuugaaaacuaugaagagaaguuccaguaugauauuguaggacauaguggcgacggcuacaauaucggucuggugccuaugaacaagaucccaaaggacaauaagcagagguuagagauucuuaaaacaaugcaugcgcacagccaauuuugcauguccggcgaucauacuuuggaaggaaccgaacacgcuaucaaggagauuguuaaggaggaagccgacgaauacuuuguaauuguccugucugaugcaaaccucucacguuacggaauacacccagcgaaauucgcacagauauuaacuagggacccacagguaaacgccuuugccauuuucaucggcagucucggagaccaggcaacaagguuacagagaacacugccugcagguagaaguuucgucgccauggacacuaaagacauaccacagauauugcaacagauuuucacgaguacaaugcuuucuuccgucuag

SEQ ID NO: 14193 - RNA, 561 nt, Artificial Sequence
  Description of Artificial Sequence: Synthetic coding sequence
auggaggcauuaccccuauuagccgcgacgacuccagaucacggacggcacagaagguugcugcugcugcccuugcuguuguuuuugcuccccgccggcgccguucaggguugggagacagaagagaggccacggacaagggaagaagagugccacuuuuacgcaggaggucaagucuauccgggggaagccaguaggguuaguguggccgaucacucacugcaucugaguaaggcgaagaucucaaaacccgcuccuuacugggaagguacugccguaauagacggcgaauuuaaagaacugaagcuuaccgacuauagggggaaguaccuagucuucuuuuucuauccucuugacuuuacauuugugugcccuacugaaaucauagcuuuuggggaccgucuggaagaauuuagaucuaucaacaccgaaguugucgcauguagcguggacucacaauuuacucaccuagcuuggucagucucuuacaccuacauuagacgcaagaaacggauggaucuucuccugaagcacggccagauuacucuggauaugauauag

SEQ ID NO: 14194 - RNA, 816 nt, Artificial Sequence
  Description of Artificial Sequence: Synthetic coding sequence
auggaagcucuuccucugcucgccgcuaccacaccugaucacgguagacaucgacgacucuuacuguugccauugcuauuauuuuugcugccugccggugccguccaaggcugggaaacagaagaaagaccucggaccagagaggaagagugccauuucuacgcgggcggucaaguguauccaggcgaagcuagcagggucuccguggcagaccauucccuacaccucagcaaagcgaaaaucuccaagcccgcuccuuacugggaaggaacagcagugaucgacggcgaguuuaaagagcugaagcuuacagacuaucgagggaaguacuugguuuuuuucuucuaccccuuagauuuuacauuugugugcccaaccgaaaucauugcuuuuggcgaucgauuggaggaguuccguagcauuaauaccgagguaguugcauguaguguggauucccaguucacucaccuagccuggaucaauacaccucguagacaggggggccucggacccauaagaauuccccuccucagcgaccuaacccaucagauuagcaaggacuacggaguauacuuagaggacucaggccacacacuacgcggacucuuuauuauagaugacaagggcauucugaggcaaaucacauuaaacgaucucccagucggaagaucaguugacgagacucugagguugguacaggcuuuccaguacaccgauaagcauggugaggucuguccggcaggcuggaaaccgggaagcgagacuaucauaccggacccugcaggaaaguuaaaauacuucgacaagcugaauuag

SEQ ID NO: 14195 - RNA, 558 nt, Artificial Sequence
  Description of Artificial Sequence: Synthetic coding sequence
auggaucacagaagccgucugcgcgguaccggccugaaucgaauccccggcacucagagccgugcaccccgaguuccacugccuuuccauguccagcaggaagccagagagggagaagacugggagagggaaccuccaagacagcgcccuccaauauacgagcccccugagagcgaagaauuaccggauaaugugauggugaguaaaccugcccccuacugggaagggacugccgucauugauggggaguuuaaagaacuaaaguugacagacuaccgcgguaaguauuuagucuucuucuuuuauccucucgacuuuaccuuugucuguccgaccgaaaucauagccuuuggagaucguuuagaagaguuuagaucaaucaacacugaaguuguggccugcaguguugacucacaguucacgcaucucgcuuggaucaauacaccaaggcgacagggaggucuuggaccuaucagaaucccccugcugagcgaccuuacccaucagaucaguaaggauuaugggguguacuuagaggacucgggacauacuuuauag

SEQ ID NO: 14196 - RNA, 843 nt, Artificial Sequence
  Description of Artificial Sequence: Synthetic coding sequence
auggcccgcuuuuggguaugcguagcuggugcugguuuuuuucucgccuuucucgugcuccacucccgguuuugcgguucaccuguucugagaaauuucacauuugcggucaguuggcgaaccgagaagauucuuuaccguuuggauguggguuggccaaagcacccagaguacuucacugggacuacauuuugcgucgcagucgacuccuugaacgggcuaguguacauuggacaaaggggugacaauauaccuaaaauccugguuuuuacagaagauggcuacuuucugcgagcuuggaacuacacaguagauaccccucacgguauuuucgcagcuucaacacuguaugagcagaguguguggauuaccgacguggguuccgacuucaugauccuguggcuccacggagagaacggcacaggucccgccaaguuuaacauuccucacagcgugacucuggauuccgccgggagaguguggguagcagauaggggaaauaagagaauucagguuuucgacaaagacaccggagagugguuaggugcauggaacaacuguuucaccgaggagggccccucuagcguccgguuuacaccugacgggaaauaucucaucguggcucaauuaaauuuaucuagguuauccguuguugccgcuccgccuguuggaucuauuggagaguguagcgucaucucuacuauacagcucgcugaccagguccucccccaucuccucgaagucgaucgcaagacaggcgcagucuauguggcugagauuggcgccaaacagguacagaaguacguuccucugaauuccuauguuccguccuucggguccuag

SEQ ID NO: 14197 - RNA, 1044 nt, Artificial Sequence
  Description of Artificial Sequence: Synthetic coding sequence
auggcccguuuuuggguuugugucgcuggugcugguuuuuuucucgccuuucugguuuugcauagcagauucugugguucuccugucuugcgcaauuuuaccuucgccguguccuggcgcacugagaaaauucucuacaggcuagacgucggauggccuaagcaccccgaauacuuuaccggaaccacuuucugcguugcuguggacucacucaacggucugguguauauaggucaacgcggggauaacauuccuaaaauucugguguuuaccgaggacggauacuuccuaagagcuuggaacuauacgguggauacaccgcacggaauauucgcugccuccacauuguaugagcagucuguguggauuaccgauguaggcucugguuucuuugggcauaccgucaagaaguauaguaguuuuggggaucuagugcaggugcugggaacuccgggaaagaagggcacaaguuugaacccacuucaauucgacaacccagcagagcucuauguugaagauacaggggauaucuauauuguugacggagauggcggccugaacaauagacugauuaaacuuucacaggacuuuaugauacugugguugcauggcgaaaacgggacgggaccagccaaguuuaacauaccucacagugugacacuugauuccgccggccguguaugggucgcugaccgggguaauaagaggauccagguguuugauaaagauacaggagaguggcucggugcuuggaacaacuguuucacagaagaaggacccucuagcgugcgguucacaccagacggaaaauauuuaaucguugcgcagcuuaaucucuccagacuuagcgugguggcagcaccuccugucgguagcauuggcgagugcucagugauuaguacaauccaacuggcugaccaagugcucccacaucuccuggagguggauaggaagacaggugcuguguaugucgcggaaaucggggcaaagcaaguucagaaguacguuccacucaauucuuauguucccagcuuuggaucauag

SEQ ID NO: 14198 - RNA, 1707 nt, Artificial Sequence
  Description of Artificial Sequence: Synthetic coding sequence
augguucugcugcacuggugccuccugugguuacuguuuccacucuccucucgaacccagaaacugccaacccgugaugaggaauuauuucagaugcagaucagagacaaggccuuuuuucaugauaguucagucauuccugacggcgcggaaauuaguucauaccucuuuagagacacacccaagagauauuuuuuuguuguggaggaagauaacacuccacugagcgugacaguaacacccugcgaugccccccuggaguggaaacucucucuccaagaacuccccgaggacagaagcggcgaggggucgggcgaccuggaaccucucgaacagcaaaagcagcagauaauuaaugaggaagguacugaacuguuuucuuauaaagggaacgacguggaauauuucaucuccuccagcuccccuagugggcuguaccaauuggaccugcugagcacugaaaaggauacccacuucaaaguauaugcuacaaccacgccugagagcgaccaacccuaccccgaacugcccuaugacccucguguggacgugaccucucuaggacgaacaacugugacacuggcauggaaacccucucccaccgccucccugcugaagcagcccauacaguacugugucgucaucaauaaagaacacaauuucaaaucauuaugugcuguugaagcaaaguugagcgccgaugaugccuuuaugauggcaccaaagcccggacuggauuuuucuccauuugauuucgcccacuucggguucccgagcgacaacuccggcaaagagagguccuuucaagccaagcccagccccaaauuaggccgccacguguacucccguccuaagguagauauucagaagauuuguauuggaaacaaaaauauauucaccgugagugaccuuaagccugacacucaguauuauuucgaugucuucguugucaacauuaauucuaauaugagcaccgccuacguagggacuuucgcacgaacaaaagaagaagcuaaacagaaaacugucgaacuuaaggacggaaaaaucaccgacguguucgugaagcggaaaggggcaaaauucuuaagguucgcaccuguaucaucccaccagaaaguuacuuuuuuuauccauuccugccucgaugcagugcaaauacaaguuagaagggauggaaagcuacugcugagucagaauguggaaggcauacagcaauuccaacugagaggcaaacccaaggccaaauacuuagugagacuaaaggggaauaagaagggcgccucaaugcuuaagauucuggcuaccaccaggccuacaaaacaaaguuucccuucacugcccgaggauaccagaaucaaagcauucgacaagcuccgcacuugcaguucagccacgguugcauggcuuggcacucaggaaagaaacaaguucugcaucuacaaaaaagagguggacgacaauuacaacgaggaucagaaaaagagagaacagaaucagugucucgggccugauauucguaaaaaaagugagaaaguucucugcaaguacuuccauucucaaaaucuucaaaaagcaguuacuacagagaccaucaagggacuucaaccaggcaagucauaucuucuggacguguaugucaucgggcacggggggcacagcgugaaguaucagucaaaggucgugaagacacgcaaguuuugcuag

SEQ ID NO: 14199 - RNA, 489 nt, Artificial Sequence
  Description of Artificial Sequence: Synthetic coding sequence
augaaaggcuuuaccgcaacccuuuuucuauggacucugauuuuucccagcuguaguggcggcggugggggaaaagccuggccaacacacguugucuguucugacucaggucuugagguacuuuaccagucuugcgaccccuuacaggauuucgguuuuucuguggagaaauguuccaaacaacuuaaauccaauauaaauauccguuuugguauuauuuugagagaagauaucaaagagcucuuccucgaucuagcccuaaugucucaaggaucuagcguucucaacuucagcuaucccaucugugaggccgcacugcccaaauuuagcuucugcgggagaagaaagggugagcagauauacuacgccggacccgugaauaaccccgaauuuacaauuccccagggcgaauaucaggugcuccuggaacuauacacugaaaagcguucaacuguagccugugcaaacgccaccauuauguguucuuag

SEQ ID NO: 14200 - RNA, 1698 nt, Artificial Sequence
  Description of Artificial Sequence: Synthetic coding sequence
auggauuucuuguuggcacugguucugguaaguagccuguauuuacaggcagcagcugaguuugacggccgauggccgagacagaucgucucaucuauaggguugugcagauaugggggccguaucgauuguuguugggggugggcaaggcagucauggggucaaugucagccagugugucagccuaggugcaaacacggcgagugcaucgggccuaacaagugcaaaugucacccaggguacgccgguaagacauguaaucaagaccuuaacgaaugcggacugaagccuagaccaugcaagcacagauguaugaacacuuauggcagcuacaaauguuacugccucaacggauauaugcugaugcccgaugguucauguaguagcgccuuaacuuguucgauggccaacugucaguacggaugcgaugucgugaagggucagauucgaugccaauguccaucuccaggccugcaacucgcaccugacggaaggacaugcguagauguugaugaaugugcaaccgggagagccagcugcccucgcuuuaggcagugugugaauaccuucgggagcuauaucuguaaaugccacaagggauuugaccucauguauauaggcggaaaauaucagugccacgacaucgacgagugcagccuggggcaguaccaguguaguuccuuugcaagaugcuauaauauucgggguagcuauaaaugcaaaugcaaagagggauaccagggggauggccugacuugcguauacaucccgaaaguuaugauagaaccuucaggccccauacauguucccaaagguaacgggacaauccugaaaggagauaccggcaauaacaauuggauuccugacgugggcaguacgugguggccuccaaaaacucccuacauuccuccaauuaucaccaaucgaccuaccagcaaaccaacaaccagacccaccccuaagcccacucccauacccacaccacccccacccccuccacuccccacagaacuuagaacaccuuugcccccuaccacuccggaaagacccaccaccggacugacaaccaucgccccagccgcauccacuccaccaggggggaucacaguagauaaccgcgugcaaaccgacccucagaaaccucgcggggaugucuucauaccuagacagccuagcaacgacuuguuugaaauuuuugagaucgagagggguguuagugcagacgacgaggcaaaagaugaccccgggguauugguccauucuugcaacuuugaccacggcuugugcggguggauccgcgaaaaggacaaugacuuacacugggaaccaauccgggaccccgcaggaggccaauaucugacaguuucagcagcaaaagcaccaggaggcaaggccgccagauuaguccucccucucggaaggcucaugcacuccggggaucucugcuuaagcuuccgccauaaagugacaggacuccauagcggcacauugcaaguguucgucagaaaacauggagcucacggugcugcguuauggggccggaauggaggacauggcuggagacagacacagauuacacugcggggagcugauauuaagucugucgucuucaagggggaaaagaggagagggcacacgggagaaauuggacuugaugacgugucucuuaaaaaagggcacuguucagaagaaagguag

SEQ ID NO: 14201 - RNA, 1413 nt, Artificial Sequence
  Description of Artificial Sequence: Synthetic coding sequence
augaagcguucaguggcaguaugguuauuaguuggccugucucuaggugugccucaguuugguaaaggcgacauaugugaucccaacccuugugaaaauggugguauaugccugcccggccuggcugacggaagcuucuccugcgagugcccggauggauuuaccgauccuaacugcagcagcguuguggaggucggaccaugcacuccaaacccuugucacaacggcgguacuugcgaaauaucagaggcguaccgcggcgauacuuucauuggcuaugucugcaagugcccaaggggguucaauggaauccauugccagcauaacaucaacgaaugugaggucgaaccuuguaagaaugggggaauuugcacagaccucgucgcuaauuacuccugcgaaugcccaggagaguuuaugggaaggaauugucaguacaaaugcagcggaccucugggaauugaaggcggcaucauuaguaaccagcagaucacagccagcagcacacacagggcacuuuucggcuugcagaaaugguaucccuacuaugcuaggcugaacaaaaagggacugauuaacgcauggacagcugccgaaaacgacagauggccauggauucagaucaauuugcagcggaagaugcgcgugaccgguguuaucacacaaggugcgaagagaauaggaucaccagaguacaucaaaucuuauaaaauugccuauaguaaugauggcaaaaccugggcuauguacaaagucaaggggaccaaugaggacaugguguuuagaggaaauaucgacaacaauacgccauacgccaauuccuuuacaccucccauuaaggcacaauacguccgccuguacccacaagucuguagacgacauugcacucuccggauggagcucuugggcugugaacugucuggaugcucagaaccucuugggaugaaaagcggucacauucaagauuaucagauaaccgcuaguuccauuuuuaggacccucaauauggacauguuuacaugggaaccgcgaaaagcacgcuuggacaagcaggggaaagucaacgcuuggaccucuggccacaaugaucagagucagugguuacagguggaccuguuagugccuacuaaagucaccgggaucauuacucaaggggcaaaagacuuuggacacguacaguucgucggcagcuauaaguuggccuacucaaaugacggcgagcauuggacuguguaccaggaugaaaagcagcgaaaggauaaaguguuccaagguaauuuugacaacgauacucauagaaagaacguuaucgacccaccuaucuacgcuagacacauacgaauuuuacccuggucuugguacgggagaauaacacugcggagugaguuacugggguguacagaggaggaauag

SEQ ID NO: 14202 - RNA, 1254 nt, Artificial Sequence
  Description of Artificial Sequence: Synthetic coding sequence
auggccucuuacuuauauggcgugcuguucgccgucgggcucugcgcucccaucuacugcguguccccugcaaaugccccauccgccuaucccaggccaucgucaaccaaaucuacgccugcaagccaggucuacagccugaacacggauuuugcuuuccgccuuuaccgccgucuuguucuugaaaccccuagccagaauaucuuuuucucucccgucagcguuuccacuagccucgccaugcucuccuuaggagcucacucugucacuaagacacagauccugcaaggguuaggauuuaaucugacccauacacccgaaucugccauacaccaagguuuucagcaccucgugcauucucugacagugccuagcaaagauuuaacguuaaagaugggcucggcccuguuugucaaaaaagagcuucaacugcaagccaacuuccucggaaaugucaaacgccuuuacgaagcugaggucuucucgaccgacuuuuccaauccaagcauugcacaagcacgcaucaauucucacgucaaaaaaaagacucaagggaagguuguugauaucauacagggucuggaucugcuuaccgccauggucuugguuaaccauauauuuuuuaaggcuaaaugggaaaaaccuuuccauccagaguauacccguaaaaacuucccguucuuagugggcgagcagguuaccguucacguccccaugaugcaccagaaggagcaguucgcauuugggguagacacugagcucaauuguuucguauugcagauggauuauaaaggcgacgcaguggcauuuuuuguacucccaucuaaaggcaagaugcggcagcuggaacaggcccucagugcacggacucugagaaaauggucacacucacugcagaagagauggaucgaaguuuucauuccaagauucucuaucucagcuucguauaaucuagaaaccauccugccuaaaaugggaauccagaacguguuugauaaaaacgcagauuuuuccggaauagcaaagcgggauucacugcagguuucaaaagcaacacauaaggcagugcuugacgugucggaggagggaacagaagcaacugcugcuaccacaacaaaauuuauaguccguagcaaggaugggcccagcuacuuuacagugucauuuaauagaacauuucuaaugaugauuacuaauaaggcaacagacggcauccuauuccuuggaaaaguugaaaaccccacuaaaaguuag

SEQ ID NO: 14203 - RNA, 486 nt, Artificial Sequence
  Description of Artificial Sequence: Synthetic coding sequence
auguuaaugcccguucacuuucuucugcucuuacuuuuacugcugggcggaccccgaaccggucucccacauaaguucuacaaggccaaaccuauuuucucuugucugaacaccgcucucagcgaggccgagaaaggacaaugggaggaugcuucccugcuuucaaaaaggucuuuccacuaccugagaucacgggaugcuucauccggagaagaagaggagggcaaagaaaaaaagacguuuccaauuucuggggccaggggaggggccaggggcacaagguaucgauacgucagccaggcacagccucguggcaagcccagacaagauaccgcuaaaucuccccauagaacaaaauucacguugucccucgauguacccacuaacauuaugaaucugcuguuuaacaucgccaaagcuaaaaaucuccgcgcccaggcugccgccaaugcucaccugauggcccaaauuggaagaaaaaaauag

SEQ ID NO: 14204 - RNA, 2091 nt, Artificial Sequence
  Description of Artificial Sequence: Synthetic coding sequence
auggcuauggcaagacugggcucuuggcuaggagaagcacaguggcuagcguugguuaguuuguuuguggcugcacuggcuaccguuggucuguaccuugcacagugggcacuagcccgugcuagaccccaaccccagaggcgggcgguggaaccaggcgaggguccucguccugguagugacgcgcuacuguccuggauacugacacugggcagcuggagaagucaguggcaggcagccugggugaccgccuuaaaugaggaagcggaaagaaagggaggacccccauuccuuagcuucgaagaagaucccagacagcaggcauuagaacugguggugcaagagguuuccucugugcuccgaagcgcagaagaaaagguaguuguaugccauguuguaggccaggcaauucaguuccuugugucagagacgcccgcacucggggccggcugccgccuguacgauaugcgguugaguccauuccaucuucaacuggaguuucauaugaaagagaaaagagaagaccugcagaucagcuggaguuuuaucagugugcccgagauggcuguaaacauacaacccaaggccuuaggagaagaucagguggccgagacaagcgccauguccgauguauugaaagacauucuuaagcaucucgccggaucugcaucucccuccguugugcugauuacuaagccgacaacuguuaaagaggcucagaaccuucagugcgcugcuucgaccgcgcaggaaucuugcccccccaaaccuccgagggcucaugaacucaaguugcucgugcgcaauauccacguucuacugcugucugaaccaggcgcuucaggacacaucaaugccgugugugucguacagcugaacgacccuguccagagauucuccuccacacucacgaaaaacaccccugacuugaugugggaggaagaauuuacuuucgaacucaacgccaaguccaaagaguugcacuugcaaaucucagaagcagggagauccucugaagggcuacucgcaacagcaaccguaccguuagaucucuuuaagaagcagccauccggaccacaguccuucacacucaccucuggauccgccuguggcucuagcguacucggcucaguuaccgcagaauucaguuacauggagccgggcgaauugaaauccuggccgauuccaccaccagucccagcagccaagauagagaaggaccgaaccguuaugccuugcggcacagucguuacaaccguuacugccgucaagacgaaaccuagaguagaugugggacgugcuuccccguuaaguucagacucaccuguuaaaacaccuauuaaagugaaggucauagaaaaggauauuuccguacaagcaaucgcaugucgaucggccccgguuuccaaaacacucucaagcuccgauacagaacuccuggugcugaauggcucagacccugucgcugagguggccauccggcagcuuuccgaaaguucaaaacuuaaacucaagagcccacgcaaaaagucuacaauuauaauaucugguauuuccaagaccucacugucacaggaucacgaugcagcacugaugcaaggauacacagccaguguggauaguacccaccaggaagaugcaccaucccauccagagcgcgcagcugcaagcgccccacccgaggaagcagagagcgcccaggcgucacuggccccuaaaccucaggaagaugaacuggauucuugggauuuagagaaggaaccccaagcugcagccuggagcagccaaguccuucuggaucccgacggagaugaacuguccgaguccagcaugucuguuuuagagcccggcaccgcaaaaaagcauaaaggaggaauucuuaggaagggggcuaaguuauucuuuagaagacgucaucagcagaaagauccagguaugucccagucucacaaugaccuaguguuccucgagcagcccgaagggaguagaaggaaaggcaucacacucacgcgcauucugaauaagaaacuuuugucgcgccauaggaacaaaaacaccaugaacggcgcuccaguugaaccguguacauag

SEQ ID NO: 14205 - RNA, 669 nt, Artificial Sequence
  Description of Artificial Sequence: Synthetic coding sequence
augccugcgucaaguccauuccucuuagccccaaaagggcccccuggcaauaugggcgguccaguuagggaaccagcucugagcguggcccuauggcucagcuggggagccgcucugggcgcaguagcaugugcuauggcccugcugacacaacagacugaacuucagucacugcggcgagaagugucgcgccuucaggguacaggcggcccuagccagaacggagaaggguauccguggcagucucuuccagagcagcauucaguacuccacuuggugccaauuaacgcgaccucuaaagacgacuccgacgugaccgaagugauguggcaaccagcacucagaagagggagaggacuucaagcccagggcuacggcguccguauacaagaugcgggaguguauuugcucuacagccagguacucuuccaagacguuacauuuacaaugggucaggucguuucacgggaaggacagggacgacaggagacacuuuuccggugcauacgaucuaugccaucucacccagaucgagccuacaauucauguuacagcgcagggguuuuccaccuccaccagggagacauccugagcguaaucauaccccgagcuagagccaaacugaaucuuuccccacacggcacauuucugggcuucguuaaguuguag

SEQ ID NO: 14206 - RNA, 2205 nt, Artificial Sequence
  Description of Artificial Sequence: Synthetic coding sequence
auguggggucucuuacuugcacuggccgcauuugcucccgccgugggccccgcucuuggagccccaaggaacaguguguugggucuugcacagccgggaacaaccaaggugcccggcaguacuccugcauugcacagcucacccgcccaaccucccgccgaaacagcaaacggcaccucagagcagcauguucgaauuagaguaauaaaaaaaaagaaggugauaaugaagaaaagaaagaaacugacacugacacggccaacuccacuuguaaccgcugggccacucgucacgccuacgccugcagguacucuugaccccgccgagaaacaggagaccggcuguccuccacuggggcuggagucacuacgaguuuccgacagcagauuagaagccucaagcucccaguccuuuggccugggcccacaccggggaaggcugaacauucaauccggguuggaagauggagauuuguaugacggcgcguggugcgcugaggagcaggacgccgaccccugguuccaggucgaugcgggucaccccacuagguucucaggcguaaucacccaggguagaaacuccgucuggcgcuaugacugggucaccuccuacaaagugcaauucaguaaugacucccgaaccugguggggaucacgcaaccacucaucaggcauggacgccguauuuccugccaacucagauccggaaacacccguguuaaaccuccugcccgaaccgcaggucgcccgauuuauccgguugcugccgcagacuuggcuacaagggggcgcaccgugcuuacgcgccgagauauuagccuguccagucagcgaucccaacgacuuauucuuagaggcacccgccuccgguaguuccgauccccuggauuuucaacaccacaauuacaaggcuaugagaaaacugaugaaacaagugcaggagcagugcccaaauauuacccguaucuauucaauaggaaagucuuaucagggccucaaacucuacgugauggagaugucagacaaaccaggggaacacgaacugggggaaccugagguuagguauguggccggcaugcacgggaacgaagcccucggaagggaguuacuucuccuguugaugcaguuucugugucacgaauuccugcggggcaauccucgcgucacucgccuccucuccgaaaugcguauucacuuacugccgagcaugaacccagaugguuacgaaauagcuuaucaccggggcagcgaauuaguggggugggccgaagguagauggaauaaucagagcaucgaccucaaccauaacuucgcggaccugaacacuccccucugggaggcacaagacgacgggaagguaccacauauagugcccaaccaccaucugccauugccuacuuauuauacccugccuaacgcaacaguugcaccagagacccgagcuguaauaaaauggaugaaaagaauuccuuuuguucucuccgcaaaccugcacggcggcgagcugguugucucuuacccuuuugauaugacucgaacaccuugggcggcccgcgagcugaccccaaccccagacgaugccguauucagauggcugagcacaguuuacgcaggcucuaauuuagcaaugcaggacacaucacggcggcccugucauucucaggauuucucagugcacggaaauauaauuaauggagcugacuggcauaccgucccuggaucaaugaacgauuuuucauauuugcauacuaacugcuuugaggugaccgucgaguugaguugcgacaaguucccucacgaaaacgaacucccucaggagugggaaaauaacaaagaugcucugcugaccuaucucgagcaaguaagaauggguauugccggcgugguccgagacaaagacacugaacugggaauugcggaugccgucaucgccguagacgguauaaaucacgauguuacaacugcuuggggaggugauuauuggcgacuccuaacuccuggugauuauauggucacagcuuccgcugaaggauaucauagcgugaccagaaacugccgcgucacuuucgaggaaggcccuuuuccauguaacuuugugcucaccaagaccccaaagcagagacuccgggaauuacuggcugcaggugccaaagucccccccgaucugcgucgacgacuggagcggcucagaggacagaaagauuag

SEQ ID NO: 14207 - RNA, 759 nt, Artificial Sequence
  Description of Artificial Sequence: Synthetic coding sequence
augcgcgcuccucuucuuccacccgccccagugguucuuucccuguuaauccuggguuccggccauuacgccgcaggacucgaccucaaugacacuuauuccgguaaaagagaaccuuuuagcggcgaccauucugcagaugguuuugaagucacgucuagguccgaaaugaguuccggcucagagaucucgccugugucagaaaugccaagcuccuccgagccuucauccggcgccgacuacgauuacagcgaagaguaugauaacgagccacagauucccggcuauauuguugaugauucgguccggguggagcagguggucaagccuccacagaacaagacagaguccgagaauacaagcgacaaaccaaagcguaagaaaaagggagggaagaauggaaagaauaggagaaauagaaagaagaagaacccguguaacgccgaguuucagaauuuuuguauucacggugaguguaaguacauagagcaccucgaagccguuacaugcaagugucaacaggaguauuucggagaaagauguggagaaaagucuaugaaaacccacucuaugauagauaguucacugaguaaaaucgcgcuggcagcaaucgcugcguuuaugucggccgugauccugaccgccguggcaguaauuacugugcaacugagacgccaguacgugagaaaauacgaaggagaagccgaggaaagaaaaaaacugcgccaggagaacgggaaugugcacgccauugcuuag

SEQ ID NO: 14208 - RNA, 8487 nt, Artificial Sequence
  Description of Artificial Sequence: Synthetic coding sequence
augccaaagagggcucacuggggagcgcugagcguuguacuuauccuacuguggggucacccucguguugcucuggcauguccccauccgugugcuugcuacguuccuagcgaagugcacuguacuuuccgaucgcucgcuucagucccugccggaauagcuaagcacgucgaacggauuaaccugggcuucaacuccauacaagcucuguccgaaacaucguucgcugggcucacaaagcuggagcuacuuaugauucacggaaaugagauccccucgaucccugacggcgcccugcgcgauuuaucuagucugcaaguuuucaaauuuuccuauaacaaacuuagagugaucacaggacagacguuacaaggccucuccaauuugaugaggcuucacaucgaccacaauaaaauagaauuuauccacccucaagcuuuuaacggccucacaagccucaggcuccuccaucuggaagggaaccucuugcaucaacuccacccuaguacuuucagcacauucaccuucuuagauuauuuucgccucuccacaauucgccaccuguaucuggcggaaaacaugguacguacccugcccgcuucuauguugaggaauaugcccuuguuagaaaaccuauaccuucaaggaaaucccuggacaugcgacugugaaaugagaugguuccucgaaugggacgccaagucuagaggcauucucaaaugcaagaaggauaaggccuacgagggaggacagcugugcgccaugugcuuuuccccuaagaaauuauauaaacacgaaauccauaagcucaaagacaugacgugcuuaaagccaucuauagaaagcccacuccgccagaauagguccaggagcauugaagaggagcaggaacaggaagaggacggaggcagucaacugauuuuagagaaguuccaguugccucaguggucuauuagcuuaaacaugacugacgaacaugggaauaugguaaaccuagugugugauaucaagaagcccauggauguauacaaaauccaccuuaaccagaccgacccuccagauauagacaucaaugccaccguggcccuugacuucgaaugccccaugacgcgcgagaacuacgaaaagcuuuggaaauuaauagccuauuauucggagguacccguuaagcugcaccgcgagcuaauguugagcaaagacccucgcgucucuuaccaguaccgccaggacgccgacgaggaagcucuuuauuacacaggcgugagggcccaaaucuuggccgaaccugagugggugaugcagccuaguauugacauucagcuaaaucgcagacaaaguacagccaaaaaagugcucuuauccuacuacacucaauauucacagacuaucuccaccaaagacacaaggcaagcgcgugguaggucaugggugaugauugaaccaucaggcgccgugcagagggaucagacuguucuggagggaggcccaugccagcugucuuguaaugugaaagccuccgaaagccccuccauuuuuuggguucucccagacggaucaaucuugaaagcuccaauggaugacccugauagcaaguuuuccauauugucaucuggcuggcugagaaucaagucuauggagcccuccgauucuggacuguaccagugcauugcacaggucagagaugagauggauaggaugguuuacagaguccuggugcaaucuccauccacgcagcccgcagaaaaagauacaguuacgaucgggaagaacccaggugaaucuguuacccugccauguaacgcacuggcuauccccgaagcccaucuuucuuggauucugccaaaucggagaaucauaaacgaccuagccaauacuagucacguguauaugcuucccaauggaacauuauccauuccuaaaguucagguuucagauagcggguacuacagaugcguggcggugaaccagcagggcgccgaccacuucacaguuggaauuacagugacaaagaaaggcucgggguuaccaucaaaaagagggcggcggccgggugcuaaggcucuaucaagagugagggaggauaucguggaggaugagggggguagcggaaugggggaugaggagaauacaagccggagacuucugcaucccaaggaccaggagguguuucugaaaaccaaagacgaugcgaucaauggggauaaaaaagcuaaaaaagggcgucggaagcugaagcuuuggaagcauagugagaaggagccugaaacuaacguggcugaggguaggcgcguguucgaaaguaggagacgcauuaacauggcuaauaagcagauaaauccugaacggugggccgacauacuggccaaggucagagggaaaaacuugccaaaagggacagaggucccuccccuaaucaaaaccacaucccccccauccuuaucuuuagagguuacaccuccauucccugccaucucaccgccgagugccucgccuguucaaacugugacauccgccgaagaaucaagcgcugaugucccgcugcuuggugaggaagaacauguauuggguaccaucuccagcgcgucaaugggacuagagcacaaccacaacggggugauuuuggucgaacccgagguaacuaguaccccccucgaggaaguuguggaugaucugagcgagaaaaccgaagagaucaccucuacagagggcgaucucaaaggaacagcagcacccacacugauuucugaacccuacgaacccaguccuaccuugcauacuuuagacacagucuacgaaaaaccaacacacgaagagacagcaacugaggguuggucugccgcagaugugggaaguucuccagaaccaacuucuuccgaauacgagcccccacuugacgccguuagccuugcagagagcgaaccaaugcaguacuuugacccugaucuggaaacaaaaucccagccugaugaggacaaaaugaaagaagacacauuugcgcaucugacgccuacuccgacgauuuggguuaacgacuccagcacaucccaauuauucgaggacucaacuaucggugagccuggugugccuggacagagccacuuacagggauugacagacaauauccaucuaguaaaaucuucccuguccacgcaggauacacugcugaucaagaagggcaugaaggagaugagccagacacuucaaggggggaauauguuagaaggugaccccacacacucccgcucaagcgagucagagggccaggagagcaaaucuaucacacugcccgacuccacccugggcauuaugucuucaauguccccuguaaaaaaaccagccgagaccaccgugggaacucuguuggauaaagacacaaccaccgccacaacgacccccagacaaaaagucgcucccaguucaacaauguccacacacccgucuagacggaggccuaauggacgaaggagacugcgcccgaauaaauuuagacacagacauaagcagacaccaccuaccaccuuugcucccuccgaaacguuuucaacacagccaacccaagcaccugauauaaagaucucaucacagguugagucuagucucguccccaccgcuugggucgacaauacggugaacacaccuaagcagcuggaaauggagaaaaaugccgaacccacaaguaaagggacacccagaagaaagcauggcaagagacccaacaagcaccgguacaccccgucaaccgugucgucaagagccucaggauccaaaccaucgccaucccccgagaauaaacaucgaaauaucgucaccccuagcucagagaccaucuuguugcccagaaccgugagccugaaaacugagggaccauaugauagucuagacuacaugacaaccacacguaagauuuacucuucuuauccaaagguacaagaaacccucccugugaccuacaagcccaccagcgauggcaaagaaaucaaggacgauguggcuaccaauguggauaagcacaaaucugacauucucgucaccggagaaaguauaacuaacgcuauucccaccagccgaucucuagugagcacgaugggggaguuuaaagaggaaucaucuccagucggauucccuggcacaccaaccuggaacccuucccgaaccgcccaaccaggcaggcugcagacuggcaucccuguuacaacaagcggcgaaaaccugacagacccuccacuccuuaaagaacucgaagauguggauuuuaccucugaguuccuuuccagucugacaguguccacaccguuccaucaggaagaagcuggcuccucaacuacgcucucuucgauuaagguggagguugcgucaagccaggccgagaccacaacccucgaucaggaucaucucgaaaccaccguugccauccugcucuccgagacaaggccccagaaccacacuccuaccgccgcucgcaugaaagaaccagccucaaguucacccaguaccauacugaugucccuuggacagacuaccaccaccaaaccugcucugccauccccucgcaucucccaggcaagccgcgacaguaaggagaauguauuuuuaaacuaugucggcaauccggaaacagaagccacacccguuaauaaugaaggcacgcagcacauguccggcccaaacgaacuguccaccccuagcucugaccaggacgccuuuaaucuuaguacuaagcuggaacucgaaaagcaaguuuuuggcagcagaucuuugccccgcgggccugauucccagcgucaggaugggcgcguccacgcaagucaucagcucacccgcguuccugcaaagcccauucuuccuacagcuacaguucggcucccagagauguccacccaguccgccucccgauauuucgucacaucccagucgccccgccacuggacuaacaaacccgaaauuacuacuuauccuucaggagcucuacccgagaauaagcaguuuaccaccccccgccuuuccaguaccacaaucccucuuccccugcacaugucuaagccuucgauacccaguaaguucaccgaucggcggacagaccaguucaacggcuauaguaagguguuuggaaauaacaacaucccagaagcacgaaauccugucggcaagcccccaagcccaagaaucccucauuacagcaauggacgccuucccuucuuuacuaacaagacacugucauuuccgcagcuaggagucacuaggagaccgcaaaucccaaccuccccugcccccgucaugcgugagaggaaagucaucccugguucauacaaccgaauucacucucacucuaccuuccacuuggacuucggccccccagcaccuccuuugcugcauacaccucagacuacuggcagcccaagcacuaaucuucagaacauuccgauggugaguuccacccaaucuucuauauccuucaucacuaguuccguccagagcagcggcucuuuccaccaaagcucuaguaaauuuuuugcugguggaccgccagcuaguaaauuuuggucccuuggagaaaaaccacagauccuuacaaagucuccacagacuguguccguaacugccgaaaccgacaccguguuccccugugaagcuaccgggaaacccaaaccauucguaaccuggacaaaggucagcacuggcgcacugaugacacccaauacgagaauacagcgguuugaagugcugaaaaacgggacccuugugauuagaaagguacaggugcaagauagagggcaguacaugugcaccgccucuaaccuccacgguuuagaccguaugguagugcuacuauccgugaccgugcaacagccgcagauucuggccucacacuaucaggaugugaccguauaccugggagacacuauugccauggagugccucgccaagggcacaccagcgccccagauuagcuggaucuuccccgaccgccguguguggcagacaguuucacccgucgaaggacgcauaacccuacacgagaacagaacccucagcaucaaagaggcaucauuuagcgauaggggaguuuacaagugcguggccucuaacgccgccggagccgacucauuagcuauucgccuucaugucgccgcacugccucccgugauacaccaggaaaaauuggaaaauauaucccuucccccuggccuuuccauucacauccauuguaccgccaaagcugccccucuucccagugugcgauggguuuuaggcgaugggacccaaauccguccgucacaguuccugcacggcaaucuguucguguucccaaaugguacgcuauacauccggaacuuagcuccuaaagacaguggaagauacgaauguguggcggcuaaccuggucggaucugcuagaaggacugugcagcugaacgugcagagggcugcagcuaacgcucgaauaacuggcaccucaccucgccgcaccgauguucgcuacggcggcacccuaaaacuagauugcuccgcuucaggcgauccuuggccucguauccucuggcgguugccuucaaaacguaugauagaugcccucuuuuccuuugacucuaggaucaagguuuucgcaaaugguacauuaguugugaagagcgucacagacaaagaugccggagauuaccuguguguggcuaggaauaaagugggugacgauuacgugguguuaaaggucgaugucgugaugaagccugcgaaaauugagcauaaagaagagaaugaucauaagguuuucuauggcggcgaccuuaaagucgauuguguggcuaccggacucccuaauccagaaauuagcuggucacugccugacggcucccuggucaacagcuuuaugcagagcgacgauaguggagggaggacaaagcgcuacgugguauuuaacaacggaaccuuguacuucaaugaagugggaaugagagaggaaggagacuacacaugcuuugcggaaaaucagguagggaaagaugagaugagagugcgagugaaaguggugacugcgcccgccacgauucgaaauaaaacauauuuggcaguccaggugccguauggagaugugguaacgguagcuugcgaggcgaagggggaaccgaugccuaagguaacauggcugagccccacgaacaaagugauccccacauccucugaaaaauaucagauauaucaggacgggacauuacucauucagaaggcgcagaggagcgauucgggcaauuauaccugucucguacguaacagugcuggcgaggaccgcaaaacuguguggauccaugucaauguucaaccuccaaaaauuaauggcaaccccaauccuauuacaaccguccgagaaauagccgccgggggcucuagaaagcugauagauugcaaggcagaaggcaucccaacucccagagugcugugggccuuucccgagggcguugugcugccagcaccauacuacggcaaucgcauaaccguucacggcaaugggucacucgacaucagaucccuaaggaaaagcgauucugugcagcuggucugcauggcacgcaaugaaggaggcgaagcaagguugauccuacaauugacuguccucgagccaauggaaaagccuauuuuccacgauccuaucucagagaagaucaccgccauggcaggucacacaauuucccugaacugcuccgcagcuggaacaccgacucccucacucguguggguccucccaaaugguaccgaccugcaauccggccagcaacuucagcguuucuaucauaaagcggauggaauguuacacauuuccggguuaucuuccguggacgcgggcgccuacagaugugucgcccguaaugccgccggacacacagaacgacucgucagccucaaggugggucucaaacccgaagcuaauaaacaguaucauaaccuggugucuauaauuaacggugaaacacuuaagcuccccuguaccccuccaggggcuggacaagggcgguucucuuggacacuucccaauggaaugcaucuugaagguccucagacacugggaagagugucccuguuggauaauggaacacuuaccgugcgggaagcgucaguuuuugacagaggcacauauguaugucgcauggaaaccgaauaugggccuagcgugaccucaaucccuguaaucguaaucgccuauccuccuaggaucaccucagaaccaacgcccguaauuuauacaagacccgggaauaccgucaaacugaauugcauggcuaugggcauucccaaggcagacaucaccugggagcuuccugauaaaucccacuugaaagcaggaguucaggccagacucuauggcaaccgcuuccuccacccgcagggcuccuuaacuauccagcacgccacacaaagggacgcuggcuucuacaagugcauggcuaaaaacauccugggcuccgauuccaaaaccacuuacauacacguauucuag

SEQ ID NO: 14209 - RNA, 3330 nt, Artificial Sequence
  Description of Artificial Sequence: Synthetic coding sequence
augcgacuguuguuacuagugcccuugcuccuagcucccgcgccggggucauccgcuccgaaggugagacgucaaucggauaccuggggccccuggagccaguggucacccuguucacgcacaugcggagggggggugagcuuccgggagcgaccaugcuauagucaaagaagggaugguggauccucgugugugggacccgcaagaucucaucgauccugucguacagagucuugcccggauggcgcccgagauuucagggcagaacaaugugcagaauuugauggagccgaauuucaggggagaagauaucgaugguugccauacuacuccgcuccaaacaagugugaacucaauugcauaccuaaaggugaaaacuucuauuacaaacaucgggaagccgucguggacggaacgccuugcgaaccuggaaaacgggacgucuguguggacggaucuugcagagucgucggaugugaucacgaacuagacaguagcaaacaggaggacaaaugucuucgauguggcggagaugggacgacguguuaucccgucgcagggacuuuugacgccaaugaucugucuagaggauacaaucagauacugauagugccaaugggcgccacauccauuuugauugacgaagcagccgcaucacgcaacuucuuagccgugaagaauguuagaggagaguauuaccugaacggacauuggaccauugaggcugcaagagcccuccccgcagcuaguaccauuuugcacuacgaacggggugcugaaggugaccuggcuccugaacgguugcacgcccguggaccuaccagugagccacugguaaucgagcugauuucacaagaaccaaauccgggggugcauuacgaauaucaucugccuuuaaggagaccaucaccaggcuuuucauggucucacgggagcuggagcgacugcucugcagaauguggaggcggacaucaauccaggcugguguuuuguaccauugaccacgaagcguauccggaccauaugugucagaggcagccaagaccugcagauagaagaaguuguaaucugcacccuugcccagaaaccaagcgguggaaggccgguccuugggcgcccugcagcgcguccugcggcgguggaucacagagcaggagugucuacugcaucuccucagacggagcuggaauucaggaagcuguggaagaagcagagugugcaggccuuccugguaagccccccgcuauccaggccugcaauuuacaacggugugccgcguggagucccgaaccguggggggaguguucggugucaugugguguuggcguccguaagcgauccgugaccugcagaggcgagagaggaucauugcugcacacugccgcguguucccuggaagauagaccaccgcugacugagccaugcguacaugaagauugcccucuguuguccgaccaagcuuggcauguugguacuuggggguuaugcagcaaaucguguuccaguggaacuagaagacgccagguaauuugcgcaauuggaccaccuucccacugcgguagccuacagcauuccaagcccguagacguugaaccgugcaauacacaacccugccaccuuccucaggaggucccaagcaugcaggacguccauacacccgcuucaaacccauggaugccccugggaccucaggaaagcccugcuagugauucacgaggacaguggugggcugcccaggagcacccauccgcuaggggcgaucaccgaggugaacggggcgauccacgcggugaucaagggacacauuugucagcacucgggccugcccccucucuacaacagccaccuuaccaacagccauuacguucgggaucugguccucacgacugcagacacagcccccauggaugcugccccgacggccacacugcaagccugggcccacaguggcagggcugcccuggagcuccuugccagcagucgcgauaugguugcuguccagacagggugucagucgccgaaggaccccaucacgcugguugcaccaaguccuauggaggcgacaguaccgguggaaugccccggaguagagccguggcuaguacagugcacaacacucaccaaccccaggcccaacagaacgagccauccgaaugucggggcagccaauuugguugcugcuaugacaacguagccacugccgcuggcccccuuggagaggguugugucgggcagccgagccacgccuaccccgucagaugccugcugccaagugcacaugguuccugcgcagacugggccgccaggugguacuucguggcuucugucggucaguguaauagauuuugguacggcggcugucauggaaaugcaaacaacuuugcuucugagcaagaauguaugaguagcugucagggaucacugcauggcccacgcagaccucaacccggcgcuagugguaggaguacacacaccgacggcgggggauccagcccagcuggcgagcaggagccaagccaacauagaacaggugccgcagugcagagaaagccuuggccaagugguggucuuuggcgccaggaucaacaacccggaccaggggaagcaccccacacucaggcuuucggcgaauggccauggggccaagagcucgggucaagggccccgggccugggcggagaugccggcuccccggccccgccauuccacucuuccuccuacaggaucucccucgcaggagucgagccuuccuuaguucaggccgcgcuggggcaacugguacgucuauccugcagcgacgacacggccccagagucucaggcugcuuggcaaaaggauggccagccaauuucuuccgacagacacagauugcaauucgaugguucccucauuauucaccccuugcaggccgaagacgccgguacguacucuugugguucaacaagacccgggagggacucccagaaaauacaguuaagaauuauugguggagauauggccguuuugucugaggcagagcugucuagauuuccccagccccgagacccagcacaggauuucggacaggccggcgccgcuggaccauuaggcgcuaucccuucuucucacccucagccagccaauagguuacgucuggaucagaaucagccaagaguaguggaugccucucccggccagcgcauucgaaugacaugccgagcagaagguuucccacccccagcaaucgaguggcagcgcgacggccagccggugaguagcccgucgacacaucguccugcacagggcccuuggcaaggccugaggagacccgcucgcgccggacagcuguag

SEQ ID NO: 14210 - RNA, 405 nt, Artificial Sequence
  Description of Artificial Sequence: Synthetic coding sequence
augaagaguguguuguugcuuacuacgcuccuugugcccgcccauuuaguagccgccuggaguaauaacuaugccgucgacuguccgcagcauugcgacagcucugaaugcaaaucuuccccacgaugcaagcguaccguccuggaugauugcggaugcugcagagucugcgcagcuggacggggagaaacgugcuaccgaacagugucaggaauggauggaaugaagugcgggccaggccuaagaugucaaccgucaaauggcgaagacccauucggggaagaauuugguaucugcaaagaacacgauauggcgaguggagacgggaacauugucagagaagaaguggugaaggaaaaugccgccggaagcccuguaaugcguaaguggcuuaacccaagauag

SEQ ID NO: 14211 - RNA, 555 nt, Artificial Sequence
  Description of Artificial Sequence: Synthetic coding sequence
augaagucuguccuauugcuaaccacuuuacuggugccugcacaucugguugcugcauggucuaauaacuaugccguggacuguccucaacacugugacucaagugaaugcaaaagcucaccgaggugcaaaaggacugugcuugacgacuguggcuguugcagagugugcgcugcugguagaggagagacuugcuaucgcaccguuuccgggauggacgggaugaagugcggaccgggcuugagaugccagccuuccaacggcgaggacccuuucggcgaagaauuuggaauuugcaaggauugcccuuaugguacuuucggaauggacugcagagaaacuuguaauugccaaagcggaaucugcgaccgcgggacuggaaagugccugaaguuccccuucuuccaguauaguguuaccaaauccucuaaucgcuuuguuagcuugacugaacacgacauggccagcggcgacggaaauaucgucagagaagaggucgugaaggaaaacgcagcugggucuccugugaugagaaaauggcugaaccccagauag

SEQ ID NO: 14212 - RNA, 597 nt, Artificial Sequence
  Description of Artificial Sequence: Synthetic coding sequence
augccaauuccagcgagcccccuucacccuccucugccauccuugcuucuuuaucuucuccuugaauuagccggcguuacacauguuuuccacgugcagcagacugaaaugagccagacuguuucuacgggcgagaguauuauucuuagcuguucuguacccaauacccugccuaacggaccuguucugugguuuaagggcacaggcccaaaucgcaaauugauuuauaauuuuaagcaggggaauuuuccacgcgugaaggaaauaggggauacuacuaaaccugggaacaccgauuuuucuacacgcauaagagaaaucucacuggcugaugcgggcaccuacuacugcgugaaguucaucaagggcagagcaauaaaggaguaucaaucagguagagggacacaagucuucgucaccgccgagcagaacccuagaccucccaagaacagacccgccggaagagcuggcucacgcgcucaccacgaugcacacacuugucugagcgcccuaccugagagaaacaguaccaauuacuuuguucagccuuguuguugucugaggcuccugggccugacaggccuccucucgaaguag

SEQ ID NO: 14213 - RNA, 594 nt, Artificial Sequence
  Description of Artificial Sequence: Synthetic coding sequence
augcccauaccugccuccccacuccaucccccucuuccgucguuauuacucuaucuguuacuugaguuagcuggggugacacacgucuuucacguucagcagacagagaugucccagaccgugucuacuggcgagagcauaauccuuucaugcucaguacccaacacucucccaaauggacccgugcugugguuuaaaggaaccggccccaauagaaaacugaucuacaauuucaaacaaggaaauuucccuagggugaaggagauaggagauaccacuaaacccgggaauacagauuucuccacuagaauaagagagaucucccuggccgaugcuggaacuuauuauuguguaaaguuuauaaaggggagggcuauuaaagaauaccagucagggaggggaacccaaguguucgugacagagcagaauccucgaccuccuaaaaacaggcccgcuggucgggccgggucucgagcucaccaugaugcccacaccuguuuaucagcucugccugaacguaauagcacaaauuauuuuguccagccauguugcugucugagguuacuggggcucaccgguuuacugagcaaauag

SEQ ID NO: 14214 - RNA, 1563 nt, Artificial Sequence
  Description of Artificial Sequence: Synthetic coding sequence
augaccacagacgacacugaggugccugccaugacccuggcuccaggccacgccgcacucgagacucagacacugagugcugaaacuuccucuagagcgaguacucccgcaggaccuaucccagaagccgagacccggggagcaaaacgaauuucaccagcgagagagacccgaagcuucacuaagacgagccccaauuucaugguauugaucgcaaccuccguagaaaccagugccgcaagcggaucgcccgaaggagccggcaugaccacugugcagacuaucacaggcagcgacccucgcgaggcuauauucgacacacucuguaccgaugauaucuccgaagaagcuaaaaccuugacgauggauauuuugacacucgcacauacaucaacugaagcaaagggacuuaguuccgaaaguucugcgagcuccgauggcccgcaccccgugaucacaccaucccgagccagugagagcucugcuuccucagacgggccacauccaguuauaacaccaucgcgagccagcgaauccucugcaucaagugacggcccgcauccuguaaucacacccucccgagcauccgagucuucugcauccucugacggcccucaccccgugauaaccccaucuugguccccagguuccgacguuacacugcucgcugaagcccuugugacaguuaccaauaucgaagugaucaauuguucaauaaccgaaauugaaaccacuacuucuaguaucccaggagcaucugacaccgaccuuauuccuacugagggcguuaaggcuuccuccacgucugacccccccgcauugccagacagcaccaauaccaaaccucacauuacagaggugacagcuuccgcagagacacuuuccacugcaggcaccacggaaucagccgcuccagacgcuacaauugguacgccccuccccacuaacucaaccaucgagcgcgaaguuaccgcacccggggccacaacauugucuggcgcucucgcaacuggcaauccccuggaagaaacgagcgcauugagcguugagaccccguccuaugugaaggugucaggagcagccccaguguccauugaagccggguccgcaguagguaaaaccaccucauucgcuggauccucagccucguccuauuccccccuggaagcagcacucaagaacuuuacgcccucugaaacucuuacaaccgacaucgcuacuaagggaccuuuuccaacaagcagagacccucucccaaguguccccccuacaacuacaaacucuucaaggggcacaaauaguacacuagcuaaaauaacuacuagugcuaagacaacuaugaaaccaccaaccgccacccccacaacagcuaggacuagaccgacaacugacgugagcgccggagaaaacggagguuuuuugcuccugcggcugucuguggcgucgccagaagaucuuaccgauccacguguugcagaacgauuaaugcagcagcugcaccgggaguuacacgcccacgccccccauuuccaagucucacugcuaagagugcgcagagguuag

SEQ ID NO: 14215 - RNA, 600 nt, Artificial Sequence
  Description of Artificial Sequence: Synthetic coding sequence
augcucuggaggcaacucauauauuggcagcuccuugcgcuuuucuuuuuaccuuuuugucucugucaggaugaguauauggaguccccacagacaggcggccuucccccggacuguaguaaguguugccaccacgggaauaacggaaauaacggcgccacuggucacaagggagaaaaggguuaucccgguaucccaccugagcuucaaauugcuuuuauggcuagccucgcgacgcacuucaguaaccagaacagugggaucauuuuuucaucggucgaaacaaauauuggaaauuucuucgauguaaugacuggcagauucggugcuccugugagcggggucuauuucuuuacauucuccaugaugaaacaugaggacgucgaggaagucuacguguaucuuaugcacaaugggaacaccguguuuagcauguauuccuacgaaaugaaaggcaaauccgauacaaguuccaaccacgcuguguugaagcuggccaagggcgaugaagucugguuacggaugggcaacggcgcccuucauggagaccaucagcgguucucgaccuuugcaggcuuucuucucuuugaaaccaaguag

SEQ ID NO: 14216 - RNA, 960 nt, Artificial Sequence
  Description of Artificial Sequence: Synthetic coding sequence
auguuguggcgccagcucauauacuggcagcugcuagcccucuuuuuucuccccuuuugccucugccaagacgaguauauggaagugagcggcagaacuaauaaagucgucgccaggauuguccagagccaccagcagaccggccgauccggcucuagacgggaaaaagugagagagcggucccacccaaagaccggaaccgucgauaacaauacuuccaccgaccuaaaaagccugagacccgaugaacucccucacccagagguugaugaucucgcccaaaucaccacauuuuggggacaaucuccucagaccggagggcuuccucccgauugcaguaagugcugucacggugauuauaguuucaggggcuaucaagguccaccagguccgcccggcccuccggggaucccgggcaaccacggcaauaauggcaacaauggcgcgacuggccacgagggcgcaaagggggagaaaggcgacaaaggagaucucggaccucggggcgagagaggacaacacggcccaaagggcgaaaaaggcuacccaggaaucccucccgagcuacagaucgcguuuauggcgucucuggcgacucauuucuccaaucagaacagcgguaucaucuucucaucaguggaaacuaacauaggaaauuucuuugacgucaugaccggcagauucggcgccccagucagcggaguuuacuucuuuacauuuucaaugaugaaacacgaagacgucgaagagguguaugucuacuugaugcacaaugguaauacaguguuuaguauguauucuuacgagaugaaaggcaagagcgauaccuccuccaaccaugcugugcugaaauuggcaaaaggcgacgaaguguggcugcgaauggguaauggggcacugcauggagaccaccagcgcuuuucaacuuuugcaggcuuccuucuuuuugagacaaaauag

SEQ ID NO: 14217 - RNA, 855 nt, Artificial Sequence
  Description of Artificial Sequence: Synthetic coding sequence
augacuaaaucaucacucaggccgcugcaaaagcaguccccccagaccggaggacuacccccugauuguagcaaguguugucacggggauuacaguuuuagaggcuaucaaggccccccuggucccccugggcccccaggcaucccagguaaccacggaaacaauggaaauaauggugccacaggacacgaaggagcuaaaggugaaaaaggggauaaaggggaccucggaccacguggagaaagaggucagcauggccccaaaggcgaaaaggguuauccgggcaucccucccgagcugcagaucgcuuuuauggcuucacucgcgacacacuuuucgaaccagaacucaggaauaaucuuuagcucagucgagacaaacauaggaaauuucuuugaugugaugacagggagguucggggcgccuguguccggcguauauuuuuuuacuuucuccaugaugaaacacgaggacguggaggaagucuacguauaccugaugcauaaugggaauaccgucuuuagcauguauucauaugagaugaaaggaaagucagacacauccucaaaccaugccguucucaaguuagcuaagggagacgaaguguggcugagaauggggaauggagcgcuccauggugaccaucagagauucuccacauucgcaggauuccuccuguucgagacaaagugccauggagagaccccugcaggcccccgcgauucugccgcagguaaaaguaaggcuuaucucugucaagcugaguggaucuggccaguacgcaagcuguuacccguuucauggccucgguaucaacuuuucggauucguaagauggaaagagcagcauaucuag

SEQ ID NO: 14218 - RNA, 234 nt, Artificial Sequence; identical to SEQ ID NO: 12579
  Description of Artificial Sequence: Synthetic coding sequence

SEQ ID NO: 14219 - RNA, 237 nt, Artificial Sequence; identical to SEQ ID NO: 12580
  Description of Artificial Sequence: Synthetic coding sequence

SEQ ID NO: 14220 - RNA, 627 nt, Artificial Sequence
  Description of Artificial Sequence: Synthetic coding sequence
augggggcacagggggcccaagaaucuauuaaagcuauguggagggucccaggaacuacgagaaggcccgucaccggggaauccccggguaugcacagaccagaggcaauguuacuacuacuuacacuagccuuauugggaggccccaccugggcugguaaaauguacggcccuggaggcggcaaauauuuuuccacuacugaagauuacgaccaugagauuaccgggcuccgugucuccgugggucugcuguuggugaaaagcguucaagugaaacugggugauaguugggacguuaagcugggugcccucggugguaacacccaagaagugacccuccagcccggcgaauacauuacuaaggucuucgucgccuuccaagcauucuuaagggguaugguaauguacacaucaaaagaucgguacuucuauuucggcaaacuggauggucagauuucaucugcuuauccuucccaagagggucaagugcuuguugguaucuauggccaguaccaacugcucggcaucaagaguauuggcuucgaauggaauuacccccuggaagagccaacaacggagcccccugugaaccugacuuacucugcuaacucacccgucggacgauag

SEQ ID NO: 14221 - RNA, 288 nt, Artificial Sequence; identical to SEQ ID NO: 12582
  Description of Artificial Sequence: Synthetic coding sequence

SEQ ID NO: 14222 - RNA, 339 nt, Artificial Sequence
  Description of Artificial Sequence: Synthetic coding sequence
auguuugugcuucuguaugucacgucuuuugccauuugugcaucgggacagccccgcggaaaccagcuuaaaggggagaauuauaguccccgcuauauuugcucuaucccuggccucccuggcccucccggaccucccggcgcuaauggaucaccuggcccucacgggcgaauaggacuccccggcagagacggacgugauggaaggaaaggggagaaaggagagaaaggaaccgccggcuugcgggguaagacuggaccauuaggccuugccggcgaaaagggggaccagggagagacuggaaaaaaagguccuauaggccccgaaggagagaaguag

SEQ ID NO: 14223 - RNA, 300 nt, Artificial Sequence; identical to SEQ ID NO: 12584
  Description of Artificial Sequence: Synthetic coding sequence

SEQ ID NO: 14224 - RNA, 336 nt, Artificial Sequence
  Description of Artificial Sequence: Synthetic coding sequence
augaagucucuguuauuuacccucgcgguguucaugcuccuggcucagcuagucuccggcaacugguacguaaaaaagugucugaaugacguugguauauguaaaaagaaauguaagccagaggaaaugcaugucaaaaacggcugggcuaugugcgguaaacagagagauugcugcgugccggccgaccgacgugccaauuaucccguauucuguguccagaccaagaccacccgaaucucaaccguaaccgcuaccaccgcuaccacuacccugaugaugacuacagcuaguaugucuuccauggcuccaacucccgucuccccuacaggauag

SEQ ID NO: 14225 - RNA, 1698 nt, Artificial Sequence
  Description of Artificial Sequence: Synthetic coding sequence
auggaggauuccgacucggcagccaagcagcugggacuggcggaggcugcugccguggccgccgccgcugcgguugccgcugccgccgccgccgccgccggaggagaagccgaagaacccgugcuuucgcgcgaugaggacuccgaagaagacgcugacagcgaagccgagagagaaacaccgaggguaaccgccguggcaguuauggccgcugaaccagggcauauggacaugggagcugaagccuugccaggaccggacgaggcagccgccgccgccgcuuucgccgaagucacaacugucacagucgccaacguaggagcugcagcugacaacguauuuacaaccucaguggccaaugcugcaagcaucaguggacacguucuuucuggcaggaccgcccuacagauuggcgauucccuuaacacugaaaaggccacccuuaucgugguccauacggaugguaguauuguagaaacaaccggccuaaagggaccagccgccccucucacccccgguccucagucuccacccacaccccuugccccuggucaggaaaaaggcgggaccaaguauaacugggaucccuccguauaugauuccgaguuaccuguucguugucggaauaucagcggaacacucuauaaaaaccgguuaggaagcggggggcgugguaggugcauuaaacagggugagaauugguacagccccacggaguucgaagcuauggcagggagggcuagcucaaaagacuggaagaggucaauccgcuaugccggccguccauuacaaugccuaauccaagauggcauauuaaauccccacgcugcuucuugcaccugcgcugcaugcugcgacgauaugacccuaucaggcccagugagacuuuucguaccuuauaaaagacgcaagaaagaaaacgaguuaccaaccacacccgugaaaaaggauagcccuaaaaacaucacccuccugccagcgaccgcagcuacaacauuuaccgucacccccucuggucagaucacuacuagcggcgcccuaacuuucgauagagcaaguaccguagaggcgacugccguuaucuccgaaucucccgcgcaaggugaugucuuugccggcgcuacagugcaagaggcuagcguccagccacccugccgugcuucccaccccgaaccacauuacccuggauaucaggacaguugucagauagcuccguucccggaggccgcucugccaacaucacacccaaagauuguccugacgucccuucccgcccuggcuguacccccccccacaccaaccaaagcagccccaccugcccuuguaaauggacuggaacuguccgagccacgaucuugguuauaucucgaagagaugguaaauuccuuguuaaauacugcacaacaacucaaaacccuuuucgagcaggcuaagcaugcguccacuuauagagaagcagccacuaaccaagccaaaauccacgccgacgccgaaagaaaagaacagaguuguguuaauuguggaagggaggcaaugucagagugcaccgguugucacaaaguaaacuauuguaguacauuuugccagagaaaagacuggaaggaccaucaacauaucuguggccaaagcgcugcuguuaccgugcaagcagaugaaguucauguggcugaguccgugauggagaaagugacaguguag

SEQ ID NO: 14226 - RNA, 471 nt, Artificial Sequence
  Description of Artificial Sequence: Synthetic coding sequence
augaacauucuuaugcugaccuuuaucaucuguggccuccuaacccgcguuacaaaagggagcuucgagccucagaaauguuggaagaauaaugucggacauugccgaagaagaugccuggacaccgagcgcuauauccugcuguguagaaacaaacugaguugcuguauuucuaucaucucucacgaguacacaagacgaccggccuuuccggugauucaucuggaggacaucacccucgacuauagugacguugauucuuuuaccgguagccccguuuccaugcugaacgaccucauuaccuuugacacaacaaaguucggcgaaaccaugacccccgagacaaacacuccagagacaaccaugccaccaagcgaagcaaccacacccgaaaccaccaugccaccuagugagacagcaaccagugaaacuaugccuccaccaucucaaacagcacugacacauaauuag

SEQ ID NO: 14227 - RNA, 837 nt, Artificial Sequence
  Description of Artificial Sequence: Synthetic coding sequence
augggaggaccucgcgcucucuuggcagcauugugggcacuggaggccgcugggacugcugcucuaagaaucggugccuucaauauucagucuuucggggauuccaaggugucugaccccgcaugcggcucaauuaucgccaagaucuuggccggguacgauuuggcgcucguucaggaaguacgcgauccagaccuguccgccguuagcgcccugauggagcaaauuaauagugugucagagcaugaauauucguucguauccucucaaccacucgggagggaucaauauaaggaaauguacuuguucguguacaggaaggaugcugugucuguuguggacaccuaccuguauccagauccagaagacguguucagcagagagcccuucguugugaaauuuagcgcacccggcacugcccaaaaucuaguacugauaccacuacaugcagcuccacaucaggcuguggcagaaauagacgcacuuuaugauguauauuuggauguuauugacaaaugggggacggaugacaugcuuuuucucggggacuucaaugccgacuguaguuauguccgggcacaggauugggcagcaaucagacugagaucgucagaaguuuucaagugguuaauucccgauagugcggauaccacgguuggcaauucagacugugcauacgaucggauuguggcuugcggcgcuaggcucagaagauccuuaaaaccacaaucugcgacuguucacgacuuccaggaagaguucgggcuggaccagacgcaagcacuagcuauuagcgaccacuuuccuguugaggugacacucaaguuucauagguag

SEQ ID NO: 14228 - RNA, 3039 nt, Artificial Sequence
  Description of Artificial Sequence: Synthetic coding sequence
auggccgaagccgccuuggaagccgucaggucugaacugagagaguucccggcagcagcccgcgaacuguguguuccguuggccguuccauauuuggauaagccaccuacccccuugcauuuuuaucgggauuggguuugcccuaaucggcccugcauaauucggaaugcccugcaacauuggccagcucuacaaaaauggagccuacccuauuuccgcgcaaccguuggcucuacggaggugucuguggcuguuacucccgauggcuaugcugaugcagugcgaggugacagauuuaugaugcccgccgagaggagacugccgcugaguuucgugcuagaugugcuugaaggccgagcccaacauccaggagucuuauaugugcagaaacagugcuccaaccuacccagugaacugccacaguugcucccagaucuggaaagccacgugccuugggcaagcgaagccuugggaaagaugccagaugccgucaacuucuggcucggcgaagcugccgccgucacuagccuucauaaggaccacuacgaaaaccuuuauugcguugucucuggugagaaacauuuucuguuccacccaccuagcgaucgcccauuuauuccauacgaauuauacaccccagcuaccuaccagcucacagaagaggggacguuuaaagucguggacgaggaggcaauggaaaaagcugagguuucucgaacaugcuuacugacaguuagaguacuucaagcccaccgucucccaucaaaggaccuuguuaccccuagcgacugcuauguuacccuguggcugccaaccgcuugcucacacagacugcagacucgaaccguuaaaaacagcuccuccccuguguggaaccagagcuuucauuuccgcauucauagacagcugaaaaaugucauggaacugaagguguucgaucaggaucuugugaccggugaugacccuguccucuccguauuauucgacgccggaacgcuucgugccggggaauuuagaagagaaucuuuuucacugagcccgcagggagaaggacgucuagagguggaauucagauuacagagucuagccgauagaggggaguggcuuguaagcaacggaguccucguugcuagagagcuuagcugccuucauguucagcuggaggaaacaggugaucagaaguccagcgaacauagaguucagcuggucguacccggcagcugcgagggaccgcaggaagccuccguaggcacagggaccuucagauuucacuguccagccuguugggagcaggaguugucuauacggcugcaggaugccccugaggaacaacugaaagccccccugagcgcccugccuaguggccaagucguccggcugguauucccuaccucacaggagccguuaaugcgugucgagcugaagaaggaagccggacuuagagaacuugcuguccgccuggguuucgggcccugugcugaagagcaagccuuccuuucaaggcgcaaacaggucgucgcggcggcacugcggcaggcccugcaacuugacggcgauuuacaggaggacgaaauccccguuguggccauuauggccacuggaggaggaaucagagccaugacaucacuguaugggcaacuagccggcuuaaaagaguuaggacuauuagauugugugucuuauauuaccggcgcaucagguucaacaugggcccuugccaacuuguacgaggaccccgaguggagccagaaggaccuugccgggccuacugaacuccugaagacccaggugacaaaaaacaagcucggggugcuggcccccagucaacugcagcgauaccggcaagagcucgccgaaagggcuagacucggcuacccuagcugcuuuacaaaucuuugggcauugaucaacgaggcauuacuucacgacgaaccucacgaccacaaacucagcgaccagcgugaagcucucagccacgggcaaaauccauuaccuaucuacugcgcccugaacacaaaaggucagucucuuacgacauucgaauucggugaauggugugaauucucaccuuaugaagucgguuuucccaaguacggcgcauuuauccccagcgaauuguucgguagugaauuuuucaugggccaacuaaugaaacgcuuacccgaaucucgcauaugcuuccucgaagguaucuggucuaaucucuacgccgcuaauuugcaagacagucucuacugggccucagagccaucacaauucugggauagauggguacggaaccaagcaaacuuggauaaagagcaggugccccugcuuaaaauugaagagccgccauccacugccggaaggauugccgaguucuucacagaucuuuuaacguggcgcccucuggcccaggccacacacaacuuucuaaggggacuacacuuccacaaagacuacuuucagcacccccauuuuucuaccuggaaggcaacgacacuagacggacugcccaaucagcucacgccuucagagccccaccuguguuuguuggauguaggauauuuaaucaauacaucaugccuaccuuugcuucaaccaaccagagauguggaccuuauccucucccucgacuacaauuugcacggggccuuucagcaacuucagcugcucggccgguuuugucaagaacagggaauaccuuuuccuccuauaagcccuagcccagaggaacaguuacagccaagggaaugucacacuuuuagcgauccaaccugucccggagccccugcaguuuuacauuucccccuuguuagugacucuuucagggaauauuccgcgcccgguguaaggcgaacacccgaagaggccgcagccggugaggugaaucugagcucuuccgauagccccuaccacuauaccaaggucaccuacagccaggaagauguggacaaacuucugcaccugacucauuauaacgugugcaauaaccaggaacaacugcuagaggcucugagacaagcaguacagagacgcagacagcgacgaccccacuag

SEQ ID NO: 14229 - RNA, 1548 nt, Artificial Sequence
  Description of Artificial Sequence: Synthetic coding sequence
auggcauggcccuacuuccuagacugccauagauacuuuacgagagaagacgaaggauguuaugacccccuagaaaagcuucgcggcggccuggaagccgacgaagcccugcccagcgggcugccacccacauuuauuagauucucccaccacuccuacgcccagaugguccgggugcugaggagaacugccucccguugcgcucacgucgcaaggacauacucuaucggaagaucguuugauggucgagaauuguuggucauugaauuuaguucccgcccaggacaacacgaguuaauggagcccgaggucaaauuaauugggaacauucauggaaaugaaguugcuggucgcgaaaugcugaucuaucucgcucaauaucuguguucagaauacuugcucgggaacccccgcauacaaaggcugcuuaauaccaccagaauucacuugcuuccgucaaugaaccccgacggauaugagguagcugccgcugagggagcuggcuacaaugguuggacgagcggacgccaaaacgcucagaaccucgaccugaaccggaacuucccagauuuaacaagcgaauacuauagguuggccgagaccagaggagcccgaagcgaucauaucccaaucccucaacacuacuggugggggaagguagcccccgaaaccaaagccaucaugaaauggaugcagacaauuccuuuugugcugucagcaagccugcauggaggugaucuugucgucuccuacccauuugauuucucaaagcacccucaagaagagaagauguucucgcccaccccagaugaaaagauguuuaaacugcugucaagagccuacgcugacguucacccuaugaugauggauagaucagaaaaucgcuguggcgguaacuuccuaaagagaggauccauuauaaacggagcugacugguacucguucaccggcggcaugagcgauuucaauuaccugcacacuaacugcuuugagauuaccgucgaacucgggugugugaaauucccuccagaggaagcccuguacauccuguggcaacacaacaaggaaucuuuauuaaacuucgucgaaacuguucacagagggauaaagggcgugguaacagauaaauucggaaagccagucaagaacgcucgcaucucagucaaagggauucgccacgacauaaccacggcgccagacggggauuauuggcgucuauuaccccccggcauucacauugugauugcgcaggcccccggcuaugccaagguaauaaagaagguuaucauucccgcccggaugaagagagcugggcgagucgauuuuauacuccagccacugggcauggguccaaagaauuucauccacggccuuagacgcacuggcccacacgacccacucggcggcgccuccucccuaggggaagccacagaaccagauccgcuucgugcgcgaagacaacccucugcugauggaucaaaaccuuggugguggucauacuucaccucucuuucuacacaucgaccacgcuggcugcugaaauacuag

SEQ ID NO: 14230 - RNA, 285 nt, Artificial Sequence; identical to SEQ ID NO: 12591
  Description of Artificial Sequence: Synthetic coding sequence

SEQ ID NO: 14231 - RNA, 420 nt, Artificial Sequence
  Description of Artificial Sequence: Synthetic coding sequence
augggcaauccagguggaguuggcagcgaacgcaugagaguugcuaggcguacaagaaaugucuguagaugcccuagggccgcaggaccaggaguccccgaacccagagccgcuccccucccacuccuggcuauggcucccccgccugcgugccgaucccccaugucucccccgccuccgccgcuacugcuguuacugcugagccuugcccugcugggugcucgugcccgcgcugaaccugcaggaucugccgugccagcccagucuagaccaugcguggauugucacgcguuugaguuuaugcagcgggcacuccaggaccuuagaaagacagccuguucacuggacgcaagaaccgagacauugcuucuucaggcugagagacgagcucuuugugcaugcuggcccgccggacacuag

SEQ ID NO: 14232 - RNA, 471 nt, Artificial Sequence
  Description of Artificial Sequence: Synthetic coding sequence
auggcucccgcaguuacccgccuucuguuccuucagcuggugcugggaccuacccuggugauggacauuaaaaugcaaauaggaucucgaaacuucuacacacugucuauagauuauccucgcguuaauuacccaaagggcuuccggggcuacuguaauggccucaugagcuauaugagggggaaaaugcagaauucagauugcccaaaaauacacuacgugauucacgcucccuggaaagcgauucagaaguuuugcaaguacucagacucguuuugugagaacuauaaugaauacuguacacugacacaagauucucugcccaucaccgucugcucccuuucacaucagcagccaccuaccucuugcuacuauaacucaacauuaaccaaccagaaacuauauuuacuaugcucaagaaaguaugaagcagauccgaucgguaucgccggccuguauagcgggaucuag

SEQ ID NO: 14233 - RNA, 444 nt, Artificial Sequence
  Description of Artificial Sequence: Synthetic coding sequence
augaucaucaugguuauaauauuccuagucuuguuauuuugggaaaaugaaguaaaugacgaagccgugauguccacuuuggagcacuugcacguagacuauccacagaacgacguccccgugcccgcacgauacugcaaucacaugaucauccaaagagugauucgagaacccgaccacacaugcaaaaaggaacacguguucauucaugaaagaccgcgcaaaauuaacgggauuugcaucucucccaaaaaagucgccugucagaaucucuccgccaucuucuguuuccaaucggagaccaaguuuaaaaugaccguuugccagcucauugagggaacucgcuacccagccugcagguaccacuacucucccaccgaaggauucguucuggugacuugugacgacuuacgacccgacagcuuuuugggauaugugaaguag

SEQ ID NO: 14234 - RNA, 453 nt, Artificial Sequence
  Description of Artificial Sequence: Synthetic coding sequence
augagguuuauggccggccccgccgggucccaaagcuugggcccccuuuguuuccacucuaguccucaggcacuguacaccguauugcuaauaguuuuaguaaugaugucucuaguauucggaaaguucgugcccgucaacugggaaccaccccagccucugcccuucccuaaguaucuccgcugcuauaggugccugcuggagacgaaagaacuaggcugucuccuuggaucagacaucugccugacacccgcaggcucuuccuguauuacacugcacaaaaagaauaguuccggcucugaugugaugguuagugauugccgcuccaaggaacagaugucagacugcagcaacacucggaccuccccugugucagguuuuuggauuuuuucacaguauuguuucuuagauuucuguaacgacccucagaaccgcgggcucuacaccccuuag

SEQ ID NO: 14235 - RNA, 2742 nt, Artificial Sequence
  Description of Artificial Sequence: Synthetic coding sequence
augggacccgaagccuuguccucccucuuacugcuucugcucgucgcuuccggcgaugcagacaugaaaggacauuuugaucccgccaaaugcagauaugcucucggcaugcaggacagaacaauccccgacagcgacauuucagcuucaagcagcuggagugauucgacggcagcccgacauagcagauuggaaaguagcgacggagauggugccuggugcccagcuggcucuguguuuccgaaggaagaggaguauuuacagguagaccugcagagacugcaccuuguggcccucgucgggacucagggaaggcacgccggagggcucggcaaagaguucagccggagcuauaggcugcgauauucucgcgauggaaggagauggaugggauggaaagaucgauggggacaggaagugaucucaggaaaugaggacccugaaggcguaguacugaaagaccugggcccuccuaugguggcucggcuggugagguuuuauccccgugccgauagagucaugaguguuugcuugcggguugagcuguacgguugcuuguggcgggacggccuguuauccuauacagcgccagucggccagaccauguacuugagcgaagccgucuacuugaaugauaguacuuaugacgggcacacaguaggcggcuuacaauauggcggccucggucaacucgcggauggggucgucggacuugacgauuuuaggaaaagccaagaguuacgcguauggccuggcuacgauuacgugggcuggaguaaccauucuuuuucauccggauacgucgaaauggaauucgaauucgacaggcugcgcgcauuucaggcuaugcagguccacuguaauaauaugcacacucucggggccagacugcccgguggcguagagugucguuuccgccgcggucccgccauggcuugggaaggcgagccuaugagacauaaccucggugguaaccugggggaucccagagcaagagccgucucaguaccccugggugguagaguggccagauuucugcagugccguuuccuuuuugcugguccuugguugcucuucucagaaauuucauuuauaagcgaugucgucaacaacuccucaccagcccucggaggcacauuuccucccgcaccuugguggcccccugguccuccucccaccaacuucucgagccuggagcuagaaccucgcggucagcaacccguagcaaaagccgagggaucaccaacagccaucuugauaggaugucuaguggccauuauucuccuccugcuucuuauuauugcgcucaugcuguggcgacuucacuggagaagguuauugagcaaagcagaacguaggguucuugaggaggagcugacaguucaucucucagugccuggcgacacaauuuugaucaauaaucguccugggccccgugaaccaccaccauaucaagaaccucggccucgcggaaacccuccucacucagccccgugcgugccaaauggcuccgcccugcugcugaguaaucccgcuuauagacuccuguuagcaacuuacgcccggccacccagagguccaggacccccaacacccgcuugggcaaagccaaccaauacucaagcguauucaggcgauuauauggagccagaaaagcccggugcccccuuacuuccacccccaccacaaaacagcgugccccacuacgccgaagccgacauaguuacccuccaaggaguuacugggggcaacacauaugccgugccagcacucccccccggcgcugugggcgauggaccaccccggguggacuuuccacggucccggcuuagguucaaagaaaaauuaggcgaagggcaguuuggcgaaguucauuuaugugaaguugacucuccucaagaucuugucucucuggauuucccacuaaacgugcgaaaaggacacccccuacucguagcuguuaagauccugaggccugacgcuaccaagaacgcccgcaacgacuuucucaaagagguuaaaaucauguccaggcugaaggaucccaauauuauacggcuucucgggguuugcgugcaggacgauccucuguguaugaucacugauuauauggaaaacggcgaccuuaaccaguucuugagcgcacaucaguuagaagauaaagcggcagaaggcgcucccggcgauggacaagccgcucaagggccaaccauuagcuauccaaugcuccuacacguggccgcgcaaaucgcuaguggaaugagauaccucgccacucugaauuuuguacaccgcgaccuugcaacacggaauuguuuagugggagagaauuuuaccaucaaaaucgcggacuuugggauguccagaaaccuauacgccggcgacuauuaucgcgugcaggguagagcugugcucccuauacgguggauggcuugggaaugcauucugauggggaaauuuaccacagccucugaugucugggcauucggaguaaccuuaugggaaguccuaaugcugugucgugcccaacccuucggucagcugacggacgaacagguuauagagaacgccggagaguucuuucgggaucagggucggcagguguaucugagcagaccgccggcaugcccucagggcuuguacgaauugaugcugcgaugcuggucacgcgagucagaacaaagaccuccauuuagucagcuucacagauuccucgccgaagacgcccugaacaccguguag

SEQ ID NO: 14236 - RNA, 453 nt, Artificial Sequence
  Description of Artificial Sequence: Synthetic coding sequence
augagauuuauggcgggcccugccggcucccaaucacuggguccucucuguuuucacucuuccccccaggcacucuacaccguucugcugaucgugcuggucaugaugagccucguuuucgguaaguuugugcccgucaacugggaacccccacagccauuaccuuucccuaaguauuugcgcugcuauagguguuugcucgaaacaaaagaacugggcugucuucucgguucugacauuugcuugacaccagccggcuccucauguaucacgcugcacaagaaaaacuccucaggcuccgacguuaugguguccgauugcagaucaaaagaacaaauguccgauugcucuaacacacgcaccucaccagugucaggauuuuggaucuuuucucaguauugcuucuuagacuuuuguaacgauccacaaaauaggggcuuguacacuccguag

SEQ ID NO: 14237 - RNA, 567 nt, Artificial Sequence
  Description of Artificial Sequence: Synthetic coding sequence
auguuccaccaaaucugggcugcgcuccucuauuucuacggcaucauucuuaauucuaucuaucagugcccugaacauagucagcugaccacccucggcgucgacggcaaggaguuuccugaggugcaucucggacagugguacuucauagccggcgcugccccaacuaaagaggaacuggcuacuuucgacccaguagauaacauaguauuuaauauggccgcuggaucagcaccaaugcaguugcaccuacgagccacgauccgaaugaaagacggacugugcgucccacgcaaguggauuuaccaccugaccgagggcucuaccgaucugagaaccgagggcagaccagauaugaaaacagaauuguucucauccagcuguccgggcgggaucauguugaacgaaaccggccagggcuaccaacgcuuucuacuuuacaaccgauccccccacccucccgagaagugcguggaagaguucaaaucccugacgaguugccuugauagcaaagcuuuucuguugacaccucgcaaccaagaggccugcgaacuuuccaauaauuag

SEQ ID NO: 14238 - RNA, 2535 nt, Artificial Sequence
  Description of Artificial Sequence: Synthetic coding sequence
augggcccaggagcaccguuugcaagagugggcuggccuuugccccugcuugugguuauggcagcaggaguggcaccaguaugggccucucacaguccgcaccucccuaggccacauucccgaguccccccccacccuuccuccgagcgccgggcaguguauauuggggcccuguuuccuaugucaggaggauggccagguggucaggcuugccaacccgcaguagagauggcgcuggaagaugucaacuccaggcgagauauccucccagauuacgaacuuaagcucauccaucaugacaguaagugcgauccuggccaagcuacuaaguaccuuuaugaacuccuuuacaacgauccaaucaaaauuaucuugaugcccgguugcucuuccguaucaacauugguggcagaggcagccagaauguggaaccugauaguccucuccuauggaaguucuucgccugcauugagcaaucgccagagguucccaacuuucuuucgaacccaccccagugcuacccugcauaacccuacacgggugaaacuguuugagaaaugggguuggaagaagauugcuaccauucaacagaccaccgaagucuucacauccacgcucgacgauuuggaagagagaguuaaagaggccgguauugagauaacguucagacagucuuuuuucucugauccugcugugccugugaaaaaccuaaaacgccaggacgccaggauuaucgugggacuguucuaugagaccgaagcccggaaaguguuuugugaggucuauaaggagagauuguuuggcaaaaaguacgucugguuucucauugggugguaugcagauaauugguuuaaaaucuacgacccguccauuaacuguaccguugacgagaugacugaggcagucgaaggccacaucaccaccgagauagucaugcucaauccagcaaacacaaggucuaucagcaauaugacaagccaggaauucgucgaaaagcugacaaagaggcugaagcgucaccccgaagaaacaggaggguuucaggaggccccucuggccuaugacgcuauaugggcacuugcucuagcuuugaauaaaaccagugggggaggcgguagaucugggguuagacuugaggacuucaauuacaauaaccagacaauaaccgaucaaauauauagagccaugaauagcucuuccuuugaaggcgugucuggacacguggucuuugaugcaagcgggagcaggauggccuggacucuuaucgagcagcugcagggaggauccuacaagaaaauuggcuauuaugacucuacaaaagaugauuugaguuggagcaaaacggauaaguggaucggggguuccccaccggcggaucagaccuuggugaucaaaacuuuuagauuccuuucacaaaaacucuuuauuagugucucuguguuaucaagccugggcauuguacuggcuguugugugccuaucauuuaacauuuacaauucccacguccgguauauccagaacagucaaccuaaucugaacaaucugacagccgugggauguucacuugcucucgcugccguguuuccucuuggucuagauggcuaucauaucggaaggaaccaguuuccauuugucugucaagcccgacuguggcugcuaggacugggauuuagucucgguuacggaucuauguucacgaagaucuggugggugcauacaguguucacuaagaaagaagaaaagaaggaauggagaaagacacucgaacccuggaaauuguacgcaaccgucggcuuacucguggggauggacgugcugacauuggcaauauggcagauuguggauccuuuacacagaacaauugaaacauucgcuaaagaggaaccuaaagaggacauugacgucuccauucucccacaguuggaacauuguucaagccguaagaugaacacuuggcucggaauuuuuuauggguacaagggccuccugcuucuauuggguauuuuccuugcauacgaaacaaaaucaguuagcaccgaaaaaauuaacgaccaccgggcugucggaauggcuauuuacaacguugcugugcuuugccugauaacugcccccguuacaaugaucuuaaguucucaacaggaugcagcguuugccuuugcuucgcuugccauuguauuuaguucauauaucacccugguuguccuauuugugccuaagaugcguagauugauuacucgcggagaauggcaaucagaggcucaggacacuaugaaaacuggcagcucuacaaauaacaacgaagaagagaaguccaggcuccucgaaaaggagaaccgugagcuggaaaagauaauugccgaaaaagaagagcgcguuuccgagcuccggcaccaauugcaauccagacaacagcuaagaagcaggcgacacccaccaacaccaccagaacccagcggcggccuuccacggggaccuccagagccaccugaccgccuguccugcgacggaucaaggguccaccuguuauacaaguag

SEQ ID NO: 14239 - RNA, 237 nt, Artificial Sequence; identical to SEQ ID NO: 12600
  Description of Artificial Sequence: Synthetic coding sequence

SEQ ID NO: 14240 - RNA, 2700 nt, Artificial Sequence
  Description of Artificial Sequence: Synthetic coding sequence
auguugcuccuauuguugcuggccccauuguuccugaggccgcccggugccggcggagcccagacucccaacgccacaagcgagggaugucaaaucauucaccccccuugggaggguggcauuagguaccgcggacugacaagagaccaaguaaaagcuaucaacuuucugcccguggacuaugagauagaauauguguguagaggagagagagaggugguugggccaaaagucagaaaaugccuggccaaugguucuuggaccgauauggacacuccauccagaugcgugaaccgcacaccacacagcgaaagacgugcagucuauauuggcgcccucuucccuaugucaggcggauggccaggaggccaagcaugccagcccgcugucgaaauggcgcucgaggacgugaacuccagacgggauauucuucccgauuaugagcugaagcugauucaucacgauuccaaaugcgaccccggucaggccacaaaauaucucuacgagcuucuuuacaacgacccuaucaagauuauccugaugcccggaugcagcucugugucuacucuuguggcugaggccgcuaggauguggaacuugauugugcuguccuaugguucuucaucuccugcgcuuucuaacagacagagauucccaacuuuuuuccgcacacauccuucugcuaccuugcauaacccaacccgugugaaguuguuugagaaguggggcuggaaaaaaaucgcaacuauucaacagaccaccgagguuuucaccagcacucucgacgaucuggaggaacgggugaaagaggccggcaucgaaaucaccuuccgacagucauucuucucagaucccgcagugccuguaaaaaaucuuaaaagacaggaugcgagaauuauagugggccuguucuacgaaaccgaggcaagaaaggucuucugcgaaguguacaaagaacggcuguucggcaagaaguacguaugguuuuuaauagguugguacgcagacaauugguucaagaucuaugauccauccauuaauuguacagucgacgaaaugacagaagcagucgagggccauauaacuaccgaaauuguaaugcucaauccugccaacacaagaaguaucagcaacaugacaagucaagaauuuguugaaaagcuuacgaaaagacucaagagacauccugaggaaacugguggcuuccaggaggcaccgcuggcauacgacgcuaucugggcuuuagcacuggcuuuaaauaagacgucugguggcgggggaaggagcggggugcgccucgaagacuuuaauuauaacaaucaaaccauuacagaucagauuuauagagccaugaauucgucuagcuuugaggggguaagcgggcauguaguauuugaugccagcggcaguagaauggcuuggacacugauagagcagcuccaaggaggguccuauaagaagaucggguauuaugacuccacaaaggaugaucuaagcuggaguaagaccgauaaguggauuggcggaucuccaccagccgaccaaacgcucgugaucaaaaccuuccgcuuccucucucagaaacuuuuuauuuccguuagugugcugaguagccucggaauaguccuugccgucguaugccucagcuucaacauuuauaauucccacguuagauacauucagaacucucagcccaaccucaacaauuugaccgcggucggcuguagccucgccuuggccgccguguucccccucggacucgacggcuaucauaucggaaggaaccaguucccguucgugugccaagcccgauuguggcuccugggucucggauuuucucucggauaugguuccauguucacaaaaauauggugggugcauacagucuuuacaaaaaaggaggaaaaaaaagaguggagaaagacucuugagccguggaaacuuuacgcaacagugggauugcucgugggaauggacgugcuaacucuggccauuuggcagauuguggauccccuccaucgcaccauagaaacauuugcaaaagaggagccaaaagaagacaucgauguuuccauauuaccacaacuugaacauugcagcucccgcaagaugaauacauggcuagggauauucuacgguuauaagggauuacugcuccugcuaggcauuuuucuggcuuacgaaacaaagaguguaucuacugaaaagaucaaugaucaccgcgcugugggcauggccaucuacaacguugcaguucuaugccucauaacugccccuguuacuaugaucuuauccucgcagcaggaugccgccuucgccuucgcuucacuggccauuguuuuuucuucauacaucacucuggugguacuguuugucccuaagaugagaagacugauuacuagaggugaauggcaguccgaagcccaagauaccaugaagacaggguccuccacuaacaacaacgaagaagagaaaagucgccuucuugaaaaggaaaaucgagagcuugaaaaaaucaucgcugaaaaggaggaaagagugucugaguuacgccaccaguugcaguccagacaacagcuacgcaguaggcgccauccacccaccccccccgagccaucuggaggauuaccaaggggcccccccgagccaccagaucgccuaagcugugacggaagccgggugcaucuccuguacaaguag

SEQ ID NO: 14241 - RNA, 2886 nt, Artificial Sequence
  Description of Artificial Sequence: Synthetic coding sequence
augcuacuuuuacuccuacuggcucccuuauuccugcgcccgcccggggccggaggugcccagacgcccaacgccacuucugaggguugucagauaauacauccgccaugggaaggaggcauucgguacaggggucugacacgcgaucagguuaaagccaucaauuuucuccccguagauuaugaaauugaguaugugugccgcggcgaaagagaggucguugguccuaaaguucggaaaugucuggcgaauggcucuuggacugacauggauacuccgagcagaugcguucggaucuguuccaaaucuuacuugacccuggaaaacggaaaagucuuucucacaggcggcgaccucccugcucuggacggcgcgcgcguggacuucagaugugaccccgauuuucaccuuguagguagcucgagaagcauuuguagucaaggccaguggucuaccccgaagccucacugucagguuaacagaacuccacacagcgagagacgcgccguuuauauuggggcacuguucccuaugucuggcggcuggcccggcggccaggcuugucaacccgccguggagauggcacuggaagaugugaauagcaggagagauauauuacccgacuacgaacugaaguuaauucaccaugacaguaagugcgauccuggacaggccacaaaauaccuguacgaacuguuauauaacgaucccauuaagauaauacugaugccagguugcucuuccguuuccacccuggucgcugaggcagcucgaauguggaaccugaucguacuuucuuauggaucuuccuccccggcccucagcaaucgccagcgauuucccacauuuuucagaacccaccccucugccacacugcacaauccaacacgagugaaacucuuugagaaauggggcuggaaaaaaaucgcaacgauucagcagacgaccgaaguguuuacaaguacccuggacgaccuggaggaaagaguuaaagaggccgggauagagaucaccuuccgccagucguuuuucagugaucccgccgucccuguuaaaaauuugaagcggcaagaugcucgaauuaucgucgggcuguucuacgaaacagaggcgcgcaaaguuuucugcgagguuuauaaggagagacucuucgggaaaaaguacguuugguuccugauaggcugguaugcugacaauugguucaaaauuuaugacccuagcaucaacugcacuguggaugaaaugacggaggccgucgaagggcauauuaccacugaaauugucaugcucaacccagcuaauacccgcucaaucuccaauaugacaucccaagaauuuguggaaaagcugaccaaacgucucaaaaggcaucccgaggagaccggcgguuuccaagaggcaccacuugcuuaugaugcaauaugggcucuggcuuuggccuugaacaaaacaagcgggggaggaggaagaucuggcgugcgucuggaggauuuuaacuauaauaaucagaccauuaccgaccagauuuaccgagcuaugaauucuucguccuuugaggguguguccggacacgugguguuugaugccuccggcucuagaauggcauggacccuuauugagcaacugcagggugggucuuacaagaaaauugguuacuacgacagcacaaaagaugaucuaucuuggucuaagaccgacaaguggauaggagggucaccacccgcugaccagacucugguaaucaagacauuccgcuuccugagucaaaaacuguucauuagcgugucuguucuuucuagccugggcauugugcucgcugucguuugccuaagcuucaacaucuacaacucccauguucgcuauauccagaacucucagccaaaucuaaacaaucuuacagcaguuggguguucucuugccuuggcagccguguuuccucucggccuggacggguaccacaucggccgcaaccaauucccuuuugugugucaagcuagacucugguuauuaggcuugggguuuucucuggguuacggguccauguuuacuaagaucugguggguccauacaguuuucacuaagaaggaagaaaaaaaagaauggagaaaaacgcuugaacccuggaaguuguaugccacagucggacuguugguggguauggaugucuugacucuugcuauauggcagaucguggauccccugcacaggacaaucgagacguuugcaaaagaagaaccgaaggaagauauagauguguccauacucccucaacucgaacauugcucaucucggaagaugaauacuuggcucggaauuuuuuacggauauaaaggacuguugcugcugcuggguaucuuccucgcuuaugaaacaaaaagugucucuacggaaaagaucaacgaucaucgagccguuggcauggccauauacaacguugcugugcucugccugauuaccgcccccgugacuaugaucuugucaucccagcaggacgcagcauuugcguucgcaucccucgcuauugucuucucaucauauauaacuuuagugguguuauuugugccuaaaaugcgaagacuuaucacucguggagaauggcagucugaagcccaagauacuaugaagaccggaaguucgacaaauaacaaugaggaagaaaagagccggcuucuugaaaaagaaaauagagaguuagagaaaauuaucgcagagaaggaagaacgugucuccgaguuaagacaccaauugcagucuagacaacagcugaggagccgccggcauccacccaccccaccugagccaaguggaggauuaccacgaggcccuccugagcccccugaccgccuguccugugacgggucacgcgugcaucugcuuuauaaauag

SEQ ID NO: 14242 - RNA, 2535 nt, Artificial Sequence
  Description of Artificial Sequence: Synthetic coding sequence
augggacccggugccccauuugcccgcguuggguggccucucccacugcuggucguuauggccgcugguguggccccggugugggcgucacacucaccccacuugccccguccucacucucguguaccaccccacccgagcuccgaaaggcgagccguauauauaggcgcccuuuuccccaugucugguggguggcccggaggccaggccugucagcccgccgucgagauggcacuggaagacguuaauucccgcagagacauacucccugauuaugaacugaaacugauucaucacgacuccaaaugcgacccuggccaggcaaccaaguaccuguacgaacugcuguacaaugacccaaucaaaauuauucugaugccaggcuguucauccguuucuacauuagucgccgaagccgcgagaauguggaauuuaaucguccuaaguuaugggaguucuaguccggcacugucuaaccgucaaagauuuccuacuuuuuuccggacccauccgucggcaacccuccacaauccuacacgcguaaagcuauucgagaaauggggauggaagaaaauugcaaccauacagcagacaaccgagguauucacuucuacuuuagaugaucucgaggaacgugugaaagaagcuggaauugagauuacauuccgccaauccuucuuuucugaccccgccguaccggucaaaaaucuuaagcgucaggacgcgcguaucauuguggggcuguucuacgagacagaggcaaggaagguguuuugugaaguguacaaggagcgauuauuugggaaaaaguacguuugguuucugaucgggugguacgcggauaauugguuuaaaaucuacgauccaucgauaaacugcacuguggacgaaaugacugaggccguggagggacauaucaccacagagauagugauguugaauccagccaacacucgaucgaucucaaacaugacaagccaagaauuugucgaaaaacucaccaaaagauugaaacggcauccagaggaaacaggcgguuuucaagaggcaccacuggcauacgacgcaauuugggcucuggcucuggcgcucaacaagacuuccggaggagguggccggagcggagucaggcuagaagauuuuaacuauaauaaccagacuaucacagaucagaucuaccgugcaaugaacaguaguagcuucgaagggguuucagggcacguuguuuuugacgccagcgguagcaggauggcuuggacuuuaauagaacagcuccaagggggcucauacaagaagaucggauauuaugauucuacaaaggacgaccucaguugguccaagacagacaaguggaucggcggcagcccucccgccgaccagacccuggucauuaagacguucagguucuuaucucagaaauuauucaucucuguauccguccuguccagucucggcauuguauuagcggugguuugccucaguuucaacauuuacaauucccaugugcgguacauucagaauucacagccaaaucucaauaaccugaccgcggucggaugcucucuugcccuagcugccguguuuccccuaggucuggacggguaucacaucgggcggaaucaauucccauucgugugucaagcuagacuuuggcuccuuggacuugguuucucucugggauacgggucaauguuuacuaaaaucuggugggugcacaccguuuuuacaaaaaaggaggagaaaaaagaguggaggaaaacauuagagccauggaaauuauacgccacagucggucuucuggucgggauggaugugcuuacucucgcuaucuggcagaucguagauccuuuacauagaacuauagagaccuuugccaaagaagagccuaaagaagauaucgacguuaguaucuuaccucagcuugaacacugcucaucuaggaagaugaacaccugguuggggaucuuuuacggcuacaagggacuguuacugcugcugggcauuuuccuugcuuaugaaacaaaguccguauccaccgagaaaauuaaugaucaccgggccgucggaauggcuauuuacaauguugccgugcuguguuugauaacagcccccguaacaaugauucuaagcucacagcaggacgcugccuuugcuuuugcaagucuggcaaucguauuuagcucauacauuacgcuggucguacucuucgucccuaagaugcgucgucugauaacaaggggugaauggcaaucugaggcccaggacacaaugaaaacaggaagcucuaccaacaacaacgaagaagagaaaagccgguugcuugaaaaagagaaucgagaacuagagaaaaucauugccgagaaggaagaaagaguaucagagcuacgucaucagcuucagucaagacaacagcugagaucucgaagacacccucccacuccaccagagccuuccggaggccugccccguggcccgcccgagcccccggacagacuguccugugacgguagccguguacauuuacuguauaaguag

SEQ ID NO: 14243 - RNA, 2535 nt, Artificial Sequence
  Description of Artificial Sequence: Synthetic coding sequence
auggggccuggugcccccuuugcccgcgugggcuggccacuuccccugcuugucguaauggccgccggcguagcucccgucugggccagucacucuccucaccugcccaggccgcacagucguguuccaccccaucccuccagugaacgucgcgcaguauacauaggagcuuuauuuccgaugagcggcggguggcccggaggacaggcaugucagccagcuguugaaauggcacuugaggacgucaauagcagaagagauauccuacccgacuacgagcugaaacugauccaccaugacucaaaaugugauccaggacaggccaccaaguaccucuaugagcugcuguacaaugacccaaucaaaauaauccuuaugccaggcugcuccucaguaucaacccucguggcggaggccgccagaauguggaaccugauuguccugucuuacggcucuucuucuccugccuuaucuaacagacaacgcuuccccaccuucuuccgaacacaccccuccgccacccuucauaauccaacuagagugaaacuuuuugagaaauggggcuggaaaaagauugccaccauccagcagacaacugaaguauuuacuuccacacuggaugaucuggaagagcgugugaaggaagccgggaucgaaauaacauucagacaguccuucuuuucagaucccgccgugcccgugaagaauuugaaacgccaagaugccaggaucauugugggccuguucuaugagaccgaggccaggaagguguucugugaaguguauaaagagagacucuuuggaaagaaguauguuugguuucuaauuggaugguaugcugauaauugguucaaaauuuaugauccauccauuaacuguacuguggaugaaaugacugaagcgguggaaggacauauuacuacagaaauuguuauguuaaauccggcuaauacccguuccauuucuaacaugacuagccaggaauucguggagaaacucaccaagagauugaagcgccaccccgaggaaaccggagguuuccaggaagcuccuuuggccuacgaugccauuugggcccucgcccuugcacuaaacaagacaucgggcggcggugggaggucuggaguacgauuagaagauuucaacuacaauaaccaaacaauuacugaucagaucuauagagccaugaauuccuccucauuugaaggaguaucugggcacguagucuucgacgcaagcggcaguagaauggcuuggacuuuaauagaacagcuucagggugguucuuacaagaaaauuggauauuacgauucaaccaaagacgaccugucuuggagcaaaacggacaaauggaucggaggcagccccccagccgaccaaacacuggugauuaagaccuucagguuucuaucccaaaaacuguucauuagcguuucuguccuuuccucccugggcauuguccucgcaguggugugucugucauuuaacaucuauaacagucacguucgcuacauacagaauucgcagcccaaucucaauaaucucaccgcagucggcugcagccuggcucuggcagcuguuuucccauuaggccuggacgguuaccauaucggacgcaaucaguucccuuuuguaugucaagcccgccuguggcuguuaggacucggcuuuucacugggcuacgguuccauguuuaccaagaucuggugggugcacacgguguuuacaaaaaaggaggaaaaaaaagaguggcgaaaaaccuuggaaccauggaagcuguaugcuacagucgguuugcugguuggcauggacgugcugacuuuggcuaucuggcaaauugucgacccacugcauaggacaaucgaaacguucgcaaaagaggaaccaaaagaagauaucgauguuagcauuuuaccgcagcucgaacacugcuccucccggaaaaugaacacauggcuuggaauuuuuuauggcuauaaaggucuucugcuccugcugggcaucuuucuugccuacgaaacaaaaagcguaucuaccgagaaaaucaacgaccaucgugccguaggcauggccaucuacaacguugcugugcugugucucaucaccgcaccugucacaaugauucugucuagccagcaggacgcugccuucgcuuuugccucguuagcaaucguuuucagcagcuauaucacucugguuguauuguuuguuccaaaaaugcgccggcuuaucacgcggggagaauggcaguccgaggcucaggauaccaugaaaacuggcucuaguacaaacaacaaugaagaagagaaaucuagauuauuggagaaggaaaaucgcgaguuggagaagauuaucgcugaaaaagaagaacgaguguccgaacugcgccaucaacuccaaucaaggcagcaguuaagaucucgacggcacccaccuaccccaccagagccuucuggcggucuuccuagaggucccccugaacccccagauaggcuaucuugcgauggcuccagaguacaccuuuuguauaaguag

SEQ ID NO: 14244 - RNA, 2700 nt, Artificial Sequence
  Description of Artificial Sequence: Synthetic coding sequence
augcuucugcuuuuacugcuggccccguuauucuuaagaccuccuggcgcugguggagcacaaacuccuaaugcuaccucugagggaugccagaucauucaccccccaugggaaggcggaaucagauaccgcggccugacucgggaccagguaaaggcgauuaauuuucugccugucgauuacgaaaucgaauauguauguagaggagagcgggaaguuguagguccuaaaguucguaaaugucuggcuaauggauccuggacugacauggauaccccuagucggugcgugaaucgcacgccacauuccgaacgccgagccguguacauuggagcccuauuccccaugucuggaggcuggccuggaggucaagcuugccagccggcaguggaaauggcacuagaagacguuaacagcagaagggauauucugccugauuacgagcugaaacucauucaucacgacaguaagugugaucccgggcaggcuacuaaauaccuauacgaauuacucuauaaugacccaauaaagaucaucuugaugcccgguugcucauccguaucuaccuuagucgccgaagccgcccgcauguggaaccuuaucguuuuaaguuacgguagcaguucccccgccuugaguaauaggcagagauuuccaaccuuuuucagaacacaucccuccgcaacucuccacaauccaacacgggugaagcuguucgagaaguggggguggaaaaagaucgccacaauacaacagaccacggaagucuuuacgaguaccuuagaugaccucgaggaacguguuaaagaagcuggcauagagauaacuuuucggcagucauucuuuucagacccggcaguucccgugaagaauuuaaagaggcaagacgcccggaucaucgugggacuguucuaugaaaccgaggcacgcaaaguauuuugcgaaguguauaaagagcggcucuucggcaaaaaguacguuugguuuuuaaucggaugguacgcugauaacugguucaagauuuacgauccuuccaucaacuguacagucgaugaaaugaccgaagcagucgaagggcauauuacaacugaaaucgucaugcugaacccagcgaacacaagaagcauuucuaauaugacgagucaagaguucguggagaagcuaacaaaaagacuuaaaaggcacccggaagaaacaggcggauuccaagaagcuccacuggccuacgacgccaucugggcucuggcucuggcucugaacaagaccucagguggugggggaagaagcgguguuagauuagaagacuuuaacuacaacaaucagacuaucaccgaucagauuuaucgugccaugaauuccagcuccuucgaaggugugagcgggcacguggucuucgacgcuuccggaucccgaauggcauggacccucaucgagcagcuccaaggcggcagcuacaaaaagauuggcuauuacgauucaacuaaagacgaccuguccuggucaaagacugacaaguggauuggcgguucuccuccugcagaccagacgcuugugauuaagacuuuucgguuccugagucagaaguuguuuaucagugugagcguacucucaagucugggcauagucuuagcagugguuugucuuucuuucaacaucuauaauucccacguccgguacauccaaaauucucaacccaaccugaauaaucuuacugcaguugguugcagucuggcccucgcugcagucuuuccucugggacuagacggcuaucacaucggcagaaaucaguucccuuuuguuugucaagcacgucuuuggcugcuaggccuuggcuucucguuaggguacggaucuauguuuacuaaaauuuggugggugcauaccguguuuaccaaaaaggaggaaaagaaagaauggaggaaaacgcuggagccauggaagcuuuacgccacugugggauuacuuguagggauggacguucugacucuggcaaucuggcaaaucguggacccucuucauagaacaauugaaaccuucgcuaaggaagaacccaaggaagauauugacguguccauccugccacaacuugagcauuguagcagucgaaaaaugaacacuuggcugggcauuuucuaugguuauaagggcuuacuccuccugcucgguauuuucuuggcauacgaaaccaaauccgugucaacagagaaaaucaaugaccaccgugcagucggcauggcuauauacaauguagcuguacuguguuuaauaaccgcaccggugacuaugauccuauccucucagcaagaugccgccuucgcuuucgccucccuugccauugucuucucaaguuauauaacacucgucguccuguuugucccuaaaaugcgacggcucauaacgagaggcgaauggcagucagaggcacaagauacuaugaagacaggcaguucaacuaauaauaaugaagaagagaaaaguagacucuuggagaaagagaaccgcgaacuugagaaaaucaucgcugaaaaggaagaacguguuuccgaacugagacaucaauuacagucgagacagcagcuacggucacgucgccauccccccacgccacccgaaccuuccggcggucugccacgggggcccccagaacccccugauaggcucucuugugacgguucaaggguacauuugcuguauaaauag

SEQ ID NO: 14245 - RNA, 2886 nt, Artificial Sequence
  Description of Artificial Sequence: Synthetic coding sequence
augcuucuguugcuucuccucgcacccuuguuuuugagaccaccuggcgcgggcggcgcccaaaccccaaacgcgaccagugagggcugucagauuauccaucccccaugggagggugguaucagguacagaggauugacuagggaccagguaaaagcaauaaauuuccuucccguagauuacgagaucgaguacguaugccgaggugagagggaggucgucggcccuaaagucagaaaaugucuugcgaacggauccuggacagacauggauaccccuucucgcugcgugaggauuugcaguaaaucuuaccugacccucgaaaauggcaagguuuuucuuacggggggugaucucccugcuuuggauggcgcacgaguggauuuuagaugugacccggacuuucaccuggugggaucgucgcgcagcauuugcucucagggacagugguccacuccaaaaccucacugucaggucaaucgcacaccacacuccgaacguagagcggucuauauuggagcacuguucccaauguccggcgguuggcccgguggucaggccugccaaccagccguugaaauggcacuugaggacguaaacagcaggcgagauauacugccugacuacgaauugaagcugauccaccaugauagcaaaugugaccccgggcaggccaccaaauaccuguacgaauugcuguauaaugaucccauuaaaauuauccugaugcccggauguuccucugugaguacccugguugccgaagcggcucggauguggaauuuaaucguguuaaguuauggaucaagcagcccagcucuuucuaaucgccagcgauuucccaccuucuuucggacccaccccagcgcuacucugcacaacccuacccgaguaaaacuguucgaaaaauggggguggaagaagaucgcgacaauucaacagacaaccgagguuuucacaaguacacuggaugaucuggaggaaagagugaaagaagcuggaauugagauuaccuuuaggcaguccuuuuuuagugauccagccguuccagugaaaaaccugaagagacaagacgcccgaauuauugugggcuuguucuaugaaaccgaagcuaggaaaguuuuuugcgagguguauaaggagcgacuguuuggaaagaaauaugugugguuucugaucgggugguacgcugauaacugguuuaaaaucuacgaucccuccauuaacuguacaguggaugagaugacagaagcaguugagggccauauuacuacagaaaucgugauguuaaacccugccaacacaaggaguauuaguaauaugacaagucaggaauuuguugagaagcuaaccaaacgcuugaagagacauccugaggagaccgggggauuccaggaagcaccuuuggccuacgacgccaucugggcccuugcucuggcacugaauaaaaccagcggaggaggagguaggucaggaguucgguuagaggacuuuaacuacaauaaccagaccauuaccgaccaaauauauagagcgaugaacucgagcucauucgagggaguuucggggcaugucguauuugaugcauccggcagucgcauggcauggacccucaucgagcaacugcaaggcgguuccuacaagaaaauuggcuauuaugauucaacaaaagacgaucucaguugguccaaaacagauaaauggaucggcgguucucccccugccgaccagacuuuggucaucaagacauuccgguuucucagucagaagcuguuuaucuccguaagcguucuuuccucccuuggaaucguucuggcugucguaugccuuuccuuuaauaucuacaauagucacgugcguuauauucaaaauucacagccuaaccuuaacaaccucacugccgucgggugcucucuugcucuugcugcaguuuuuccccugggucucgacgguuaccauaucggccguaaucaguuucccuuuguaugccaggcucgacuuuggcugcuuggauugggcuuuucacugggcuacggcuccauguucacuaaaauuuggugggugcacacgguuuuuacuaagaaggaggagaagaaggaguggcggaagacacuugagcccuggaaauuguacgcaaccgugggauuauuaguggggauggaugugcugacccucgccauuuggcagauuguagaccccuugcaucggacuauugagacuuucgcuaaggaagaaccgaaagaagauaucgaugucucuauucucccucaacuggaacauugcagcucccgcaaaaugaacacguggcucgggauuuucuauggauauaaaggcuuguuacugcuguugggaauauuuuuggcauacgagacaaaaucagugagcacggaaaaaauuaaugaucacagggccgucggcauggcgaucuauaacguggcugucuuaugccuaauuaccgcacccgugacaaugauacuguccucccaacaggaugccgcauuugcuuucgccucucucgccauagucuucucgaguuauaucacccugguagucuuguucgugcccaaaaugcggcgguuaauuacgaggggggaauggcaaucugaagcucaggacacaaugaaaaccggaucaaguacgaauaacaaugaagaagaaaaaucaagacugcuggagaaggagaaucgggagcuugagaagaucaucgcagagaaggaggaaagaguaagugaacugcgucaccagcuucagagucggcagcaacuuagaucuaggagacaucccccuacccccccagaaccaucaggugggcugccucgaggcccacccgagccccccgaucgacuuagcugugacggaucccgcgugcacuuguuauacaaauag

SEQ ID NO: 14246 - RNA, 2535 nt, Artificial Sequence
  Description of Artificial Sequence: Synthetic coding sequence
augggaccuggcgcaccuuuugcucgaguuggcuggccacuaccucuguuaguagugauggcugccggcguggcgccugucugggcaagucauucuccucaccucccuagaccucauagccgcgugccuccacauccuaguuccgaacgaagggccguuuauaucggagcacuauucccuaugucuggaggauggccuggagggcaggcgugccagcccgccgucgagauggcuuuagaagacguuaauucacgccgggacauucuccccgacuaugaacugaagcuaauccaccacgauucuaagugugacccaggccaggcuaccaaauacuuguacgagcuuuuauacaacgaccccaucaaaauaauccuuaugccagguugcuccuccgucaguacacucguggcugaagcagccaggauguggaaccuuauaguacucaguuauggcuccagcucccccgcacuguccaacagacaacgguucccgacuuuuuuucgcacccauccuucagccacacuacacaacccuacgcgcgucaagcuguuugagaaguggggcuggaagaaaaucgcaacgauucagcaaacgaccgagguguucacauccacucuggacgaucucgaagaacgaguuaaggaggcuggcaucgaaaucacauucaggcagucguuuuuuagcgacccagcuguucccguaaagaacuuaaagagacaagacgcuagaauaaucguuggccuauuuuaugagaccgaggcaagaaagguauuuugcgaaguguauaaggaacgacucuucggaaaaaaauacguaugguuucuaaucggcugguacgcugacaauugguucaaaauuuaugaucccucuaucaauuguacaguggacgaaaugacagaggccguagaaggucacaucaccaccgagaucguaaugcuaaauccugccaauaccagaagcauuuccaauaugacuucucaagaauucguugagaaauugacuaaaaggcuaaaaagacacccagaagagacuggggguuuucaagaggcuccucuagcuuacgacgcuauaugggcucuagccuuagcucugaacaagacaagugggggaggaggacgcaguggcgucaggcucgaagauuuuaauuauaacaaucaaacuaucacggaucagaucuauagagcaaugaauagcagcagcuucgaaggagugucgggccacgugguguuugaugccuccggcucucgaauggcuuggacacuaauagagcagcugcagggggggaguuacaaaaagauaggcuauuaugacagcaccaaggacgaccugagcuggucuaaaacagauaaguggauuggggguuccccuccagccgaucagacauuggugauaaaaaccuucagauuccuuucacagaaacucuuuauuagcguaagcguacugucgucacuggguauaguguuagccguuguuugcuugucuuucaacauauauaauagccacgucagauauauucaaaacucacagccuaaucucaauaacuugacggcaguuggguguucccuggcccuugcagcuguguucccucuaggccuggacgguuaccauaucggcagaaaccaguuuccauucgugugucaggcacgacugugguugcuaggccuuggguuuucccugggauacgguucuauguucacaaaaauuuggugggugcacacaguguuuacaaagaaagaggaaaagaaggaguggcguaaaaccuuagaaccauggaaacuguacgcuacugucggauuauuagugggaauggacgugcugaccuuggccaucuggcagauuguggacccgcuucaucgcacaauugagacguucgcaaaagaagagccuaaagaagacauugacguauccauccuaccacaguuggagcacuguagcucgcgcaaaaugaacacguggcuuggaaucuuuuacgguuacaaggguuugcuucugcuacuggguaucuuuuuggcuuacgagacuaagagcgugucgacagaaaaaaucaaugaucacagggcagugggaauggcuauuuauaacgucgccguguugugucugaucacagcccccgugacuaugauauuaagcucgcaacaggacgcugccuucgcauuugcuucuuuggccaucgucuucagcucguauauuacauuggucgugcuguuugugccuaaaaugaggaggcugaucacuaggggagaauggcaaagugaagcccaggacacuaugaaaaccgggucgucuaccaacaacaaugaagaggaaaaaagccgacuccuugagaaagagaaccgcgaguuagaaaaaauuauugcagaaaaagaagaaagaguaagcgaguuacgacaucaacuccagagcagacaacagcuacgcagucggcgacacccaccuacucccccugagccuucuggugggcucccacgcggaccacccgaacccccagacagacucucuugcgacggcuccagggugcaccugcuuuacaaguag

SEQ ID NO: 14247 - RNA, 3090 nt, Artificial Sequence
  Description of Artificial Sequence: Synthetic coding sequence
augccaccaacaaaauccguuucagagccuguaccuuuugaaaccgaagcucccagcaugacuauagugcccaccacagacaucgagccagugacaguucgcacagaggcaaccgucacgacuuuagcgccuaagacuagccaaagaacuagaacaagaagaccucgcccaaagcauaagacuaccccaaggccugagacccuccagaccaaacuugacuucggccccaucacaccaggcaccucaagcgcucccacgaccacuaccaaacgcaccagacgcccacacccaaagccuaaaaccaccccccauccugaagucccccagacgaagcuagugccagcgacuauccuggagcccgucuuacguaccgaagccagugguacaacagccgugccugcuaccauuuuugaacccgucagccccaucaaggaagcaccagggacuacauucguaccagugaccgaccuggagccugugaccuuuagaaccgaaaucccagcgacaacacuugcaacaaaaacuagcaaaaggacccguccuccccgacccagacccaagacaacccccucuccucaggccccagagacuaaaccuguaccugcaacaguccuagagcccgugacguugcguccagaagcaaguacuacacuggcauccaagaccucccagcggaccagaagacccagacucagaacaaagacuacaccacggcccgaggcucccgaaucuaaaccaguuccaacagcugaacuuaagccugugacuuuacguaccgaaaccugggucacgacucaagccccaaagacaucacagcgcacacgccgcccuaggccaaagaccaaaacaacaccgucaccagaagucccccagacaaaacuggugccuucuaccgacuuagaacccggaacccuucggacagaagcgccaaaaacuaugguugugacuaccguguuagaaccagauacauuccgcaccaaguuccccgaaaccacccucgccccaaagacucagcgaaccagaagaccaagaccaaggccuaaaaccacuuccuccccagagguuccucaaaauaaaucugugagugugacgggauuugagcccguuguucauagcacagacgcacccgggaccaccuuugcuuuaacagaauugcagacucuuauucucaagcccgugacaagucccagccucgaaaugaccgaaucacagccagugucagacgugcucgaaucaguuacacuuaguacagagaguccuaaggaaacuaucgcucccgcgaagacagacuacguguauccuacugcuaaagccccucucuggccagaggaaccgaaaacugaagucguggaaucaauuacauaugugagcgaacccccugagacuacacuugagacuagcccacugcccagccagucuaucacucuaccuucaccagacgaaccccagacagaacccgcccccaaacaaacucccagagcuccuccaaaacccaagacuagcccucggcccagaaucccucaaacccagccagucccuaagguuccccagagaguaacggcaaaacccaagacaaguccaagcccagaagugagcuacacgacccccgcucccaaagacguucuacucccccacaagccauaucccgaggugagccaauccgaaccagcaccacuggagacaagagguaucccauucauuccuaugauaagcccguccccaagucaggaggaauuacaaacaacccuggaagagaccgaccaaagcacacaggagcccuucacgacaaagauaccccgaaccacagaacuggccaaaacuacacaggcaccucaccgauuuuauacuacagucagaccucgcaccucagacaaaccccacaucagaccaggagugaagcaagcuccacguccaucgggggcggaccgaaacgugucaguagacucaacccacccuacaaagaagccggguacucgccgaccaccucugccgcccagacccacacacccaagacggaaaccccugccgccgaacaacguaaccgggaaaccuggguccgcaggcauaaucucuuccgguccaauuacaacccccccacugagauccacuccucgccccacuggaacgccucucgagcggauugaaaccgacauaaaacagccuacagugcccgcuucaggcgaagaacuagagaauauuaccgacuuuuccucaagcccuaccagagagacagacccacuaggaaaaccacgcuuuaaaggcccgcauguucgcuauauucagaaaccggauaauuccccauguagcauuacugauagcguuaaacgauucccuaaggaggaggcaacugaaggaaacgccaccucccccccccagaaccccccaacuaaucuuacagucguuaccguugaaggaugcccaucauucgugauacuagacugggagaagccucugaacgacacuguaacagaguaugaagugauuaguagggaaaaugguucuuuuagcggcaaaaauaagagcauucaaaugacuaaucaaacuuucagcacgguggaaaaucucaagccaaacacauccuacgaauuccaggucaagccaaaaaaucccuuaggcgaagggccugucagcaacacaguggcguuuucaaccgagucugccgacccuagaguaucugaaccuguaucagccggucgugacgcuauuuggacagagaggccuuucaauuccgauucauauagcgaguguaagggaaaacaguacgugaagagaacaugguauaaaaaauuuguaggaguccagcuuuguaacucccugcguuacaaaaucuaccugagcgauagucugacgggaaaauucuacaauauuggagaccagcgaggacacggcgaagaucacugucaguuugucgacagcuuucucgacggacggacugggcagcagcuaaccuccgaucagcuccccauaaaagaaggcuacuuuagagcggugcggcaagaacccguucaguuuggcgagaucggcggucauacucagauuaauuacguucaaugguacgaaugcgggacaacuaucccagguaaaugguag

SEQ ID NO: 14248 - RNA, 2355 nt, Artificial Sequence
  Description of Artificial Sequence: Synthetic coding sequence
augacuaucguacccacaacggauauugagccgguaacagugcgaacugaagcaaccguuacuacacuugcacccaaaacaagucagcgcacccguacucgccgcccccgcccaaaacacaaaacaaccccucgcccagagacacuucaaacuaaacucgauuucggcccgauaacccccggcacuucauccgcuccaacaaccaccaccaagagaacaagacgcccacacccaaaacccaaaacaaccccacacccagaggugccccagacaaaguuggcuccaaaaguaccucagagaacacacagaccucaccccaagccuaaaacgaccuuaucuccggaagaacuccagacugaauuaguaccugugacagaucuugagccugugacuuuuagaacagagauacccgcaaccacgcuugcaacuaaaacguccaaaagaacucgccccccccgcccacggcccaagacuacaccguccccccaggccccagagacaaaacccgugcccgcaaccguacucgaaccuguuacccuaagacccgaagcaucuacaacauuagcuucaaagacuucucaaagaacccgacgcccucggcugagaaccaaaacaaccccaaggccagaagcaccagaaucaaagccagcaccuaagcaaacuccuagggccccucccaagcccaaaaccagccccaggccucgaaucccucagacccagccuguuccaaaagugccucagagagucacugcgaaaccuaagaccagccccagcccagaaguguccuauaccacccccgccccaaaggauguucuccucccccacaagccauauccagaagugucccaauccgaaccugcgccacuggaaaccagaggcauuccauuuauaccaaugaucagcccaagcccaagccaagaggaacuucaaacuacucuugaggagacagaucagucuacacaagaaccuuucacgacaaagauaccacggacaacagaauuagcaaagacaacccaagcaccucaucgauucuauacuacagugcgcccuagaacuagugacaaaccacacauucgucccguauuaaauagaacaacuacgagaccaacgagacccaaacccucuggaaugcccucaggcaacgggguggggacugggguuaagcaggccccuagacccucuggcgcugacagaaacgucuccguggauucaacccauccuacaaaaaaacccgggaccagaagaccaccacugccaccuagaccuacucauccacggagaaagcccuuaccaccuaauaacgugaccggaaagccaggauccgcgggcauuaucucaucaggaccuaucacuacuccuccuuugcgauccacaccgcgccccaccgggaccccauuggaaaggaucgagaccgacaucaaacaaccaacagugcccgcuagcggcgaagagcucgaaaacauaacagauuuuucuagcagucccaccagagagaccgauccacuuggcaaaccucgcuuuaaggggccccacgugcgcuauauccagaaaccagauaacucgccuugcucaauuacagacucgguuaagcgauuuccuaaagaagaagcuacggaggguaacgccacaucucccccacagaacccacccaccaaccugacaguggugaccgucgaaggaugcccgaguuuugucauauuagauugggagaaaccucugaacgauacagugacagaguaugaggucauaucacgcgaaaauggaaguuucuccggcaagaauaagucuauucaaaugacaaaccagacuuuuucuacugucgagaaucugaaaccaaauacuagcuacgaguuccaagugaagccaaagaaccccuuaggggagggcccugucaguaacaccguggcuuuuucaacugaauccgcagauccaagaguuagugaaccagucucugccggccgggaugcaauuuggacugaacgaccauucaacucagacuccuacucugagugcaaaggaaagcaauauguuaagaggacaugguacaagaaguuuguaggggugcaacucugcaauucucuccgauacaagauuuaucucagcgacagccuaacaggaaaauuuuacaauauuggagaccaaaggggccacggggaagaucacugccaguuuguagacucuuuucuugauggcagaacaggccagcaguugacgagugaucaacuuccuaucaaggagggcuauuuuagagcagugcgucaggaaccuguccaauuuggcgaaauuggcgggcacacacagaucaacuaugugcagugguacgagugugguacuacuauaccaggaaaaugguag

SEQ ID NO: 14249 - RNA, 1584 nt, Artificial Sequence
  Description of Artificial Sequence: Synthetic coding sequence
auguuaaugcuguucguuuucggcguuuuacugcacgaggucucacuuagcggccaaaacgaagcaccuccaaauacacacaguaucccgggcgaaccacucuacaauuacgccagcauuagauugccagaagaacacaucccguucuuucuccacaauaaccgccacaucgcaacugucugucgcaaagacucucugugucccuauaaaaagcaucuggagaaacuuaaauacuguugggguuaugaaaaguccugcaaacccgaguucagauucgguuacccuguauguuccuauguugauaugggauggaccgauacacuugaaucagcugaggacauauucuggaagcaagccgauuucggguaugcaagagagaggcuggaagagaugcacguucucugucaaccuaaagagaccagcgacagcucccugguuugcagccgcuaccugcaguacuguagagccacaaaucuguaucuggaucugcguaacauuaaaaggaaccacgauagauuuaaagaagacuuuuuccaauccggcgaaauaggaggccauuguaaacuggacauuaggacccuaaccuccgagggacaacguaagagcccucugcagagcugguuugcagaacuucagucauauacccaacucaacuuccggccaauagaggaugccaagugcgauaucgucauugaaaagcccacuuacuucaugaaacuggaugccggcgucaacauguaccaccacuucugcgacuucauuaaccucuacaucacccagcaugugaauaacucauuuucuaccgacguuuacaucguuaugugggacaccuccagcuacgguuacggagaucuguucucggacacuuggaacgcauuuacugacuaugaugucauccacuugaaaaccuaugacucaaaaagaguguguuucaaagaggcaguguucuccuuguuaccccggaugcgauaugggcuauuuuauaacacgccacugaucuccggcugccaaaacaccggccuuuucagagccuuugcacaacaugucuuacaucgccucaauauuacacaggaggguccaaaggauggaaagauucgcguaacaauccucgcacggucaacugaauacaggaagaucuugaaucagaacgagcucgugaacgcccugaagacaguauccaccuuugaaguacagauuguagacuacaaguaccgcgagcuaggauuucuugaccaauugcguauuacccacaauacagacaucuuuauuggaaugcauggcgcaggacuuacacaucuucuguuucuaccggacugggccgcaguuuuugaacucuauaacugcgaagaugaaagauguuaccuggaucuggcaagguugaggggcgugcacuacauuacauggcgacggcaaaacaaaguuuuuccgcaagacaaaggacaccauccuacacugggagagcacccaaaguuuacuaauuauagcuucgacgucgaggaguucauguaucucguacuccaggcagccgaccacguccuccaacacccuaaauggccauuuaagaagaaacacgaugaacucuag

SEQ ID NO: 14250 - RNA, 2004 nt, Artificial Sequence
  Description of Artificial Sequence: Synthetic coding sequence
augggcucuucgagauuagccgcacugcuguugccacugcuucucauugugauugaccugucugauuccgcugggaucggauuccgccauuuaccacacuggaacacacgcugcccucuagcuucucacaccgacgacagcuucacugguucaucugcuuauaucccuugccggacguggugggcccuuuucucaacuaagccuugguguguccguguguggcauugcucgcgcugucuuugucagcaucucuugucuggggggaguggacuacagcggggacucuuccacuuacucgugcagaaaaguaaaaaauccaguaccuucaaguuuuauagacgccauaagaugcccgccccugcccaaagaaagcuccuaccuagacgccaccugucugaaaagagucaccacauuucuauacccuccccugauauuucacacaaaggccugcgauccaaacgcacucaacccucugacccugaaacaugggagagucugccucgccuugacagccagcgccauggcgggcccgaguucucuuuugaucugcuccccgaggcacgugcgauucguguaaccauaucuagcggcccggagguguccgugcgccucugccaccagugggcccucgagugugaagaguuauccucuccuuacgacguacagaaaauuguguccggaggacacacaguugaacuccccuacgaguuccuucuacccugucuuugcauugaagccaguuaccuacaagaggauacugugagaagaaaaaagugucccuuccagucauggcccgaggccuauggcagugacuuuuggaaaucaguacacuucaccgacuauagccagcacacgcagauggugauggcccugacucugagauguccucuuaagcuugaggccgcauugugccagagacacgauuggcauacucucugcaaagaucugccaaacgcaacugcccgagaauccgauggaugguacguguuagagaagguugaccugcacccacagcucugcuuuaaguuuucauuugguaacaguagccauguagaaugcccccaccagaccgggucucugacuuccuggaaugucucuauggacacccaggcccagcaacucauucuucacuuuagcucaagaaugcacgcaacuuuuagcgcagcuuggucucucccaggcuuaggccaggauacuuuaguccccccaguauacacugucucccaggcgcgugguucaagcccugugaguuuggacuugaucauucccuuucuacggccaggcugcuguguucugguguggcguuccgacguccaguuugccuggaagcaccucuugugcccagacgugaguuaccgacaucucggacucuuaauccuggcucuucuagcucuacucacucuucucgguguggugcucgcccucacgugucguagaccucagucaggacccggccccgcaagacccguccuccucuuacaugccgcugacagugaggcacagcggcgucuggugggcgcauuggccgagcugcuccgcgcggcccuugguggcggcagggaugucauugucgacuuaugggagggaagacauguagcccgaguggggccgcugccauggcuuugggcagcaaggacccgaguugcacgagaacagggaaccgugcuucuucucuggaguggugcagaccuucgccccgugucuggccccgauccacgagcagcaccccugcuggcucuccuucacgcugccccaagaccgcuccugcuccuggcuuauuuuagccguuuaugcgcaaaaggagacaucccaccuccacugcgggccuuaccucgguacagacugcugcgcgaucucccucgccugcuccgugcacuggaugcuagaccauuugccgaggcaacauccuggggacgcuuaggagccagacaacgccgacaguccagacucgagcuaugcucuagguuggagcgggaggcagccagauuggccgaucuugguuag

SEQ ID NO: 14251 - RNA, 1101 nt, Artificial Sequence
  Description of Artificial Sequence: Synthetic coding sequence
augccaaugauaagcgugcuuggcaagauguuucuguggcagagagaggggccggguggacgcuggacuugccagacaucacguagagucucgucagauccugcaugggcuguggaauggauugaacugccucgcggauugagcuugucuucacuugggucagcacggacucuucgugguuggucgcggaguagucgcccaucuuccguugauucacaggaucugccagagguaaacguuggggauaccgucgccaugcugccgaagucccgucgggccuugacaauucaagaaaucgcugcucuggcacgauccagccugcacggcaucucccagguggugaaagaucaugugacuaagccaaccgccauggcacaggggcguguagcucaucucaucgaguggaaaggauggaguaaaccaagugauagccccgcagcccuggagucagcuuuuaguaguuauucagauuuguccgaaggggaacaggaagcccgcuuugcugccggcguagcggagcaguuugcuauagcugaagccaaacugagggccuggaguagcgucgauggggaagauucaacugaugacagcuacgacgaggacuuugcuggcggaauggauacugacauggcugggcaguugccgcucggcccacauuugcaggaccuguuuaccgggcaucguuuuaguagaccuguuaggcagggaaguguugaacccgagagcgauugcagccagacagugagucccgacacacucuguaguaguuuauguucauuggaggauggguuacugggaucaccugcccgucucgcuucacaacuauuaggugaugaacuguugcuggccaagcuuccuccaucucgcgaaucugcguuucguucccuggguccucuggaggcacaggauagcuuauauaauagcccuuuaaccgaaaguugccuguccccagccgaagaggagccugcgccuugcaaagacugccagcccuuaugccccccgcucacaggauccugggagagacagcggcaggcgucugaucuagcauccaguggugucgucucgcuggacgaagacgaagcagaacccgaagaacaauag

SEQ ID NO: 14252 - RNA, 5172 nt, Artificial Sequence
  Description of Artificial Sequence: Synthetic coding sequence
augcaguuucagcuuacucuguuucugcaccuuggcuggcugaguuauagcaaagcccaagacgauugcaaucggggugcgugccauccaacuacaggagauuuacuugucggucguaacacucagcuuauggcaucgucaacuuguggucuuucaagagcucagaaauauuguauccugucuuaccuggagggggaacaaaaguguuucauuugcgacucccgcuuuccauaugauccguacgaccaaccgaacagucacaccauugaaaaugucaucguuagcuucgagccugauagagagaaaaaaugguggcaaucagagaauggccuggaccacgugucuauucgucucgaucuugaggcucuguuucgguucucacaccugauccugacuuuuaagaccuuucggcccgcagcaaugcuugucgagcguucuacagacuauggccacaacuggaagguuuuuaaauacuucgcgaaagacugcgcgacuagcuucccaaacauaacuucuggacaggcacagggcguuggagauaucguuugugauuccaaguauucugacaucgaaccaucuacaggaggcgagguugugcugaagguuuuagauccaagcuuugagauugagaauccuuauucgccuuauauucaagaccuugugacacugacaaacuugcgaauuaauuuuacuaaacuucacacccugggcgaugcacugcuuggccgcaggcaaaacgauucucuugauaaguacuacuacgcccuuuaugaaaugaucguccgggguucgugcuucuguaauggccaugcuagugagugccgcccuaugcagaaaaugagaggcgacguguuuuccccucccggaauggugcaugggcagugcgugugccagcacaacacagacgggcccaacugugagagguguaaggacuuuuuucaggaugccccauggcgaccggcagcagaucuccaggauaacgcaugcagaaguugcagcuguaauucacauuccucucggugccauuucgauaugacuaccuaucucgccuccggcgggcuaagcggcggugugugcgaggauugucagcacaauacagaaggacaacacugugacagauguagacccuuauuuuauagggaucccuuaaagacuaucagcgaccccuacgcguguauacccugugaaugcgauccugauggcaccaucucggguggcaucugugugagccauagcgaccccgccuuggguucuguugcaggacagugucugugcaaggaaaauguugaaggagccaagugugaucaauguaaacccaaccacuacggacugucagcaacugacccgcuaggaugccagcccugugauuguaauccucuagguucucugccuuuccugacgugcgacguggauacuggacaaugccucugccugaguuacgucacuggcgcacacugcgaggaaugcaccguggguuauuggggacucggcaaucaccugcaugguugcucaccuugugacugcgacaucggcggugcuuauucuaaugugugcuccccuaagaauggccagugcgaguguagaccucauguuacaggccgcaguugcagugagccugcacccggcuacuucuucgccccacuuaacuucuaccuguacgaggcugaagaagcuacaacucuucaggggcuggccccccuugguucugaaaccuucggucaaucucccgcuguucaugucguucugggagaacccgugcccgggaauccagugacuuggaccggcccuggauuugcacggguccugcccggugccggauuacgauucgcagugaauaacauccccuuccccguagacuucacaauugccauccauuacgagacucaauccgccgccgacuggaccgugcaaauuguugucaaucccccaggugggucugaacacuguauccccaagacauuacaaucgaaaccucaauccuucgcacugccggccgcuacuagaauaaugcugcugcccacacccauuugucuugagcccgaugugcaguauaguauugauguguauuuuagucagccucuucagggcgaaucacaugcucauagccauguauuagucgauucccuaggccugauaccucagaucaacagucuugagaauuuuugcaguaaacaggaucuggaugaguaucaguuacacaacugugucgagauugccucugccauggguccgcaggugcuuccuggagccugugaaagacucauuaucaguaugucugcuaagcuacacgauggagcuguugcauguaaaugucauccccagggcagcguugguaguaguuguuccagacucggugggcaaugucaauguaaacccuuagucguggggcgguguugugaucgaugcucaaccggcaguuacgauuuaggccaucauggaugccauccuugccauugucauccccagggguccaaagauacagugugugaccaagucaccggccaauguccaugucacggggagguaagugggcgacgcugugaccgaugucuggccggcuacuuuggguucccaaguugccauccuugucccugcaaccgguucgcagagcuaugcgauccugaaaccgggucaugcuuuaacuguggaggcuucacuacugggcggaauugcgaaagauguauagacggcuauuacgguaaucccagcucuggucaacccugucgcccuugucucugcccagaugauccaaguaguaaccaguacuuugcucacucuugcuaccagaaccugugguccucugacgugaucuguaacugucugcagggauacacaggaacccagugcggcgaguguucgacaggcuucuacggaaacccaagaauuagcggagcucccugccaaccgugugcaugcaauaacaacaucgacgugacugauccagaaucuugcuccagagugaccggugaaugucuuagguguuuacauaauacacagggcgcuaauugccagcuauguaagccaggacacuacggaucagccuugaaccaaacaugccgucggugcucuugccacgcgagcggagucuccccuauggagugucccccgggaggaggagccugccuaugcgacccgguaacaggugcuugccccugucuaccaaacgugaccggccucgcaugugaccggugugcugauggauacuggaaccuugugcccggaagaggcugucaguccugcgacugugauccccguacaagccagucuagccauugcgaucaacugacgggacaauguccuuguaaacucggcuauggcgggaagcgguguuccgaaugucaagagaacuauuacggagacccaccgggaagguguaucccuugcgauugcaaucgagcugggacgcagaaaccuauuugugacccagacacuggcauguguagauguagagaaggagugagcggacaacguugcgauaggugcgcucguggccacagucaagaauucccuaccugcuugcagugucaccuguguuuugaccagugggaucacaccauuagcagccugaguaaagcugugcagggcuugaugagguuagccgccaauauggaggacaaacgcgaaacccugcccgugugugaagcugauuuuaaggacuuacggggcaaugucucagagaucgaaagaauucuaaagcaccccguguuuccaucaggcaaauuccuaaaagugaaagacuaccacgauuccguccguaggcagaucaugcaauuaaaugaacagcugaaagccguauacgaguuccaggaucuuaaagauaccaucgagcgagccaagaacgaagcugacuuauugcuugaagauuuacaggaagaaauagaccuccaguccaguguucuuaaugcuucaaucgccgacaguucugaaaacauuaaaaaauauuaucauaucuccucaucugcagaaaaaaaaauuaacgaaacaaguuccacaauaaauacaucugcuaauacucgcaaugaccuacugaccaucuuggacacacugacaaguaagggcaacuuaucucucgaacgucuuaagcaaauuaagaucccagacauacagauccugaaugagaagguguguggggacccuggcaacguucccuguguaccucuacccugugguggggcccuauguaccgggcgcaagggacacaggaaaugucggggaccugguugccaugggucucucacccugaguaccaaugcgcugcagaaggcacaggaggcgaagucaauaauucguaaucuagauaagcaggugcgcggccuaaagaaccagauugaauccauuagcgagcaagcggagguuuccaaaaauaacgcacuucaauugcgggaaaaacuggggaauauuagaaaccagagcgacagugaggaagaaaacaucaauuuauuuauaaagaaaguuaaaaauuuucuguuggaggagaaugugccacccgaagauauugagaaaguggccaauggaguccuggauauacauuugcccauaccgucccagaaccugacagaugagcuggucaaaauccaaaagcacaugcagcuuugugaagacuacagaacagacgaaaaccggcuuaacgaagaagccgacggggcgcaaaagcuucugguuaaagcaaaggccgccgagaaagcugcgaacauccucuuaaaccuggauaaaacacucaaccaacugcaacaggcccagaucacccaagguagagcaaacaguacuauaacacaacuuaccgcaaacaucacaaaaauaaagaagaacguauugcaggccgaaaaccagacucgcgagaugaaaagcgaguuagaacuugcgaaacagcgaagcgggcucgaagacgggcuaucacugcuccagaccaaacugcaaagacaccaggaucacgcaguuaacgccaagguucaagccgaaagcgcccaacaccaggcaggcucguuggaaaaggaauucgucgaguuaaaaaaacaauaugcgauucuccagcgaaagaccucaacuacaggacugacaaaagaaacgcuggggaaagugaaacagcugaaagacgccgcugagaaauuggcaggcgacaccgaagcuaaaauaagacgcauuacagguuguuuucagaacuccgcacgcuag

SEQ ID NO: 14253 - RNA, 5286 nt, Artificial Sequence
  Description of Artificial Sequence: Synthetic coding sequence
augcaauuucagcuuacccuuuuccuccaccugggaugguuauccuauucaaaagcccaagaugacuguaaucggggcgccugucacccaacaaccggugaucuucuagucggcagaaauacccaacucauggccuccagcaccuguggacuuucacgcgcgcagaaguauugcauccucagcuaucuggaaggggagcagaagugcuucauuugcgauaguagauucccuuacgacccuuaugaccagccuaacucucacacuauagagaacgucauugugucguucgaaccggaccgcgaaaagaagugguggcaauccgaaaacggucuggaccacgucagcauuagacucgaucucgaagcccucuuuagauucucucacuuaauccuuacuuucaagacauuucguccggcagccaugcuagucgagaggagcacagauuacggccauaacuggaaaguuuuuaaguacuuugccaaggacugcgcuaccaguuucccaaauaucacaucaggucaagcucagggggugggggacauagucugcgauagcaaguauucagauauugagcccagcacaggaggugaagucguauuaaaaguucuugacccaaguuucgagaucgaaaauccuuacucaccuuacauucaagaucuugugacccuuacaaaccucagaauaaauuucacaaagcugcacacuuugggggacgccuuacucggaaggagacagaacgacucucuagauaaauacuacuaugccuuauacgagaugauagucagagguuccuguuuuugcaacgggcacgccagcgaguguaggcccaugcagaaaaugcgaggggauguguucucaccuccagguaugguucaugggcagugcgugugccagcacaauacggauggcccaaacugugagagaugcaaggacuuuuuccaggacgccccguggagacccgccgcagaccuccaggacaaugcgugccguuccugcagcugcaauucccacucgagcagaugccacuuugauaugacuaccuaccuggcuucugguggcuuaaguggaggaguaugcgaggauugccagcauaacacugaaggacagcauugcgaccgguguagaccucuguucuaucgagacccucuaaagacuauaagugacccuuaugccugcauucccugcgagugugacccagacgguacuauuucaggugggauuuguguuucucauagcgacccugcauuaggaucuguggcaggccagugucuguguaaggaaaauguugaaggggcaaagugcgaucaguguaagcccaaccacuacggccugagcgcaaccgacccccugggcugccagccuugugacuguaacccccugggaucucugccuuuccugaccugcgaugucgacacaggacaaugccuauguuuaucauacguuacaggugcucacugugaagaauguaccgucggcuacuggggacugggcaaccaccuucaugguuguucgcccugcgacugugacauaggcggcgcguacaguaaugugugcucucccaaaaacgggcagugcgaguguaggccacacgucacaggaaggaguugcuccgaacccgccccagguuauuucuucgcaccacucaacuuuuaucucuacgaggcagaggaggccacuacucuucaaggacuggcacccuuagggagcgaaacauucggccagucucccgcuguacauguugucuugggggaacccguaccugggaacccagugacauggacuggccccgguuuugccagggugcugccuggggcuggguugcguuuugccguaaacaacauuccauucccugucgacuuuacuauugccauccacuaugaaacucaauccgccgcugauuggacuguucagaucguaguuaacccaccuggugguucugaacacuguauaccaaagacccugcagucgaaaccgcaaucauuugcccugccugccgcgaccagaauaauguugcugcccacacccaucugucuugagccugacguucaguacucuauugauguauauuuuucccagccccugcagggcgagucacacgcccacucucacguucugguggacuccuugggacuaauuccacagauuaauucgcucgagaauuuuuguucaaaacaggaccuagacgaguaccagcuccacaacuguguggaaauugcaucagcuaugggaccccagguacugccgggugccugcgaaagacugauaauaagcaugagugcuaaacugcacgauggagcaguagcuuguaaaugccacccucagggauccgucgguucgucaugcagccggcucgguggacagugccaguguaagcccuuagucgugggcagauguugugaucguuguuccacagggaguuacgauuuaggucaucacggaugucaccccugucauugucacccucagggcuccaaagauacuguuugcgaucaaguuaccggacagugcccuugccauggcgagguguccggcagacgcugugauaggugcuuggcaggauauuuuggguuuccuagcugccauccauguccauguaacagauuugcagagcugugcgacccagagaccggcucaugcuucaacuguggcggcuucacuacaggcagaaacugcgaaagauguauagaugguuauuacggcaaucccucaucuggccagcccugcagaccaugccuguguccugacgaccccucuagcaaccaauacuuugcccacucaugcuaucaaaauuuguggucaagugauguuauuugcaacugccuucaaggcuacacagguacccagugcggcgaaugcucaacgggguuuuacggaaaccccaggauuuccggcgccccaugucagccaugugccuguaacaauaauauagaugugacagacccugaaaguuguucucgagugaccggagaauguuugcggugccuccacaauacacaaggugcgaacugccaacuaugcaagccuggccauuaugggucagcguuaaaccaaacauguaggcgcuguucaugccacgccagcgguguaucucccauggaauguccacccggcggcggagcuugccugugcgacccugugaccggcgcguguccauguuugccaaacgugacuggauuagccugcgauagaugcgcugauggauauuggaaucucguaccugggcguggaugucaaagcugcgacugugacccuagaaccagucaauccagucauugcgaucaguuaacgggucagugcccuugcaaauugggcuacggagguaaaagauguucggagugucaggagaauuacuacggugaucccccgggaagauguauccccugugacugcaaccgagcuggcacacagaaaccuauaugcgaccccgacaccggcaugugcagaugcagggaaggugugucugggcagagaugcgaccguugugcuaggggacacucucaggaauuucccacuugcuuacaaugccauuugugcuucgaucagugggaucauaccaucuccuccuugaguaaagccgugcagggccugaugagacuugccgccaacauggaggauaagagagagacauugcccgucugcgaagccgauuucaaggaccuccggggcaacgugagcgagaucgagcgaauccuaaaacacccuguguuuccauccggcaaauuucugaaagucaaagauuaucaugacucagugcgcaggcaaaucaugcaacuuaaugaacaacucaaggcugucuacgaguuccaggaccucaaggauacaaucgaacgugccaaaaacgaggcggauuuauuauuagaggaccugcaagaggagaucgauuugcagucaucaguccugaaugcuucuauagcugacuccuccgaaaacauaaagaaauacuaccauauuucaaguagcgccgagaagaagauaaaugaaacuagcaguaccauuaauacaagcgcaaauacacggaaugacuuacuaaccauccuggauacccuaaccagcaagggcaaucugucacuugaacgccucaaacaaaucaagauuccugauauccaaauucucaaugaaaaagucuguggagacccggguaaugugccaugcgucccuuugcccugcggaggggcacucugcaccggaagaaagggccaucgcaaguguagagggccgggcugucacgggucacugacccucucuacuaaugcucuccaaaaagcccaggaggcuaaauccaucauacgcaaccuggauaagcaagugaggggauuaaagaaucagauugaguccaucagugaacaggcugaagugucuaaaaauaaugcucuacagcucagagagaaauugggaaauauacgaaaccaaagugauagcgaagaagaaaauaucaauuuauucaucaaaaaaguaaagaauuuccuucuggaagagaauguuccacccgaggauaucgaaaaaguugcaaaugggguacuggacauucaccucccuaucccuagucaaaaccugacggacgagcuaguuaaaauccagaagcacaugcaacucugugaagacuaccgcaccgacgaaaaccgccugaaugaggaagcagauggugcccagaaauugcucguuaaagccaaagcagccgagaaagcagcgaauauuuuacugaaucuggacaaaacccuaaaucaacuucaacaggcucagauaacucagggaagagccaauuccacuaucacacagcuuacagcaaacaucacuaagauuaagaagaacgugcugcaggccgaaaaucagacucgagaaaugaaauccgaacuggaacuugcaaaacaaaggagugggcucgaggauggguugucacugcuccaaaccaaacuucagagacaccaagaccaugccgugaaugcaaaggugcaggccgaaagcgcgcagcaccaagcuggaagucuggaaaaggaauucguggaacucaagaaacaauaugccauccugcagagaaaaacaucgaccaccggacucaccaaagaaacuuuagggaaggugaagcagcuaaaagacgcggcagagaaacuagccggagauacggaagcgaagaucagaagaaucacagaccucgaaagaaagauacaggaccuuaaucugagccgacaagcuaaagccgaccagcuccgaauucuggaagaccaaguuguggcuauuaaaaacgaaaucguagagcaggagaagaaauacgcccgcuguuacuccuag

SEQ ID NO: 14254 - RNA, 1455 nt, Artificial Sequence
  Description of Artificial Sequence: Synthetic coding sequence
augggcgcagaggcccugccuggaccagacgaggcugccgcagcugcugccuuugccgaggugaccaccgucaccguagcuaacgucggagccgcagccgauaauguuuuuacuacaucagucgcaaaugcugcuuccaucucuggacaugugcucucgggaaggacagcucuccagauuggugacagucugaacaccgagaaggcaacccucauaguagugcacaccgacggcuccaucguugagaccacaggacuaaaggguccagccgcaccacucacacccggaccacagucaccaccuacaccccuggcaccuggacaggaaaaaggcgguacaaaguacaacugggaccccuccguguacgauucagaauugccaguccggugucguaacauuucagggacauuauacaaaaauaggcucggauccggaggacggggucgaugcauuaagcagggagaaaacugguacuccccaaccgaauuugaagccauggccggccgcgccucaucuaaagacuggaagcgaaguauuagguaugcugggaggccacugcaaugucucauucaggauggcauccuaaauccacaugcugcuucuugcaccugcgcugccuguugcgacgauaugacccugucaggcccuguuaggcuguucgugccuuacaagagacgcaaaaaggaaaaugagcugccuacaacaccugugaaaaaagauaguccuaaaaauauaacucugcuccccgcaacagccgcuacuacuuuuacaguuacgcccucuggacagauuaccacuucaggcgcucuuacuuuugaucgcgcguccacgguugaggccacagcaguaauaucugaaucaccugcccaaggggacguuuuugccggggcuacaguccaggaggcauccguucagccgcccugucgagcgucccauccugaaccgcacuaccccggcuaccaagauucaugucaaaucgcuccauucccugaggccgcucugccuaccucucacccaaagauugugcuuacaagcuuaccagcucucgccguccccccuccaaccccaacaaaggcugcuccaccugcccucguuaacgguuuagaacuuagcgagccacgcuccuggcucuaucucgaggaaauggugaacuccuugcucaacacugcucaacaacucaaaacauuguuugaacaggccaaacaugcuucaaccuacagggaagccgccacuaaucaagccaaaauccacgcugacgccgagcgcaaagaacaaucuugugugaacugcggcagagaggccaugagcgaguguacaggcugucacaagguuaauuacuguuccacauuuugccagagaaaaagguggagucuuacuauguuaacgucccucgugucuauaaguugguuaagggccaucuuaccaugccagccacccaagguccucgggcuguag

SEQ ID NO: 14255 - RNA, 1512 nt, Artificial Sequence
  Description of Artificial Sequence: Synthetic coding sequence
augucaggcgcucugcucuggccucuuuugccgcuucuguuacuucuguuaagugcgcgugauggaguccgggccgcccagccccaagccccuggauaucugaucgcagcucccagcguguuuagagcuggcgucgaggaaguuauuaguguuacaaucuuuaauaguccucgcgaagugacagugcaagcccaguuagucgcucagggcgagcccguagugcagagucagggugcuauucucgauaaagggacuauuaaacuuaaagugcccacuggcuugcguggacaagcacuccugaaggucuggggacguggauggcaggcugaggagggucccuuguuccauaaccagaccucagucacaguggacgggagaggagccagcguuuucauccagacagauaaaccaguguaccggccucagcacagggugcucauaucuaucuuuaccguguccccaaacuuaagaccagugaacgaaaagcuugaagcauacauccuggauccaaggggcucgcgcaugauugaguggagacaucugaagccuuucuguugcggaauaacuaauaugucauucccucuaagugaucagccuguucugggugagugguuuaucuuugucgagaugcagggucacgccuauaacaagaguuuugagguccagaaauauguucucccuaaguuugaguugcuuaucgauccuccucgcuacauucaggauuuggacgcaugcgaaaccggaacugugagggcucgguauacauuuggaaagcccguagcuggugcucugaugauuaacaugacugugaauggaguggguuauuauagucacgaggucggacggccuguguugagaaccaccaagauacucggaagucgcgacuuugauaucuguguccgggauaugauuccagcggacgugccugagcauuucagaggaagggucaguauuugggcgauggugacaaguguggauggaagucaacagguugcuuuugaugauucuacaccgguccagcgacagcucguggauauccgguacagcaaagacacuaggaagcaguucaagccaggauuagcauauguggguaagguggaguuguccuacccagauggaagccccgcugaagguguaacgguccaaaucaaagccgagcuuaccccaaaagacaacaucuacacaagugaagucgucucccagagagggcuggugggcuucgagauaccaagcauccccacaagugcucaacacgucuggcucgagguguuucaagaauuggaggauuaugacguaagugacaguuucggggucagccgcgaggaugggccauuuuggugggcaggucucacagcccagagaagacgacggagcucagucuuucccuggccaugggggaucacuaaagauucuggauucgcuuuuaccgugcgaaggggaaauggcacuggaggugaugaccggccuagugaaccagaaccacccgcuggucguuggccuuugcauagguag

SEQ ID NO: 14256 - RNA, 144 nt, Artificial Sequence; identical to SEQ ID NO: 12617
  Description of Artificial Sequence: Synthetic coding sequence

SEQ ID NO: 14257 - RNA, 861 nt, Artificial Sequence
  Description of Artificial Sequence: Synthetic coding sequence
auggaaguauauauuaggcaucucgagaaaguucugagacguuaugugcagaggcuccaguggcuccugagugggccuguccuuuguagucggacuugguaucggcagaguauggauagaggggugaugaugaccgccgcaucugguaguaggagacuguuugggacggugcucgagaguaaagugugcauauuacucgauacaagcggcuccaugggacccuaucugcaacagguaaagacggaguuaguguugcuaauuugggagcagcuuagaaagugcugugacucuuucaaucucuugaguuucgccgaaaguuuccaaagcuggcaggacacucuuguugagaccacagacgccgccugucacgaagccaugcagugggugacccaccugcaggcccagggcucuacuaguauucuccaggcucuacuuaaggcuuucucuuuucacgaccuugaaggacucuaucuucugaccgauggcaagccggauaccagcuguucccucgugcugaaugaagugcaaaagcugcgcgaaaaaagagacgugaagguucacacaaucagucugaacuguuccgaucgagcggccguugaauucuugcgcaaacuggccaguuuuacaggcggucgcuaucauugccccgugggcgaagacaccuuaucaaaaauucauucccucuuaacuaaaggcuucaucaaugaaaaagacccuacucuccccccuuucgaaggagacgaucucaggauccucgcucaggaaaucacuaaagccagaucuuuuuuguggcaggcucagaguuucaggucacagcugcagaaaaagaacgaugccgaacccaagguuacacuuaguuag

SEQ ID NO: 14258 - RNA, 3555 nt, Artificial Sequence
  Description of Artificial Sequence: Synthetic coding sequence
augaaaaaguaccgcaagaucucuaucggcugcuuugccauggcuacacaaaccucccauguguuucacggucaagagaacauguucuuagaaaaucauugcaucagaaggaacacaggaagagacagcaagaaaccccugaaacaaaagaauaugaacggucuaggucagaauagcgauaauggccuacugguuacccaugugaaccaaacccaggaucugcuacgcuugcagggcuccgagacacaauccagugauugggaggacagcgaagauugguuaagugcccacagccucaaaugucagaagcucacacucgcugaucuaaucucccaggguacagaggugcuagaagagggcacgaauguggugcaaaaaauuugcuucucuacucagaucauaagacacuucgaaucaaaguugucagauaccauagagguguaccaggaacgaauucaguggcugacugaaaacucaaagaaggcauuuggguuaauuaagggggcaagaguaagcauccucauugacgucucagcaauuucuucagggccacagaaggaagaauuccagaaggaccuuaugagccucauagaugaacaguugucucauaaggagaagcuguuuguuuuauccuucggcacuaacgcugguucacuuuggccugacccuauggaaguaucugcaagcacuuuacaggaacugaaacuuugggugaaaacuuuacagccggacggcggcuccaaccugcuccaggcucugaaaaaaauauuuacuuugaagggauuagacucucugguugcuauuaugagaaguuguccugaucagccaagugaaauacugagcgacuauauucaacagaguaccauggggagggaccucaucauccacuuuauuacuuauaggugugacgaucagaugccucccgccguacugaagaaccuagccgaagcugugcgaggauauuaucacuguuauucaccuaagauggaacacuauaccucccgugacauggaugaguuguuagcugaaauucagaaagcucagucacuccugucccaugugcaagccuuacagcauucuucacccugugaagcacugaccuguaccauggaggagauaucaacggagauuaccaacggaccuuuaaucucauuacuuccaaagcccccgaagcacgacgccccuuuaacaauugaguuucccaauuuagacaaaaccagcgccgaguggcugaaggucaauggcuuaaaggcuaaaaagcuuucucuguaccagguguuggcuccuaacgcauuuuccccugucgaagaguuugugccuauucuccagaagacaguaucuucuacuauucacgagaaagcuaugauucaguuugaguggcacgauggaacagugaaaaauauccacgucgauccccccuuccuguauaaguaucagcaacaauuaucucgcgcuaugaggauguacgaaagaagaaucgaguggcucucacuugcuucucgcagaaucuggggcacagugugcgaaaagcgaguuguaguccuucucgacauuagcgccacuaauucaauguacauaauccacauccaacauucacugcgccugcugcucgaagaacaacucuccaacaaagacugcuuuaaucugaucgccuuuggaucaacgaucgaaucguggcgcccagagaugguacccguaucccauaacaaucuacaaucugcuuggagaugggcccugaaccuccgaugcaggggcucuagaaaugucuuguccgccuugagaaaagcugucgaaguugauuucaaggauaaggacaagcaccagucacagggaauuuacuuauucacgggagggauuccugaucaagacaugccuacccucagugccuacauggcggaagcguguggagguugugaccuacaacucaacgucugccuuuucuaugucggcgagccuaagauggacacaacuccacccgcucguuacgcaucucacacagacacagcagcagcauauaaagagguuaccagggcagcaggugggcgguuccacugguucggagauaccggcauuuacgagagugaugauaucaacuccauuaugagugaaauggagaaagcacuuaauuacagccagaaaugugcuuuucuuauggccucccucaaaaaccacagcggcaagguccucggaagcagcgcauuaccuaaggaaaagccgaagacucuacaacugagaagccagccuaagaaacucugucccccccgacccaccgugccccucggagcccguaugucgaucaaagaugaccccgauagagaaaaaucccccccgcugaagucuuuaaaguggcgcccccuguccucccggguuggaaucagccccgcagcugcucagcccaccaaggaagggaugauggaguugagacgaaagacaaaauccagagaagcugagaccagucuacuucuguuuuacacagaaaaggggaacgacgugggcucuguguacaaaaaauauccacaaggccgcggcuugagaaggacaucuaguucgauugauuuaccuaggaaagauacagucugcuccucacaggaaugggucgcuaaguauggacugaagaaacugaaacucgagaucucccggugcauggguccaaauuguacccaucagaagagugggcagcggagugcaagcgccaaacauuguucuaucuucccuagcguggagauucacggcguggugcggcacauucaauggaccccccgcgagauggaaguguacauaaggcaccuugagaaagucuuaagaagguacguacaacgguugcaguggcuccugagcgguucgagacgcuuguuugguacaguauuagaaucaaaagucugcauacucuuagacacuucugguucuauggguccguaccuccaacaagugaaaacagaacugguacugcugaucugggaacaauuaaggaaauguugcgacagcuuuaaccugcugagcuuugcagagaguuuucagucauggcaggauacccuggucgagaccaccgacgccgcuugccacgaggcuaugcagugggucacccaucuacaagcccaaggaaguacauccauccuucaggccuuguuaaaagccuuuucauuucacgaccuggagggacuauaccuccugaccgauggcaaacccgacacaaguuguagcuugguucucaaugaaguacaaaaacugagagagaagagggauguuaaagugcacacaauaagccugaacugcucagaccgugcugcuguggaguucuugagaaagcuggcuuccuucaccggaggacgauaccacugccccgugggcgaagauacccuaucuaaaauucacucucuccuuaccaaaggguuuauaaacgagaaagacccaaccuugccccccuucgagggcgaugaccugcgaauccuugcccaagagaucacuaaggcccgaagcuuucuguggcaagcccaaagcuuuagaucccaguugcagaaaaagaaugaugccgaacccaaagugacucuaagcuag

SEQ ID NO: 14259 - RNA, 906 nt, Artificial Sequence
  Description of Artificial Sequence: Synthetic coding sequence
auguuaccguugaccaugacaguucuuaucuuacuguuacuaccuacgggacaggcagccccuaaagauggagucacccgcccugauagugagguccagcaccagcugcugccuaauccuuuucagccagggcaggagcaauugggguuacuacaguccuaucugaaaggccucggcagaacugaaguucagcuugaacauuugaguagggaacaaguccuucuguauuuguuugcccuccaugacuaugaccagagcggccagcucgacggccuggaauuacucucgaugcucaccgccgcccucgcccccggcgccgcuaauuccccgacaacaaaccccgugaucuugaucguggauaagguacuugagacucaggaucucaacggcgacggacuaaugacccccgcagagcuuaucaacuuucccgguguggcacuccggcauguggagcccggggagccacucgcaccaagcccacaggaaccccaagcagucggucgacagucauuacucgcgaaaagcccucugcggcaggagacgcaggaagcacccgguccaagagaagaagcuaagggacagguggaagccaggagagagucgcuagacccagugcaggaaccaggaggccaggcugaagcugacggagacgugccaggcccacgaggggaagccgaaggucaggccgaagcaaaaggagaugcuccugguccuagaggagaagcuggcggccaggccgaagcugagggcgacgcaccugggccuagaggcgaagcuggcggucaagcggaggcacgggaaaauggcgaggaagcgaaagagcugccaggcgaaacacuagaaucuaagaauacccagaaugauuucgaaguccauauagugcagguggaaaaugaugagaucuag

SEQ ID NO: 14260 - RNA, 4722 nt, Artificial Sequence
  Description of Artificial Sequence: Synthetic coding sequence
augagaguguuagcaugccuucuggccgcucugguuggaauucaggcuguggaaagguugcgacucgccgacggcccucacggcugcgccgggaggcucgaaguuuggcauggcgggcgcuggggaaccgugugugacgaugggugggacuugagggaugcagcaguggcgugcagacagcugggaugcgguggcgcucucgcugcccccggaggagcguuuuuuggugaaggagcuggccccguauggcugagcgaauuggcuugucgaggaaaugaggggcagcuagguuugugucaccacagaggcuggaaggcucacaucugcucacacgaagaggacgccggagucgugugcgcuggucaacguguggcaaacagccgggaugauucaaccagcccuuuagauggugccccuuggcccggccuacugcucgaauugaguccaucaaccgaagagccucuagucacucaugccccacguccggcagguaacccacagaacgccucucguaagaaaucucccaggccuaagcaggccaaguccacccgcgcgccacugcugaccaccggagcacccagacaagagagguuacggcucgugagcggaccucacagaugugcugggcggcucgaaguguggcacggggggagauggggaacugugugugacgauggaugggaucuccgagacgcugcgguggccugucgugagcuggggugugggggagcacucgccgcccccggaggggcacgcuucggcccuggugcagggccuguauggauggacgacgucgguuguggaggcggggagcaggcccugagggauuguccuagaagcccaugggggaggaguaauugugaccauagcgaggaugccgguuugguuugcaccggccccgccccaaggcuaagacucgcugauggcccgcacggcugcgccggcagacuggaaguguggcacggcggccgauggggaucaguaugcgaugacgccugggacuugagagacgccgcaguggccuguagggaguuaggauguggaggggcucuugcugcaccaggaggcgccuuuuucggcgaggggucagguccuauuauccuagaugaccuccggugcaggggcaacgagacagcgcuccguuucuguccagcacguccguggggacagcacgauugccaucacagagaagacgccggugccgugugugauggaaugccacucggauaugucccaccuacagccccaacugauucaaauaacagcacaccucgagaggcugcuaguagaccuccaagcacuaugaccagccaagcaccaggcaccgccggcguuucaccacccccagccagccccacaguccuuugggaaccaggacccgaggccgguucaccccaacugcgccuugucgccgggccgucuaaguguucugggagauuagagguguggcaugaucagcguugggggaccgucugcgaugauucaugggacaugcgggauagcgcgguaguaugucgcgaacugggauguggcggcccacagcagccugaucccgccgcagggagguucggguggggugcuggaccaaucuggcuggaugauguggggugugucgguacagaagcaagccuuuccgauuguccagcugcucccugggguaaacauaauugcgcacauaacgaggauguaggcguuaccugcacuggacccccuggacuggauaguauuucggacccuuucucuuggucauggauuccuggccugggucgggaccgcgaugcgugguugccuggcgagcuugccaccaagcccuccgccuccgugacugcuagcguccuagaaaagacuacgacaaaggcgccugguaagaugcccaaaagcacgaaaaaguggguuacaaagaaugccaaacgccccacaacucagccacccguuaugccuacuaccaaacauucccgugcucagucuccccccgauuugaccucacagaccacugcagcucucaccaccgaggccaguagaagacccacaagcgaguucacucgacggccuaccaccgaagcuccccagcgauggacuucccacacuacugcaacuuuaacgccccaggccccgcgcgagagaacuaccaaaaccauggcaaugcugacaacgcaaggaccccaagagaugacaagcgagagcacgauuaagucaaucccacaggccucccuugaacccagcgccgagauaccugaaggcagcccugaaagccccaaggacccagcaccuucacccagcguuuccacgacuggggagagugggcuauuccgaguuagacuugcugacggaccaaaucgaugcgccggaagauuagaaguuuggcacgcuggucgcuggggaaccgugugugacgauaauugggaucuuagggaugccacgguggcauguugggagcucggaugcggcaaggugcggccaagaguaggaaagacacauuacggccccggaacaggacccauuuggcucgaugacauggguugcaaagguuccgaagcaagcuuaucagacuguccaucaggagcauggggaaaacacaauugcgaccaugaggaagacguuggccugacauguacaggguacacagauuacgacgacuauccgccauggaccugggacccgacaucacgagaagaucuggcgaagggaaccacgaccgccggcgugccuggacauacucuacccuggcgaacuacccgccggccgggcuccuccucucccgcgauuagacgacugccugacacuggcuccaaagacggauauaagcugcccuggacuugggacacacccucuggaaggggacuggccgaaggaacuccaacugccggcaagcuaggaccaacacuaggagccggaacgaccagaagcccaggauccccacccacuuugcgcgugcacggcgauaccggauccccucgcaagcccuggcccgagcgccgccccccgagacccgcggcgacacgcacagcgccuccgacaccaagcccagguccuucagccuccccagguccuccuggccccgcguuaaccagugauuccucucgagaauugaccccccacucagccuugaccuccgaagccaccucagaugcuccugauacaucacccccgacaccggaccccgccucucgcaccaaccccgacuugauacucacauccccugauuuugcccuuaguacuccggacucuuccgugguccccgcccucacccccgaaccaaguccgacucccuugccgacacucccuaaggaacugaccagugauccuucuacccccuccgaagucacaucacuguccccgaccucagagcaagugcccgagagugauaccacuccagaucuugacacuacaccguauagcucaacaguuucugaauacagccgcucaccagacccaucuccaucaccgcauccuacuacaacuccagauccaaccauggcuccagacccuaucacuacacugaauccuaccgugaccccucauuucccuaccaccccucaucccaccaccacaccccacccaaccaccaucacccacuccacaaugauuccugaccccacaacuaccccacaacccuuuacuacuauaacucacagcacaaugauaccagaccccacaaccacuccacaacccuuuacgaccaugcagccuacaaccacuccccauuccaccaccccucacccaacuaccacuccucauccaacuacuaucacccacaguacuaugauucccgacccuaccaccaccccucagccuuucacaaccaugcaaccaacuacaaugccucacccaaccaccacuccgcacccuacuacuacuccccaccccacaacaacgccacaccccacgaccaccccucaucccacaaugacuccugauccgaccacaacucccuaccccaccaccaccccagauccaaccacaacaccccaucccacaacuccugauccgucuagcacgcccgugauuacaaccgugucucuccccaccucccucggcaccgaacuaagcucuccuacauuggcccccacagugaaaccuucucuacauccucagcuaacauuuaccgccccagccccucacacuucuacuucccagauucccacguuagaaccuaguccugcgcucgaaaguagcccaucgcgcucuuccacggcaacuuccauggaccccuuaucuaccgaggauuucaagccuccacgcagccaaucuccuaaucuuacaccgccgccgacccacaccccccauagcgcuagcgaccucaccgucucaccagauccucuucucucaccaaccgcucacccccucgaucacccaccuuuagauccgcucacacucggcccuaccccuggucagucaccuggaccccauggcccgugcguugccccgacgccaccgguaagagucauggccugcgaaccccccgcccuuguggaacugguugccgcugugcgggacguaggaggccagcuacagaggcuuacccaaguuguggaacaagagcggcaggaaagacaagcacucuuacugggccugacccaguugguggaagcugcacgcggucuggggcaacucggcgaagcugugaaacgauuggccgaaauggccuggacaacaucaaugccagccccaacuaccaccacaccagaagaggaagaaaggccacuccgaggggacguguag

SEQ ID NO: 14261 - RNA, 1911 nt, Artificial Sequence
  Description of Artificial Sequence: Synthetic coding sequence
augacuaccuggucccugcgccggcgcccugcuagaacucuuggucugcugcugcugguagugcucggauuccuugugcugaggagacuagauuggucaacccuuguuccccuaagacugcgccauagacagcucggacuucaggccaaagguuggaacuuuaugcucgaagauagcacguuuuggaucuucgggggaucaauacauuacuuucgggucccccgagaguauuggagagaucggcuucugaaaaugaaagccugcggacucaauacauuaaccacauacguucccuggaaucugcaugaacccgagcgcggcaaguuugauuuuucuggaaaccuggacuuagaagccuuugugcucauggcugcagaaauaggguuaugggugauccuuagacccggcccguacauuuguucagagauggaccugggagggcugccuucgugguuacuucaagauccugggaugaggcugcggacaacauauaagggcuucacagaggcuguagaccuguacuucgaccaucuuaugagccggguagugccuuuacaguauaagcggggcggucccauuaucgcuguucaagucgagaaugaguacggcuccuacaacaaagauccggccuacaugcccuacgugaaaaaggcccuugaggaccggggaaucguggaacugcuccuaaccucugauaacaaagauggccugagcaaagggauugugcagggcguauuagcaaccaucaaucuucaaucaacccaugaacugcagcuuuuaacuacuuuccucuuuaacguucaaggaacccagccaaagauggugauggaauacuggaccggaugguuugacuccuggggcgguccacauaacauucuugacucaagugaagugcugaagaccguuagcgccauugucgaugcuggaucuucuauuaaccuguauauguuccacggagguaccaacuuuggauucaugaacggugccaugcauuuucacgauuauaaaucggacgugacuucuuacgacuaugaugccguacuuacagaagccggagauuauacggccaaauacaugaagcuacgcgauuuuuucggauccauuuccggcauucccuuacccccuccacccgaucuuuugccaaagaugccuuaugagccucucacacccgugcuguaccuuucauuaugggaugcccugaaauauuuaggcgaaccuaucaagucugagaagcccaucaacauggagaauuugccugucaacgguggaaacggccaaucuuucgguuacauccuguacgaaacuuccaucacuaguucaggcauuuuaucuggccauguccaugacagagggcagguuuucguuaauacaguuagcaucgguuuccucgacuauaaaacuacuaagauugcugucccucuuauacaaggcuacaccgugcugagaauacugguggaaaaccggggaagaguuaauuacggcgagaacaucgacgaucagagaaagggacuuaucgguaaccuuuaucuuaaugauuccccucuaaaaaauuucaggauauauucucuagauaugaaaaagagcuucuuccaacguuucggauuagauaaguggucaagcuuaccagaaaccccuacacuuccagccuuuuuuuugggaucucuaaguauaucuaguacacccugcgacaccuuucuaaaacuugagggaugggagaaaggcgucguguuuauaaaugggcaaaacuuagggagauacuggaauaucggcccucagaagacacuguaucugccuggaccuuggcuuucuucaggaauuaaccaagugaucgucuucgaggagacaauggcaggaccugcccuccaguucacagaaacaccccaucucggucgaaaucaguauaucaaauag

SEQ ID NO: 14262 - RNA, 2037 nt, Artificial Sequence
  Description of Artificial Sequence: Synthetic coding sequence
augagaacaguaguacugaccaugaaagccuccguuaucgagauguuccugguuuugcucgugaccggugugcacaguaacaaggagaccgcaaaaaaaaucaaaaggccuaaguucaccguuccacagauaaauugugauguuaaggccggcaaaaucauugaccccgaauuuaucguuaaguguccagcagggugucaggacccaaaguaccacgucuauggaaccgauguuuaugcuucuuacaguagcguaugcggcgccgccgugcacucaggugugcuagauaauuccgggggcaagauucuugugcgcaaaguggcuggccagaguggauauaaagggucuuacagcaauggaguucagagccucucccucccuagauggcgagaauccuuuauuguuuuagagucaaaacccaaaaagggcgugacguaccccagcgcuuuaacauauucaaguucaaagaguccugcagcucaggcaggugaaacaaccaaggcauaucaaaggccgccgauacccggaacaaccgcucagccagugacucuaaugcaacuuuuggcaguuaccgucgccgucgccacgccuaccacccucccccggcccucccccagugccgcauccacaacuucuauuccccguccacaguccgucggucaucgcucacaagaaauggaucugugguccaccgcuacuuacacaucaagccagaaccgcccaagagcagacccaggaauucagagacaggauccuucuggagcagcuuuucaaaaaccugugggagcagaugugucgcucggguuagugcccaaagaagaacuuuccacccaaucccuggaacccgucucucucggggauccuaauugcaagaucgaucugaguuuccugauugacggcucgaccuccauaggcaagagacgcuuccgaauccagaaacagcuucucgcugaugucgcacaagccuuggauaucggaccugccggcccucugaugggagugguccaauacggggacaaucccgccacccacuuuaaccucaagacccauacuaacucaagggaucucaaaacagcaaucgagaagauuacccagcggggcgggcucucuaacgucggucgagcaaucucauucgucacaaaaaauuuuuucuccaaagcuaacgguaacagaucuggugcucccaacguagugguugugaugguggacgguuggccuacagacaaggucgaagaagccucccgacuagcgagagaaucugggaucaauaucuucuucaucaccaucgaaggagcugcugagaaugaaaagcaguacgugguugagccuaacuuugcgaauaaagccgugugccguacaaauggguucuacagucugcacgugcagagcugguucgggcuacauaaaacacuacaaccacugguaaaacgcguuugcgacaccgauagacuugcauguuccaaaacauguuuaaacucagccgacauuggauuugucaucgauggcucuagcuccguugguaccggcaacuucaggaccgugcuucaauucgugacaaaucugacaaaggaguucgagauaucagacaccgauacuaggauaggggccgugcaguauacuuacgagcagcgacuagaauucggauuugauaaguauaguagcaaaccagauauucuuaaugccaucaaacgagugggauauuggagcggcggaacauccaccggugcagccaucaacuuugcucuagaacagcucuuuaaaaaaucuaaaccuaauaagcggaaauuaaugaucuuaauuaccgacgggaggagcuacgacgauguccgcauaccugcaauggccgcgcaucuaaagggcgugaucaccuaugcuauugggguugcuugggccgcacaagaagaauuggaaguuauagccacccauccugccagagaucauuccuucuucguagacgaauucgauaaucuacaccaguauguucccagaauuauccagaauauaugcaccgaguuuaacagccagccucguaacuag

SEQ ID NO: 14263 - RNA, 324 nt, Artificial Sequence
  Description of Artificial Sequence: Synthetic coding sequence
ugaaccguagcugccccaucaguuuuuauuuucccaccuagcgacgaacaguuaaaaagcggcaccgcauccgucguuugccugcuuaauaauuucuacccucgcgaagcuaaaguucaguggaagguagacaaugcgcuucaguccggcaacagccaggaauccguuaccgaacaggacucaaaagauuccaccuauuccuuaucaucgacccucacccucagcaaggccgauuacgaaaagcacaaaguuuacgccugcgaggugacucaccagggccugucuucgccugugaccaaaaguuuuaauaggggggaguguuag

SEQ ID NO: 14264 - RNA, 366 nt, Artificial Sequence
  Description of Artificial Sequence: Synthetic coding sequence
auggugcugcagacucaggucuuuaucagccuccuacuguggaucucaggcgcguacggugauauagucaugacacaaagcccagauagucuggcugugagucugggggagagagcaaccauuaauugcaagucuucgcagaguguguuauauucuaguaauaacaagaauuaucuugcaugguaccagcagaaaccaggccaaccccccaaacuucuuauuuauugggccucgacaagggagaguggcgugccggauagauuuucuggaucuggaagcggcacggauuuuacacugaccauuuccucccuccaagccgaagaugucgcagucuacuauugccagcaguacuacaguacaccuuag

SEQ ID NO: 14265 - RNA, 984 nt, Artificial Sequence
  Description of Artificial Sequence: Synthetic coding sequence
gccagcaccaaaggccccucaguuuuuccuuuggcuccguguucucgaaguacuucagaaucaaccgccgcgcugggauguuuggugaaggacuauuucccugagcccguuaccgucagcuggaauaguggggcccuuacaagcggaguucacaccuucccugcuguccuccaaucuuccggacucuacagucucagcuccguugucacaguuccuucuaguucauuaggcaccaagacauacaccugcaacguagaccauaaaccauccaauaccaaaguggauaaaaggguggagucuaaauaugguccccccugcccuaguuguccagcgcccgaguuccuugggggucccagcgucuuucuauuucccccaaagccuaaagacacccugaugaucagcagaaccccugaaguaaccuguguggugguugacgugucccaagaagacccggagguccaguucaauugguaugucgacggaguggaggugcauaaugccaaaacaaagcccagagaagagcaguucaauagcaccuacaggguugugucagugcuuacuguccugcaucaagacuggcugaaugguaaagaguacaagugcaagguaagcaauaaaggacugccuuccucuauugaaaagacgauuucaaaagccaaaggccagccgcgcgaaccacagguguauacccuucccccaucccaggaagagaugacuaagaaucaaguaucccugaccugcuuggugaaaggcuuuuaucccagcgauauagcuguugaaugggaaucuaauggacagccugaaaauaacuacaaaacaaccccccccguucuagauucagacggcucauucuuucucuacaguaggcuaacagucgauaaaaguagguggcaggagggaaacguauucucauguucagucaugcacgaagcuuugcauaaccauuauacacaaaagucacucagucugagcuuaggcaaguag

SEQ ID NO: 14266 - RNA, 981 nt, Artificial Sequence
  Description of Artificial Sequence: Synthetic coding sequence
gcaucaaccaaaggaccauccguguucccccuagcuccaugcucucgcucuacaucagaaucuacagcagcacucggcugccuuguuaaagauuacuuuccggaaccaguaaccgugagcuggaauucgggagcccugacauccggagugcacacauucccagcaguccuccagagcuccggccuuuauucccugucaagcgucguuacuguacccucuucaaacuuuggcacacagacuuacacauguaacguugaccauaaacccucaaauaccaagguggauaaaacugucgagcggaaauguugugucgaaugccccccgugucccgcuccuccuguugcugggcccagcguguuucucuuccccccaaagccuaaagacacucugaugauuagcagaaccccagagguaacaugcguggugguggacguaagucaugaagacccagaaguacaauucaauugguauguugacgguguugagguccauaaugcuaaaaccaaaccccgcgaggaacaguucaacuccaccuuccgcgugguaucugugcuuacugucgugcaccaggacuggcucaacggcaaggaguauaaaugcaagguaucaaacaaaggacuuccugcuccuauugaaaagacaaucaguaaaaccaaaggccagcccagggaaccucagguguauacacuuccuccuucucgggaagaaaugacaaaaaaccaagugucauugaccugccugguuaagggcuuuuaucccagugauauuucaguagagugggaaaguaauggucagccagaaaauaauuauaagacaaccccaccgaugcuugauagugacgguuccuucuuccucuauaguaagcucaccguugacaagucacgcuggcagcaaggcaauguauuuucaugcucugucaugcacgaagcccuacacaaccauuacacacagaagucccuaucauugaguccaggcaaguag

SEQ ID NO: 14267 - RNA, 993 nt, Artificial Sequence
  Description of Artificial Sequence: Synthetic coding sequence
gcaucuaccaagggaccguccgucuucccacuggcaccuucuucaaagucuaccuccgggggcacggccgcccuggguugucuggugaaggauuacuuucccgaacccguaacuguuagcuggaauagcggagcacuuacuucuggcguucacacuuucccagccguacugcaaagcagcggccuguauucuuugucuuccgucgucaccguuccaucuucuucacugggaacacaaacauacaucugcaauguuaaccacaagccuuccaacacaaaagucgacaaaaaaguagagccuaaguccugugauaagacacacaccugccccccaugccccgccccagagcuccuaggcggaccauccguauuccucuuuccgccaaaacccaaagauacgcuaaugauauccagaacccccgaggugaccugcguagucguggaugugucccacgaggauccugaggucaaguucaauugguacgucgacggcguugaaguacacaaugccaaaaccaaaccucgagaagaacaauauaauuccacuuauaggguaguguccgugcucacaguacuccaccaagauugguugaauggaaaggaauauaaaugcaaggucuccaauaaagcucugccugcaccuaucgagaaaacuaucucuaaagccaagggccaacccagggaaccucagguguacacccuuccaccuucaagagaugagcugacuaaaaaucaagucuccuuaacuugucuugugaagggauucuaucccuccgauaucgcuguagagugggaaaguaauggucaaccugagaauaacuauaagacaacgcccccggugcucgauuccgacgguucuuucuuucuguacuccaaguuaacuguggacaaaagccgcuggcagcaaggaaauguguucucuuguucaguuaugcaugaagcucugcacaaccacuacacccaaaagucacugucucucucccccgguaaguag

SEQ ID NO: 14268 - RNA, 651 nt, Artificial Sequence
  Description of Artificial Sequence: Synthetic coding sequence
augggugccguuaugggcacuuuuucaucccugcagacgaagcaacgacgucccucuaaagauaagauugaagaugagcucgagaugacaauggugugucaccggccagagggcuuagagcaguuggaggcucagacuaacuuuacuaaacgcgaacugcaaguccuguauaggggcuuuaagaacgagugcccuuccggaguuguuaaugaagacacauuuaagcagaucuacgcgcaguucuuuccucauggagaugcaucgacauaugcacacuauuuauucaaugcuuuugauaccacacaaacagguucuguaaaguucgaggacuuuguuacggccuugucaauuuuacugcgcggcacaguacacgaaaaauugcguuggacauucaaccuguaugacaucaacaaagacggguacauaaauaaagaggagaugauggacaucgugaaagccauauaugauaugauggggaaguacacuuauccagugcucaaagaagauacccccagacagcauguggauguuuuuuuucagaagauggacaagaacaaagacggaaucguaacccucgacgaauuucucgaaucaugccaggaggaugacaauauaaugagaucccuccagcuguuccagaaugugauguag

SEQ ID NO: 14269 - RNA, 762 nt, Artificial Sequence
  Description of Artificial Sequence: Synthetic coding sequence
auggcgcggucacuccugcucccccuucagauucuccucuuaagcuuagcccucgaaaccgccggugaggaagcacagggugauaaaauuauugacggggccccuugugcucguggaucacaucccuggcaaguggcucuacucucuggcaaucagcuucacuguggagggguccucgugaacgaaagauggguguuaacugccgcucacugcaagaugaacgaguacacuguccaccuggggucugacacuuugggugacagaagggcacaaaggauaaaggcaucgaagucauucagacacccagguuacucuacucagacccacguaaaugacuugaugcugguaaaacuuaauagucaagcuagacucagcuccauggugaagaagguacgacugcccucccguugugagccuccaggaacaacuugcacuguaucagguuggggaacaaccacaagccccgacgugacauuuccuagugaucugaugugcguggacguaaagcucauuagcccccaggacuguaccaagguguacaaggacuuguuggaaaauucaaugcuaugcgcugguauucccgauagcaaaaaaaaugccuguaacggcgauagcggcgggccacuggucugucgggggacgcugcagggccugguuucauggggcacuuuuccuugcgggcagccuaaugacccaggaguuuacacccaggucugcaaauuuacaaaauggauaaaugacacaaugaagaagcaccgauag

SEQ ID NO: 14270 - RNA, 468 nt, Artificial Sequence
  Description of Artificial Sequence: Synthetic coding sequence
auguuccaacgccuguuacuguugcugcuucugaguaugggaggaacaugggcuaguaaggagcccuugagaccucgaugcagacccauaaacgcaaccuuagcaguugagaaagaaggcugccccgugugcauaacuguaaacacaacgauuugugccggcuacugucccacaaugacucggguccugcagggugugcuccccgcuuugccccaaguugugugcaauuaccgcgacgugcgcuuugaaaguauucggcugccuggcugcccucgcggugucaacccaguuguaucguaugccgucgcccuuucuugccagugugcccugugcagacgcucuacuaccgauuguggcggacccaaagaccauccacugaccugcgacgaccccagauuccaagacucuucuuccaguaaagcuccaccgccaucacugccuaguccuucuaggcucccaggaccuuag

SEQ ID NO: 14271 - RNA, 1554 nt, Artificial Sequence
  Description of Artificial Sequence: Synthetic coding sequence
auggccgugagcagaaaggauuggagcgcauugagcuccuuggcucggcagagaacacuagaagacgaagaggaacaggagagagagcguaggcggcgccaccgaaacuuguccagcaccacugaugaugaagccccuagauugucucaaaauggggaucgccaagcuagugcaagugaaagacuuccuuccgucgaagaagcugaggugccuaagccucucccaccagccagcaaagacgaagaugaagauauacagagcauacuaagaacacgccaagagaggcgacaacgacggcagguggucgaggccgcacaagccccaauucaggaacgguuggaggcugaggaagggcgaaacucacucagucccgugcaagcaacacagaaaccauuagucaguaagaaggagcuugaaauuccaccacggagacgucucagcagagagcaaaggggcccuugggcacucgaggaggagucucugguuggccgcgaacccgaagaacgcaagaagggcguccccgagaagucaccuguucuggaaaaaagcagcaugccuaaaaaaacugcccccgagaagagccuuguuuccgacaagaccucuaucagcgaaaagguccuagcauccgaaaagacuagucugagcgagaaaaucgcggucagugagaagcgcaauucaucagaaaagaagagcguccuggagaaaacuucaguuagcgagaaaagccuugccccuggaauggcccugggcucaggaagacggcuuguauccgaaaaagccagcauuuuugagaaagcauuggcuucugaaaagaguccuacugcagaugcuaagcccgccccuaagagagccaccgcauccgaacagccauuagcgcaggagccgcccgcuagcggggggucgccugccacuacaaaggagcagcggggaagagcccuaccugguaaaaaccucccuucacucgcuaagcagggcgcuucugauccccccacgguagcuagucgauuaccuccugugacacuucaggugaaaauaccauccaaagaggaggaggccgauaugagcuccccaacacagcggacauacucaucuagucuaaagcgcucuucuccacgcaccauuagcuuucguaugaagcccaagaaagagaacucugagaccacacuuacacgcagcgccucuaugaaauugccagauaauaccgugaaacuuggggaaaagcuggaaagauaucacaccgcuaucagaagaucagaaagugugaagaguagggggcugccaugcaccgaacucuucguugcucccgugggcguggcuuccaagagacaccuguuugagaaagagcuugcaggacagucccgcgccgaaccagcaucaucacguaaggagaaucuccgccuguccgguguugugaccagcaggcucaaccuauggauuucuaggacucaagaaucaggcgaccaggauccucaagaagcucaaaaagccucuagcgcaaccgagagaacacaguggggccaaaaaucagauucuucguuggacgcagaagucuag

SEQ ID NO: 14272 - RNA, 270 nt, Artificial Sequence; identical to SEQ ID NO: 12633
  Description of Artificial Sequence: Synthetic coding sequence

SEQ ID NO: 14273 - RNA, 1302 nt, Artificial Sequence
  Description of Artificial Sequence: Synthetic coding sequence
auggggaacgccuguugggagcucuacugccuugagcacggaauucaaccugacggccagaugccaagugauaagacaaucggcgguggggacgacucguuuaccaccuucuucugugaaacuggggccggaaaacaugugccucgagccguauucguugaccucgagccaacagugauagaugaaauccggaauggcccuuacagacagcuguuucaccccgaacaacugaucacagggaaagaagaugcugcaaacaauuaugcaagaggacacuacacuauuggaaaggagauuauugauccagugcuagauaggauacguaagcuuagugaccagugcacaggccuacaaggcuucuugguguuucauucuuuugggggcgggacaggcucaggguucacaucguuacugauggagagacuuaguguugacuacggaaagaagagcaaacuggaauucagcaucuacccagcgccucagguuucuacagccgucguugaaccuuacaauagcauccuuacuacacacaccacguuggagcauucagacugcgccuuuauggucgacaacgaagccauuuaugacauuugccgaaggaacuuggacauugaaagacccacauauacuaaucugaaccgcuuaaucucccaaaucgucucaucgauaacugcaucccuacguuucgacggagcccugaacgucgaccucacugaguuccagaccaaucucguuccuuaccccaggauccacuucccacucgcuaccuaugcccccgucauuuccgcggaaaaagccuaccaugaacagcugucugucgcagagauuacgaacgcuuguuuugagcccgcuaaucaaaugguuaagugcgacccuagacaugguaaauacauggcauguugcuugcuguauaggggggacguuguuccaaaagaugugaaugcugcaauugcugcgauaaagaccaagagaucuauucaauucguugacuggugccccacaggauucaaaguuggcaucaauuaucagccucccacagucgucccgggcggcgacuuagcaaaaguacagagggcuguauguaugcucagcaacacaaccgccauugcugaggcaugggcccgccucgaucacaaauuugaccuuauguacgcuaaacgagccuucguccauugguacgucggagaagggauggaagaaggggaauuuucagaagcacgggaggauauggcagcacuggagaaggacuacgaggaagucggcauugauucauacgaggacgaggaugagggggaagaguag

SEQ ID NO: 14274 - RNA, 1965 nt, Artificial Sequence
  Description of Artificial Sequence: Synthetic coding sequence
auggccccuaaaaagcugaguugccugcggagucuucuauugccccugucacuuacucuucugcuuccccaggccgacacccgcagcuucgucguugauagaggccacgaccgauuucuacuagauggcgcuccguuuagguacgugagcgggucauugcauuauuuucgggugccgcguguacugugggccgauagauuacugaaaaugcgguggucaggucuuaaugccauucaauucuaugucccuuggaacuaccacgagccacagccuggcguguauaacuuuaauggcuccagagauuugauugccuuucugaacgaggcugcucuagcuaaccuccuaguuauucugagaccuggcccauacauuugcgcugagugggaaauggggggacucccuagcuggcuguugagaaaacccgaaauucacuuaagaacuucagauccugacuuccucgcagcuguggacucgugguuuaagguucugcuccccaaaauuuacccguggcucuaccauaauggcggcaauauuaucagcauacagguggagaacgaauauggaucuuaccgagccugcgacuuuuccuauaugagacauuuagccgggcucuuucgggcacuccucggggaaaaaauucuguuauucacaacagacgggccagagggacugaagugcggaucucuacgcggucuauacacaaccguagauuucgggccagcagauaauaugacuaagauuuucacacuccugagaaaguacgagccccacggaccacucgucaauuccgaauauuacacuggauggcuggacuauuggggccagaaccacucaacaagauccguuuccgcagugacaaaaggauuggagaauauguugaaacuuggcgcuucagugaauauguacauguuucacgguggaacaaauuuuggguauuggaauggagcugacaaaaaggggagauuucucccaaucacuacaaguuacgacuacgaugcgccaauuucugaggcuggugauccuacaccaaaauuguucgcauugcgagauguuaucagcaaguuucaggaaguacccuuagggccccugccacccccaucucccaaaaugaugcucggacccgugacucugcaccuuguuggccaccuguuagcauuccucgaucugcuuugcccccgggguccaauucacucuauccugccaaugacuuuugaggccgugaaacaggaccauggauuuaugcuguaucggaccuauaugacccauaccaucuucgaacccacaccuuucugggugccaaacaauggaguacacgaucgcgcauaugugaugguggauggagucuuucagggagugguggagaggaauaugagagacaagcuguucuuaacggguaaacuaggcagcaagcucgacauccucguagaaaacaugggaagauuauccuucggcucuaauuccagcgauuucaagggacugcuuaagccuccuauuuugggucagaccauacuaacacaauggaugauguucccucucaaaauagauaaucuugugaaguggugguucccacugcaacucccuaaguggcccuacccucaggcaccaucaggaccgacauuuuauucaaagacuuucccaauuuuaggcuccguuggugauacauuccucuaucugccgggcuggaccaagggccaaguguggauaaacggcuucaaucucggucgcuauuggacuaaacaagggccacagcagacguuauacguuccacgguuccuguuauucccaagaggcgccuugaauaagaucacguuacuggaacuagaggacgucccuuugcagccacagguccaguuucucgacaagccaauucucaacucaacaucaacccugcauagaacccacauuaacucacuguccgcagauacacugagcgcaucugaaccgauggagcuauccggacauuag

SEQ ID NO: 14275 - RNA, 1173 nt, Artificial Sequence
  Description of Artificial Sequence: Synthetic coding sequence
augaaguuccagggaccauuggcuuguuuauugcuggcccugugucuggguagcggggaagcgggaccacuucaaaguggcgaagaaucuacagggacaaauauaggcgaggccuuaggccacggucucggagacgcucucagugagggggugggaaaagccaucgguaaggaggccggaggagcggcuggaucaaaagugagcgaggcacucggacaggggaccagagaagcugucggaacuggggugaggcaggugccuggguuuggcgucgcggacgcgcuggggaauagggugggcgaggcugcccacgcuuuggggaauacaggacaugagauaggcaggcaggcugaagauguuauucgacacggcgcagaugcugugcgagguucauggcagggagucccaggacacaauggcgcuugggaaaccagcgggggacauggcauuuuuggcucacagggcgguuuagggggacagggacaagggaauccgggaggacuuggcaccccaugggugcauggcuaucccgguaacucugcuggaagcuucggcaugaauccacaaggagcuccguggggacaaggaggcaacgggggaccacccaauuuuggaaccaacacacaaggcgccguggcacaaccagguuacggguccgucagagcuucaaaccagaacgaagggugcaccaacccaccaccgucugguagcggcggggguucauccaacucaggcgguggaagcgguagucaauccggcucaagcgguagcggaucuaauggagauaacaauaauggcucaucaagcggggguucaucguccggaucuucuucagggggauccucuggaggcuccuccggcgggucuagugggaauagcggagguagcaggggagacuccggcucugaaucaucuuggggaaguucaacagguucaucuagcggcaaucaugguggcagcgggggcgguaacggccacaaaccugggugcgaaaagccaggcaaugaggcuaggggcuccggggaaagcggaauucaaggauuucgcggacagggcgugagcaguaauaugaggaacagcgagaccucuccaggcauguucaacuucgauaccuuuuggaaaaacuuuaagucaaaacugggcuuuaucaauugggacgccauuaacaaauag

SEQ ID NO: 14276 - RNA, 846 nt, Artificial Sequence
  Description of Artificial Sequence: Synthetic coding sequence
auggggagucggggacagggacuccuguuagcuuauuguuuacuguuggcuuucgccucuggccuggugcugucuagagucccucacguucagggagaacaacaggaaugggaggguacugaagaacugccaagcccucccgaccacgcugaacgagccgaagagcaacaugaaaaauauaggccuagucaggaccaaggauugcccgccuccagaugucuccguugcugcgaucccggcaccucgauguacccagcuacugccgucccacaaauuaauaucacuauacugaagggagaaaaaggagacaggggcgaccgagggcuacaggggaaguacggcaaaaccgggagcgcaggagcccgcggucacaccggaccaaagggacagaaaggaucuaugggcgcaccuggugaaagauguaaaucucacuacgcugcuuucuccgugggaagaaagaagccuaugcacaguaaucauuacuaucagacugugaucuuugauaccgaauucgucaaucuauaugaccauuucaacauguuuaccggaaaauuuuauugcuacguaccaggacucuauuucuucucccugaacguucacacauggaaucagaaagagacauaccugcauauaaugaaaaacgaggaagaaguggucauucuguucgcccagguaggggaccgaucuaucaugcagucacagagccucaugcuagagcugcgagaacaggaccaggugugggugcgccucuacaaaggagagagagagaaugcaaucuuuucagaagaauuagacacuuacauuacuuuuucuggauaccuaguuaaacaugccacggagcccuag

SEQ ID NO: 14277 - RNA, 876 nt, Artificial Sequence
  Description of Artificial Sequence: Synthetic coding sequence
gugcucagcgcaucuggaccaggccgaaaaauggggagcaggggccaaggcuugcuacuggcuuacuguuuacuucucgccuuugccaguggacugguguuaagcagagugccccacgugcaaggagagcaacaggagugggagggaacagaagagcuuccuagcccaccugaucacgcggagcgcgccgaggaacaacacgagaaguaucgcccuucacaggaucaaggacuuccagccucccgcuguuuaagaugcugcgaucccgggacaagcauguacccggccacugccguaccacagaucaauauaacaauccuaaagggagaaaagggcgaucgaggugauagaggcuugcagggaaaauacggaaagacuggaucagccggcgcucgagggcacacgggccccaaaggacagaagggcaguaugggagcaccaggagagcgcuguaagucacacuacgcagccuuuagcgucggacgaaagaagccaaugcauucgaaucauuauuaccagaccgucauauucgacacugaguucgucaaccucuaugaucauuuuaauauguuuacggggaaguuuuauugcuacgugccaggccuguacuuuuuuucccugaauguacacacauggaaucagaaagagacuuaucuacauauuaugaaaaaugaggaagaagucguuauacuuuuugcccaggugggggaccgcucaauaaugcagagccaaucauugauguuagaguuaagagagcaagaccagguuugggugaggcucuacaaaggcgaaagggaaaacgcaaucuuuucugaagaacucgacacuuauaucacauuuuccggcuaccuggugaaacaugccacggagccauag

SEQ ID NO: 14278 - RNA, 1002 nt, Artificial Sequence
  Description of Artificial Sequence: Synthetic coding sequence
augguaagcaaaagucgauggaagcuccuagccauguuagccuugguccuggucgugauggugugguauuccaucucuagagaagauagauacaucgagcuuuucuacuucccaauuccagaaaaaaaagagccaugccuccagggggaagcagagucaaaagcauccaaguuguucggcaauuauucucgggaccaaccaauauuccugagauuggaagauuacuucuggguuaaaacaccauccgcauacgaacuuccuuacggaacgaaaggaagugaagaccuucuccuuagaguuuuggccaucaccaguagcuccauccccaaaaacauccagucucuccguugcaggcgauguguggucguuggaaauggccaccgccugaggaauaguucacuuggagaugcaauuaauaaguacgacguagucauaaggcucaauaaugcuccaguugcgggcuacgaaggggacgugggguccaaaacgacaaugcgccucuuuuauccagaaucugcccauuuugacccuaaaguagagaauaacccagauacccuccuagucuuggucgccuucaaagcaauggauuuccacuggauugagacaauacuuuccgacaagaagagagucaggaagggauucuggaagcagccaccacucauaugggacguaaauccaaaacaaauccguauacucaauccguuuuuuauggagauugcugccgacaaacugcucucacuaccuaugcaacaaccuaggaaaauaaaacagaagccaacaacuggucuacuggccaucacccucgcucugcaccuuugcgaccucguccauaucgccggcuucggguacccugaugcuuauaauaagaaacagaccauccauuacuaugagcaaaucacccugaagaguauggccggaucgggacauaauguaagccaggaggcccuugccauuaaacgcaugcuggagaugggagccauaaagaaccucacuucuuucuag

SEQ ID NO: 14279 - RNA, 312 nt, Artificial Sequence
  Description of Artificial Sequence: Synthetic coding sequence
augucugguagagguaaaggcggcaaaggcuuagguaaggggggggcuaagagacacaggaagguauuacgggacaacauccaggggauaacuaaaccggccaucagacgccuagcacggagaggcggagucaaaagaaucaguggccucaucuaugaagagacuagagggguacuuaagguguuccuggagaacgucauccgugacgcagucacauacacugaacaugcaaagcggaaaaccgucacagcaauggacguaguauacgcccuuaaacgucagggacggacgcuauauggauuuggcgguuag

SEQ ID NO: 14280 - RNA, 312 nt, Artificial Sequence
  Description of Artificial Sequence: Synthetic coding sequence
augucaggacgaggaaaggguggaaagggacuuggaaaagggggggcgaagaggcaccggaaaguauugcgugacaauauccaggggaucaccaaaccagcuaucaggagacuggcccgacgcggcggagugaaacgaaucucuggucuuaucuacgaagaaaccaggggggugcuaaaaguguuucuagaaaaugucauccgggacgcugucacauauaccgagcacgccaaacgcaagacagugacugccauggacgugguguaugcucucaaacggcagggccgcacacuguacggguucgguggauag

SEQ ID NO: 14281 - RNA, 312 nt, Artificial Sequence
  Description of Artificial Sequence: Synthetic coding sequence
auguccgggagaggaaaaggcgggaagggacugggcaaaggcggggcgaagagacaccggaaagugcuucgggauaauauccaaggaauuacaaaacccgccauucggcggcuggccagacgaggcggaguuaagaggauaucaggucugaucuacgaggaaaccagggggguguuaaaagucuuccuggaaaaugucauccgagacgcgguaaccuauaccgagcaugcuaagcgaaaaacugugacggccauggauguuguguacgcacuuaaaaggcaggguagaacucuguacggcuuuggcggcuag

SEQ ID NO: 14282 - RNA, 312 nt, Artificial Sequence
  Description of Artificial Sequence: Synthetic coding sequence
augagcggaagggguaagggcgguaaaggccuaggaaaaggaggugcaaagcggcaccgcaaaguacugagagacaacauccaggggauuacuaagccagccauccgaagacuugcacggcgcggcggggugaagcgcauuuccggccuaaucuacgaagagacgcgcggaguccugaagguuuucuuagagaaugucauuagagaugccgugacuuacacugaacacgccaagagaaaaacagugacagcaauggaugugguauaugcacugaaaagacaagggcggacauuauauggauuuggcggauag

SEQ ID NO: 14283 - RNA, 2268 nt, Artificial Sequence
  Description of Artificial Sequence: Synthetic coding sequence
augccuccauuucugcugcuugaagccguuuguguauucuuguucucccgggucccaccuucccuuccccuccaggagguucaugugucuaaagaaacuaucggaaagauuucugcugccucaaagaugaugugguguagugccgccguagacauuauguuucuuuuggacgggucuaauagcguuggcaaagggaguuucgaacgcucaaaacauuuugcaauaaccgucugcgacggccucgacauaucucccgaacguguacguguuggcgccuuccaguucaguuccacuccucaccuagaauuuccccucgauucauuuagcacacagcaggaaguuaaagccaggauuaagaggaugguuuucaaaggcggacggacagaaaccgaacuagcucugaaguaucugcugcacagaggcuugccgggcggaagaaacgccucagucccacagauccugauaauagugaccgauggaaaaucucagggcgauguagcacugccuuccaagcaacuuaaggagcgaggggugacagucuuugcgguaggaguccgguucccccggugggaggagcugcaugcacucgcuuccgagccacgcggacaacaugugcugcuugcugagcaaguagaggaugcgacaaacggacucuuuucuacacugagcucaagugccaucuguucuagugcaaccccugauugccggguagaagcccauccuugugagcaucgcacgcuugaaaugguccgcgaauuugcugguaacgccccaugcuggcgcgguucgagaagaacacuggccguguuagcagcccacugcccguucuacuccuggaagcgcguauuucuuacacacccggcuacuugcuauaggacuacaugcccagguccuugugacucccagccuugucaaaaugggggcaccugcgugccagaaggccucgaugguuaccagugucuuugucccuuggcuuuuggcggggaggcuaacugcgcucugaagcugucucucgaaugccgcguugaucuucuguuucucuuggauucuuccgccggaacuaccuuagacgguuuucugagggcaaaaguguuuguaaaaagauucguuagagcgguacuuagugaagauucuagagcuaggguugguguugcaacuuauucaagagagcuucuuguagccgugccggugggcgaguaucaagacguacccgaccugguguggagccuggacggaauuccauucagaggagggccaacacugacggguagcgcacuccggcaggcugcagagaggggguucggguccgccacucggacuggccaggaucggccucggagaguuguaguucuccucaccgagucucacuccgaggacgagguagccggccccgcaagacaugcuagagcucgggagcugcuucuguuaggaguugggagcgaggccgugagggcugaguuggaagagauuacagguucacccaagcacguuaugguguauucagacccgcaggauuuguucaaccagaucccagaacuccaagguaagcucuguucaagacagagacccggcuguagaacucaagcccuggacuugguuuuuaugcuggauacuucugccuccgugggcccagaaaacuucgcucagaugcaauccuuugugagaucuugugcccugcaguucgaagucaaccccgacguaacacaggugggacuuguagucuacggcucacaggugcagacugcuuuuggucucgauaccaaaccgacacgcgcugcuaugcuucgcgcgauuucucaagcucccuaccugggcggugucggaucugcuggcacagccuugcugcauauuuaugacaaagugaugacuguucagagaggggcccgaccaggcgugcccaaagcuguugucguccucacgggcggccguggcgcggaggacgcagcugugccagcgcagaaacugaggaacaauggaauuaguguccugguugugggaguugggccuguccuuucagaaggccugagaagauuggcgggacccagagacagucugauacauguggcggccuaugccgauuugagauaucaccaagacguacugaucgaauggcuauguggugaagcuaaacaacccgugaaucugugcaagccaucaccauguaugaacgaggggagcugugugcugcagaauggguccuauagaugcaaaugucgagaugguugggaggggccacauugugaaaaucgguuucuuagaagaccuuag

SEQ ID NO: 14284 - RNA, 816 nt, Artificial Sequence
  Description of Artificial Sequence: Synthetic coding sequence
augaucaccggcguguuuagcaugaggcuuuggacacccguuggaguuuugacuucccuugcauauugcuugcaucagagacgugucgcacucgcggaacugcaagaagcugaugggcaguguccgguggaucgcagucucuugaagcucaaaaugguucaggucgucuuccgccauggagcacguucuccccuaaaaccuuuaccucuugaggagcagguugaguggaacccccaguuacuugaagugccaccccaaacccaguuugacuacaccgucaccaaucuggcaggaggcccuaaaccuuauagcccuuacgacucccaauaccacgaaacaacacugaaaggggguauguuugcaggucaguuaacaaaggucgguaugcagcaaauguucgcucugggggaaagauuacgcaaaaacuacguggaagauauucccuuucuuagcccgacauucaauccucaggaggucuucauuagauccaccaacauuuuccggaacuuggagaguacccggugucugcuggcuggccuguuccagugucagaaagaaggaccuauuaucauccacacugacgaggcugauucagaagugcuauauccaaauuaccaaagcuguuggucacuccgccagagaacccguggccgcagacagaccgccucccuacaaccuggaauuucagaagaucuuaaaaagguuaaagaucgcaugggcauugacuccuccgacaaaguugacuucuucaucuuacuggauaacguugcagcugagcaggaaaagauggguagcugccgcuuucauggaagcuag

SEQ ID NO: 14285 - RNA, 1395 nt, Artificial Sequence
  Description of Artificial Sequence: Synthetic coding sequence
auggagcauaguguguguccaucauccgcaguacauuugaucccgguauccaccccaaagaacggcauguccaguaagucucggaagcgcauuaugccugauccuguuacagaaccacccgugacugaccccgucuaugaagcucucuuguauuguaauauacccagcgucgccgagcguagcauggaaggccacgccccacaccauuuuaagcuggucuccguacacgucuuuauccgccauggugaucgcuacccgcucuacguuaucccaaagacgaagaggcccgaaaucgauuguacacuuguggccaauagaaaacccuaucacccaaagcuagaagcuuucauaagucauaugucuaaaggguccggggccaguuuugagaguccuuugaacucacucccccucuaucccaaccacccgcucugcgaaaugggagaacugacucagacugguguggugcagcaccuucagaauggacagcuacugcgcgauauauaucuaaagaaacacaaacucuugccaaacgauuggucugcagaucagcuauaccucgagacuacagguaagucucggacacuacaauccggcuuggcccugcuuuauggcuuucuccccgacuucgacuggaagaagaucuacuuucggcaccaaccaucugcauuguuuugcuccggguccugcuauugcccugugcguaaucaauaccucgagaaagaacagcggcgacaguaucugcugagacuaaagaauucucaauuagaaaaaacguacggcgaaauggcaaagaucguggacgucccgacaaaacaguuaagagccgcaaauccuaucgauucuauguugugccacuucugccauaaugugucuuuccccugcacccgaaacggauguguugacauggagcacuucaagguaauuaaaacccaccagauugaggacgagagggagcggcgagaaaaaaaauuguacuuuggcuauucauuacucggagcccacccuauuuugaaucagacgauuggccgcaugcaacgagcaacagagggaagaaaagaggaauuauuugcacuuuacucagcucaugacguuaccuuguccccugugcugucugcccuugggcucagugaggcgcgcuucccacgauucgccgcgagguuaauuuucgagcuguggcaggauagagaaaaacccucagagcacuccgugcgcaucuuguauaaugggguugacguuaccuuucacacuucuuucugccaggaccaccacaaacgaucgcccaaaccuaugugccccuuagagaaucuuguaagguuugugaagcgagauauguucguggcgcugggaggcucagguacuaauuauuaugacgcaugccaccgcgagggcuucuag

SEQ ID NO: 14286 - RNA, 1443 nt, Artificial Sequence
  Description of Artificial Sequence: Synthetic coding sequence
augcuguucaggaauagguuccuccugcugcucgcccuagcugcccuacuggccuucgugucuuugucguugcaguucuuucaucuuauuccaguuucuacaccaaaaaaugggaugucuuccaaaucacgcaaacgcauuaugcccgaccccguaacagaaccgcccgugacugaccccgucuaugaagcccugcuguauuguaauauucccuccgucgcagaacgaaguauggaaggacacgccccucaccauuucaaacuuguaagcgugcaugucuucaucaggcauggcgauagauauccucuauacgucaucccuaagaccaaacgcccagagauugauugcacccugguugcuaacaggaagccauaucaccccaaacuugaagcuuucaucagucauaugucaaaaggaagcggcgcaagcuuugaaucaccacuaaacucccugccccuauacccuaaccaccccuuaugcgagaugggcgagcugacccaaacuggcguaguccagcaucuccagaauggccagcuucuaagggacaucuacuugaaaaaacauaagcuccugcccaaugacugguccgcugaccaacuuuauuuagagacaaccggaaagucaagaacucuacagucaggucuggcccugcuguauggcuuucuacccgauuucgacuggaagaaaauauauuucaggcaucagccaagugcccuguucugcucaggcucgugcuacugucccguucggaaucaauacuuggagaaagagcaacgcaggcaguaucuucuccggcuuaagaacagucaguuagaaaagacauauggcgaaauggcgaaaauuguugaugucccuacaaaacagcuccgcgcugcgaaccccauugauucaauguugugucauuucugucacaacguuucuuucccuugcacacgaaaugguugcguugacauggagcauuucaaggucauuaaaacucaccagauugaggaugagcgggaaagacgcgagaaaaaacuuuacuuuggauacucuuuacugggcgcccauccuaucuugaaucagacaauugggagaaugcaacgugccacagaggggcggaaagaggagcuuuuugcacucuacagcgcacaugaugucaccuuauccccaguccucagcgcacugggccugucagaagcucgcuuucccagauucgcugcgcggcucauuuuugaacuauggcaagaucgcgaaaagccuagugagcauucuguaagaauuuuauacaauggaguugacguaacauuucacacauccuucugccaagaccaucauaagcgaucacccaaaccgaugugcccccuggagaaucucgugcguuuugucaagcgugacauguucguagccuuaggcggaagcgggacgaauuauuacgaugccugucacagagagggauuuuag

SEQ ID NO: 14287 - RNA, 1311 nt, Artificial Sequence
  Description of Artificial Sequence: Synthetic coding sequence
augcagggcaccccuggaggaggaacacgacccggcccaagcccuguugauaggcguacauuacuuguguucagcuucaucuuggcagcugcgcuggggcagaugaauuuuaccggugaucagguacuucgcguauuggccaaagacgaaaagcaacugucacugcugggggaccucgagggucugaaaccccaaaaggucgauuuuuggagaggcccugccagaccaucacugcccguagauaugagagucccguuuucugaacugaaggauauuaaagccuaccuggaaucccacggcuuagccuacucaauuaugaucaaggauauucaaguccuguuagacgaagagcgacaggcuauggcgaagucacgcagauuggaacgcucaaccaacuccuuuucuuacucuaguuaccacacucuugaggaaauuuacucuuggauagauaauuucguuauggaacacagugacauaguuuccaaaauccagauuggaaacuccuucgaaaaccagucaauuuuagugcucaaguuuuccaccggagggucucgacacccagccaucuggauugauacugggauacauucucgggaauggauuacacacgcuaccggcaucuggacugcaaacaagauagucucugacuacggaaaagaucgcguacugacggacauucuuaacgccauggauaucuuuaucgaacucguuacaaacccagacggcuuugcuuucacacacuccaugaacagacuguggagaaagaacaagucuauuagaccaggcaucuuuugcauuggggucgaucucaauagaaauuggaaaucaggcuuugguggcaacgguucaaacaguaauccaugcagcgagacauaccacggacccuccccccagucugagccagaagucgcugccauugucaacuucaucacggcccaugguaacuucaaagccuugaucucaauccacagcuauucccaaauguuaauguacccuuauggucgccuuuuggagcccguauccaaccaaagggaacuauaugaucuggcaaaagaugcggucgaagcacuauacaaagugcauggaaucgaguauauuuucggaaguauuaguacaacacucuacguggcaagcgggaucaccgucgacugggcuuacgauagcggaauuaaauacgcuuuuagcuuugaacugcgggacacuggccaauacgguuuucugcuuccagcaacccaaauuauacccacagcacaagagacauggauggcucuccggaccauaauggagcauacucugaaucauccuuauuag

SEQ ID NO: 14288 - RNA, 1161 nt, Artificial Sequence
  Description of Artificial Sequence: Synthetic coding sequence
auggcucaauggcacuguucccaacgaacacaagcaggcggccacggagugggggagagacuggcgcaaugucaggaccaaucaagucgccaugccgcagagcuucgggauuuuaagaauaagaugcugccccuccuggaaguggcugaaaaagagagagaagcucugagaacugaagcugacaccauuucaggacgaguugauagacuggagagggagguagacuauuuggagacacaaaaucccgcuuuaccguguguggaguuugacgagaagguuacgggaggcccagggacuaaaggcaagggacggagaaaugaaaaguaugacauggugacggauuguggcuauaccauuucacaggugaggaguaugaagauccugaaaagauuugguggaccagcagggcuuuggaccaaagaccccuuaggacagacagagaaaauuuaugugcuggauggaacccaaaacgacacagcguuuguuuuuccccggcugcgcgauuuuacuuuggcaauggccgccagaaaggcaucaagagugcgcgucccuuuuccauggguagggacagggcaguuaguguacggaggcuuucuauauuuugcaagaagaccuccugggcgucccgguggcggaggcgagauggagaacacucugcagcugaucaaguuucaccucgcuaaccggaccguggucgacuccagcguauucccugccgagggacugauuccuccuuauggacuuacugcagacacguacaucgaccuugccgccgaugaggaaggcuugugggccguuuacgcaacacgggaagaugauagacaccucugccuagccaaacucgauccucaaacucuugauaccgaacaacagugggauacgccuugcccaagagagaaugccgaagccgcuuucgucauuuguggcacacuauauguaguauauaacacccgacccgccagccgcgcccguauccaauguuccuuugacgccuccggaacacugacucccgagagagcagcccugcccuauuuucccaggcgcuauggugcccacgcuagcuugagguauaauccaagagagagacagcucuacgccugggaugacggauaccagauaguauacaaacuggaaaugagaaagaaggaggaagaaguguag

SEQ ID NO: 14289 - RNA, 990 nt, Artificial Sequence
  Description of Artificial Sequence: Synthetic coding sequence
augcggccaccucccgcacuggcacuagccggcuugugccuucuugccuuacccgcugcugcugccuccuauuucggucugacagguagagaaguuuugacacccuuucccggacugggaaccgccgcugcaccugcacaggggggagcccaccucaagcagugugauuuguuaaaacugagucgcagacaaaagcaacuuugucgcagggagccuggacuggccgagacacucagggacgccgcucaccuggguuuacuggaaugucaguuucaguuucgccacgagcgcuggaauuguucucuggaaggacguaugggcuugcuaaaaagaggcuuuaaggaaacugccuuucuguaugccgucaguagcgccgcgcugacacacaccuuagcucgagcuuguucugcaggucgcauggagcgcugcaccugugacgauagccccggccuagagucucgacaggccuggcagugggggguguguggugacaaccugaaauacaguacuaaauuucucuccaauuuucuggggucaaaaagaggaaauaaggaucugagagcccgggccgaugcucacaauacacauguuggcauuaaggcaguuaagucaggccuuagaaccacaugcaaaugucacggcgucagcggcucgugcgcaguuagaacuugcuggaagcagcugaguccauuccgugaaaccggacaaguccuaaaacuucgauaugacuccgccguaaaaguauccucagccacuaacgaagcuuuagggcguuuggaacugugggcuccagcuagacagggaucacuuaccaagggacuagccccccggucuggggaucugguuuacauggaggauaguccuaguuuuugccggccgagcaaguacagcccaggcaccgcagguugguccgcaguugcccggucgcagcucaucaccacaagcacaaguagaauccaggccauauuaccaucccaacuuccugaauag

SEQ ID NO: 14290 - RNA, 579 nt, Artificial Sequence
  Description of Artificial Sequence: Synthetic coding sequence
augaggcuagccgggccagaaucaaguguuaccgcugcaccuagagcaaggaaguauaagugcgggcugccucagccaugcccugaggaacaucuggccuuccgaguuguaagcggggccgccaaugugaucggaccaaagauuugucucgaagacaagaugcuaaugagcucugugaaggauaaugugggaaggggacuuaacauugcacuugugaauggggugucuggagaguuaauugaagcaagggcauuugacaugugggcuggugacgucaacgaccuucugaaguucauacggccccugcaugaagggacccuuguauucgucgccagcuaugaugauccagccacaaagaugaaugaggagacacgaaaauuguucagcgaacuggguucccguaacgcuaaggagcuugccuuccgggauaguuggguguucguuggugcuaagggcgugcagaacaaaaguccauuugagcaacacgugaaaaacaguaaacauucuaacaaauaugagggguggcccgaagcccuggaaauggaaggcugcauccccaggaggagcaccgcaucguag

SEQ ID NO: 14291 - RNA, 1053 nt, Artificial Sequence
  Description of Artificial Sequence: Synthetic coding sequence
augaaaugcucuuuacgcgugugguuucuuagcguggcguucuugcucguguucauuaugucguuacucuuuaccuacagucaccauucuauggcgacccugccuuaccuggacucaggugccuuggacggcacacacagagugaaacugguuccugguuacgccggccugcagaggcucagcaaagagagguuaucuggcaagucuugcgcaugccgacggugcaugggcgacgcaggagccuccgauugguucgauucccauuuugacggcaacauauccccaguauggacucgcgaaaacauggaucuuccuccagauguucagcggugguggaugaugcugcaaccccaguuuaaaucucauaauacuaacgaggucuuagaaaaacuguuucaaaucgugcccggagagaaucccuauagguuucgagacccccaccaauguaggaggugcgcugugguuggaaauagcgggaacuugcgaggaagcggauacggccaagacguagacggacacaauuucaucaugcggaugaaucaggcgcccacagucggauucgaacaggacgucggcucaagaacuacgcaccauuuuauguacccugaaagcgcuaaaaacuugcccgcaaaugucucuuuuguacuggugccuuuuaaagugcuggaucuccuguggaucgcuagcgcacugaguacugggcaaaucagauuuacuuacgcccccguaaagucuuuccugaggguggauaaggagaaaguucagauauauaacccagccuucuuuaaauacauacaugaucgauggaccgagcaccaugguagguauccuagcaccggaaugcuaguguuguucuucgcccuccacguaugugaugagguaaaugucuacgguuuuggagcugacagucgcgggaacuggcaucacuacugggaaaauaaucgcuaugccggagaguuucggaaaacggggguucacgaugccgacuuugaggcgcacauuaucgacaugcuugccaaggcaucaaagauugaaguuuauagaggaaauuag

SEQ ID NO: 14292 - RNA, 189 nt, Artificial Sequence; identical to SEQ ID NO: 12653
  Description of Artificial Sequence: Synthetic coding sequence

SEQ ID NO: 14293 - RNA, 738 nt, Artificial Sequence
  Description of Artificial Sequence: Synthetic coding sequence
augacauuguucccaguauugcuguuucucguugcaggacugcuucccucuuuucccgcgaaugaagauaaggacccagccuuuaccgcccuauugaccacacagacucagguacaacgcgaaaucguuaauaaacacaacgaguugagaagggccgucucaccaccugcccgcaauaugcugaagauggaguggaacaaagaggcugcggcaaacgcacagaagugggcuaaccaguguaacuauagacacagcaacccaaaagacagaaugacgucccucaaauguggcgaaaaccuguacaugagcucugccucuuccucuuggucccaggcuauucaguccugguucgaugaguacaaugauuuugacuucggaguggggccuaagaccccuaacgcugugguuggccauuacacacagguuguaugguacucuuccuaucugguaggaugcgggaacgcauauuguccaaaccagaaaguacuuaaguauuacuaugucugucaguacugcccagcaggcaauugggccaaucgucuguauguccccuacgagcaaggagccccuugugcuagcugcccagauaacugcgacgaugggcugugcaccaacggcuguaaguacgaggaccuuuauuccaacuguaaaucgcugaagcugacucucacauguaaacaccaacugguaagagauuccuguaaagcauccugcaauugcucuaauucuaucuauuag

SEQ ID NO: 14294 - RNA, 1341 nt, Artificial Sequence
  Description of Artificial Sequence: Synthetic coding sequence
augcugcacccagaaacaucccccggaagaggccaccuguuagcugugcuccucgcacuccugggaacggcuugggcugagguuuggccuccucaauuacaggaacaggcgccaauggccggcgcccugaaucggaaggaaagcuuuuuauuguugagccuccauaauagacuaagaucuugggugcaaccccccgccgccgacaugagaagauuggauuggucugauucccucgcgcagcuugcccaagcccgcgcugcacugugcggaaccccuacucccucacucgccagcgggcuguggcggacccugcaaguuggauggaauaugcaguuacuucccgcuggcuuagucuccuuugucgaagugguuucacugugguucgccgagggccagcguuacucacacgcagccggcgagugugcacggaacgcuacuuguacacacuacacacagcuagucugggcaacaagcagccagcugggcugcggacgucaccucuguucggcaggccaggcugcuauugaagcuuuuguaugcgccuacuccccccguggcaacugggaagugaauggaaagaccaucguuccuuacaagaagggggcauggugcucacugugcacugccagugugagcgguuguuucaaggcgugggaccacgcaggaggucucugugaagugcccagaaacccaugucguaugucuugccagaaucacggucggcuuaacauuucaacaugccauugucacugccccccaggcuauacaggccgcuacugucaagugagaugcucucuccaaugugugcauggccgcuuucgcgaggaggaauguucuuguguaugcgauauugguuauggaggggcccaaugcgcuacaaaaguccauuucccauuccacacgugcgacuugagaauugacggcgacugcuucaugguauccucagaggcggacacuuauuacagggcucggaugaaaugccagagaaagggugguguucuagcgcagauuaaaucccagaaaguacaggauauacuggccuuuuaucuaggcagacucgaaaccacgaaugaagucaucgauucugacuucgagaccagaaauuucuggauaggccuaacuuauaagaccgccaaagauuccuucagaugggcgaccggggaacaccaagcauuuacuagcuucgcauuuggacaacccgauaaucauggauuuggcaauugcgucgagcugcaggcuuccgcugcuuuuaauuggaaugaucagagguguaagacacggaacagauacaucugucaauuugcucaggaacacaucucacgauggggacccgguaguuag

SEQ ID NO: 14295 - RNA, 585 nt, Artificial Sequence
  Description of Artificial Sequence: Synthetic coding sequence
augacuaugagacauaacuggacaccagaucugagcccucuguggguccugcugcugugcgcccacgucgucacccuccucgugcgagccaccccugugagccagaccaccaccgccgcaaccgccucaguccguucuaccaaagacccaugcccuucacaaccuccaguuuuuccagcugcuaaacagugccccgcucuugaggugacuuggccagaaguagaagugccacugaacggcacccuuagucugucuugcguugccuguagcagguuccccaauuuuucuauccuauacugguuaggaaaugguuccuucauugagcauuugcccggaagauugugggaaggcucuacuagucgugaacguggcucuaccgguacacaacugugcaaagcacucguacucgaacagcucacccccgcauuacauucaacuaacuucagcugugugcuuguugaccccgaacaaguuguucagaggcacgucguuuuggcccagcuaugggcuggcuuaagggcaacacugcccccaacacaggaagcacugcccucaucucacuccucaccgcagcaacaaggauag

SEQ ID NO: 14296 - RNA, 585 nt, Artificial Sequence
  Description of Artificial Sequence: Synthetic coding sequence
augaccaugcgacacaauuggaccccugacuuaagucccuugugggugcuccuuuugugcgcacauguggugacccuccugguucgagcuaccccugugagucagacaacuaccgccgcuaccgcaucugugagauccaccaaggaucccugcccuagccagccaccaguguucccggccgcuaagcaauguccugcccuggagguaacauggccagaaguagaagucccgcugaacggcacccugucacugucuugcguugccuguucucguuucccuaauuucucuauucuguacuggcucgguaacggaagcuucaucgaacauuugcccggacggcucugggagggaucuacaucccgggaacguggaagcacaggaacacaguuauguaaggcacugguucuggaacagcuaacaccugcccugcacuccaccaacuuuucuugcguguuagucgaucccgaacaggucgugcagcggcacgucgugcuugcucagcuuugggccggccuacgcgccacacuccccccgacucaagaagcccugccgucuagccauucgagcccccaacagcagggguag

SEQ ID NO: 14297 - RNA, 348 nt, Artificial Sequence
  Description of Artificial Sequence: Synthetic coding sequence
augacaaugagacauaacuggacacccgaccucuccccccuauggguucugcuuuugugcgcccaugucgucacccuccugguccgugcaacaccugugagccagacuacuaccgcugccaccgcaucuguacgcuccaccaaagacccauguccuucccagcccccuguguucccugcagccaaacagugcccugcccucgaaguuaccuggcccgaaguggaagugccccucucuugggccgagggcaaucuggcuccucacccccggucccccgcucugcaaccacagcaaagcaccgccgccggccuucguuuaagcaccggccccgccgccgcccagccauag

SEQ ID NO: 14298 - RNA, 528 nt, Artificial Sequence
  Description of Artificial Sequence: Synthetic coding sequence
augcucccucccauggcacuccccuccguuaguuggaugcugcugucaugccucaugcugcucagccaaguacagggggaagaaccacagcgcgaauugccaucagccagaauucgcugucccaagggaagcaaagcuuacgggagccacugcuaugcucuauuccucagcccuaagagcuggaccgacgcagacuuagcaugucaaaaacgacccagcgggaaccugguuaguguguugucaggcgccgaagguucuuuuguuucaaguuuagucaaauccauugggaauagcuacaguuacguguggaucggacuccacgacccuacgcaggggacagaacccaacggugagggcugggaauggagcucgagcgauguuaugaauuacuuugcuugggagagaaaccccaguaccauaagcucaccuggacauugcgcaucccugucacgaaguacagccuuuuuacgcuggaaagauuacaauugcaacguacgccuccccuacguguguaaguucacggacuag

SEQ ID NO: 14299 - RNA, 993 nt, Artificial Sequence
  Description of Artificial Sequence: Synthetic coding sequence
auggguaagcugugucuaggcccaacucuguguccugcugcagcugccgaggaaagcagggaugcugagccccgccgugaacuccucuguucuggacgucccuggaccuggagagccgcugcccgagugacgaccaugauucccugggugcuucuggcaugugcucuuccuugcgccgccgauccucugcugggagcguucgcacgaagagauuuccgcaaaggcucuccccaacuuguaugcucucugccuggaccacagggaccucccggaccucccggggcccccggacccagcggcaugauggggcguaugggguuucccggcaaggaugggcaagauggacacgacggugauaggggagauagcggagaggaggggcccccuggccgcacugguaaccgggguaagccgggacccaagggaaaagcuggcgccauaggacgagcuggcccaagagguccaaaagggguuaacgggacaccagggaagcacggcacaccuggcaaaaaggggccuaaggggaagaagggugagccuggccucccagggccuuguagcuguggauccggucacacaaagucugcauucucuguggccgugaccaagucuuacccuagggaacggcuaccuauuaaauuugacaaaauccugaugaaugaaggcgggcauuacaaugccaguuccggcaaguuugucugcggcguaccuggcaucuauuacuuuaccuacgauaucacucucgcaaacaaacaccuggcuauaggauuagugcauaacggacaguauagaauaaggacauucgacgcaaauaccgggaaccacgauguggcuagcgggucuacgauacucgcgcuaaaacagggggacgaggucuggcugcagauauucuauuccgagcagaacggacucuucuaugaccccuauuggacagacucgcuauucacagguuuucuaauuuacgcagaucaggacgaucccaacgaaguguag

SEQ ID NO: 14300 - RNA, 390 nt, Artificial Sequence
  Description of Artificial Sequence: Synthetic coding sequence
augagauugcuccuccucguaccacuacuguuagcccccgcacccgggucuucggcccccaaagugaggcgucaaagugauacauggggcccguggucacaguggucacccuguucaaggaccuguggagguggcgugagcuuuagggaacgcccuugcuauucccagcgcagggauggaggcaguucuugcguuggaccugcccgaucacaccgaaguugccggacugaaagcugucccgauggugccagagacuuucgcgcagaacaaugugccgaguucgauggagccgaauuucaggggaggagauaccgcuggcugccauacuauagcgcacccaauaagugugaauugaauuguauaccuaagggacucggguugcagggcuag

SEQ ID NO: 14301 - RNA, 1227 nt, Artificial Sequence
  Description of Artificial Sequence: Synthetic coding sequence
auguucuccaaugcuaauucgaggagcaaaauguggcuuuuacugacuauggcgucuuugaucagcgucuuagguaccacucauggacuuuuuggcaaacugcacccugggaguccugaaguuacuaugaacaucucccagaugauaacauauugggguuauccuaacgaagaguacgaaguugugacggaggacggguacauucuugaagucaacagaauucccuacggcaaaaaaaacagcgguaauacagggcaacggccggugguguucuugcagcacgguuugcucgcuagcgccacgaacuggauuucuaauuuacccaauaauucccuggcauucauucuggccgaugccggcuacgacguuuggcucggaaacucucgcggcaauacuugggccagacggaauuuauauuacagccccgauaguguugaauucugggcguucagcuuugaugaaauggcuaaguacgauuugcccgcaacgaucgacuucauugugaaaaagaccgggcaaaaacaacuucacuacgucggacauucacaaggcaccacaauuggauucaucgcuuucaguaccaauccuucccuagccaagcgaaucaaaaccuucuaugcccucgcucccguugcaacuguuaaguauaccaaaagccuaauuaacaagcuacgauucguaccacaaagucuguucaaauucauuuuuggugauaagaucuuuuauccccacaacuuuuucgaccaguuccucgccacugaaguuuguagccgggagauguugaaucugcuuugcucuaacgcucucuucauuaucugcggcuucgauucaaaaaacuucaacaccucgcgccuagacguauaccugucccauaauccugccgguacaagcguucaaaauauguuucacuggacccaggcugucaaaucagggaaguuucaagcauacgacugggguuccccuguccagaaucgaaugcauuaugaccagucacagccuccuuacuauaacguuaccgccaugaacguucccauugcuguuuggaaugguggaaaggaccuacuagcagacccccaggacgugggccuucucuuaccuaagcuuccgaaccucauuuaccacaaagaaaucccuuucuacaaucaccuggauuuuaucugggccauggacgccccacaggaaguguauaaugauauaguuucuaugauaagcgaggacaagaaguag

SEQ ID NO: 14302 - RNA, 393 nt, Artificial Sequence
  Description of Artificial Sequence: Synthetic coding sequence
auggcguccgaucucauuagaaccauacuugccguugcccucauuuccaaacuuggcacugcaguggaugcggaacugaugccaucuggcgcuauacuucagaacaaaagagagaaccugccucgagugugucacgcucuagcuuuccugggcauggcuagaugucaggaccuuuuccucgucagauugcagggguggaagcuuggcacuagguuucaggauggcccuaggucuacaccucaggaggaaggaggcucaccacagagaaaacgagguaugccaguccagauucacuuucuccuaaaguccuuucucuccucucccaucacauucgccuuuauuucccuagcccguaccguuucacucgccaccgccauuugcaagauuguguag

SEQ ID NO: 14303 - RNA, 393 nt, Artificial Sequence
  Description of Artificial Sequence: Synthetic coding sequence
auggcauccgacuuaauuaggacaauucuugccgucgcccugaucagcaagcuugggacagccguugaugccgaguuaaugccuagcggagcaauccugcaaaacaagcgagagaaccucccccgugucugucaugccuuagccuuucugggaauggcucguugucaggauuuauuucucgugcgcuuacaagguuggaaauuagguacccgcuuucaggacgguccaaggagcaccccacaggaggaagguggaagcccgcagcgaaaaagagggaugcccgugcagauucacuuccucuuaaaaucauuucugucaucaccuaucaccuuugccuucauuucauuagcacggaccgucaguuuagcaacagccauuuguaaaaucgucuag

SEQ ID NO: 14304 - RNA, 1731 nt, Artificial Sequence
  Description of Artificial Sequence: Synthetic coding sequence
augauugucuucggaugggcuguguuccuggcuuccagaucccucggacaaggacuauuacugacccuggaggagcacaucgcccacuuccugggcaccggcggagcugcaaccacgaugggcaauaguuguaucugcagagaugauucaggaaccgaugacucaguugacacccagcagcagcaggcggagaacagugccguuccuacagccgacacacgaagccagcccagagauccugugcggccaccaaggaggggaagagggccacaugagccucgucgcaaaaaacaaaauguugacggucugguacuagacacucucgccgugauacgaacccugguagacaacgaucaggagcccccuuacagcaugauuacccuccacgagauggcagagacagaugaggguuggcuugaugucguccagagccugauccgaguaauuccccuggaagacccacuggggccagcagucauaacacugcuccucgacgaguguccauugcccacuaaagaugcccugcaaaagcuuaccgaaauucuuaauuuaaauggagaaguugcaugucaagacucaucacacccugccaaacacagaaauacauccgcagugcuggggugccuggcagaaaagcuugcgggacccgccucuauugggcugcucuccccugguauuuuagaguaucuccuccagugucugaaacuucaaucacacccuaccgucaugcuuuucgcucugaucgcacucgaaaaguucgcacaaaccuccgaaaauaagcugacgaucucagaaaguaguauaucagaccgccuuguuacccucgaauccugggcaaaugauccagacuaccugaaacggcaaguaggguucugcgcucaauggucacuagacaaucuuuuucugaaggagggccggcagcugacauacgagaaaguaaaucugagcaguauuagagcaaugcuuaauucuaacgacguaucagaauaccugaaaauuuccccucaugggcuugaagcgagaugugaugccaguaguuuugagagcgucagguguacauuuugcguggacgccggugugugguacuacgaggucacagucguuacgucaggagugaugcagauugggugggcaaccagggauagcaaguuccucaaccaugaaggauacgggauuggcgacgaugaauauagcugcgcuuacgacggaugccgccaacugauuugguauaaugcaagaagcaaaccccauauacauccaugcuggaaggagggcgacacgguaggauucuuacuugaccugaacgaaaaacagaugaucuuuuuccucaauggcaaccagcuaccaccagagaaacaaguguuuagcagcacaguauccgguuucuuugcggccgccagcuuuaugucuuaccaacaaugugaauucaauuuuggagcgaaaccuuucaaguacccccccagcaugaaauuuagcacuuuuaacgacuaugccuuccuuaccgccgaggagaaaaucauacuuccgaggcaucgccguuuggcucuacugaaacaaguuagcauccgggagaacugcuguagcuuauguugugaugagguggccgacacacagcugaaaccuugcggccacucagaccugugcauggauugugcucuucagcuggagaccuguccccugugccguaaagagaucguuucaagaauucgacaaaucucucacaucucauag

SEQ ID NO: 14305 - RNA, 360 nt, Artificial Sequence
  Description of Artificial Sequence: Synthetic coding sequence
auggcgaggccugguauggagagauggcgagauaggcuggcuuuggugacaggagcuucugggggcaucggcgccgcagucgccagggcgcucguucaacaaggccugaaaguggugggaugcgcucguacuguggggaacauugaggagcuggcagcagaguguaagucggcuggcuauccgggaacccugauaccauacagaugcgacuugaguaacgaagaggacauccucuccauguuuucagcuaucaggucacaacauucagggguggacauuuguauaaauaaugcuggacuggcuagaccagacacucuacuuagcggcuccacuucuggauggaaagacauguucaacuag

SEQ ID NO: 14306 - RNA, 144 nt, Artificial Sequence; identical to SEQ ID NO: 12667
  Description of Artificial Sequence: Synthetic coding sequence

SEQ ID NO: 14307 - RNA, 159 nt, Artificial Sequence; identical to SEQ ID NO: 12668
  Description of Artificial Sequence: Synthetic coding sequence

SEQ ID NO: 14308 - RNA, 1272 nt, Artificial Sequence
  Description of Artificial Sequence: Synthetic coding sequence
auggagcuggaacucaugccuuucaaugugcugcugaggacuacucucgaucuccuacaagaaaaagacccugcccacauuuucgccgaacccguaaaccuguccgaggugcccgacuaccuagaauucaucuccaaaccaauggacuuuucuacaaugagacgaaagcucgagagccaucuuuaccgaacccucgaggaauuugaagaggacuucaaucucauugucacaaacugcaugaaguauaaugccaaggauacaauauuucauagagcagccguuagacugcgugauuugggcggcgcgauccuccggcacgcccgucgucaggcugagaauaucggcuaugacccagaacgcggaacucaccugcccgaaagcccaaagcuugaagauuuuuauagguucucaugggaagauguugauaacauucugauacccgaaaaccgggcccaccugucucccgaaguucagcucaaggaacuguuggagaaacucgaccucgucucagcaaugcgaucgucuggcgcaagaacacgaagaguccgccugcucagacgcgaaauuaaugcgcuacgacagaaacucgcucagccccccccuccacagccacccucauuaaacaagacugucagcaacggugagcuccccgcagggccgcaaggagaugccgcugugcuggagcaagcccugcaagaggagccugaggacgacggcgauagagaugauagcaaauugccaccacccccuacccuugagccuaccggucccgcaccgucucugagugagcaggaaucaccacccgaaccaccuacccugaaacccauuaacgauucuaaaccucccucucgcuuccugaaaccacggaaagucgaggaagacgaacugcuagaaaagagcccacuucagcugggcaacgaacccuugcagcgccucuuaucugauaauggaauaaauagacugucucugauggcuccugauaccccggcugguacgccccuaucaggggucggacgccgcaccuccguuuuauucaagaaggccaaaaacggagugaaauuacaaaggucaccugaucggguucuggaaaauggagaagaccaugguguagccgggucaccagcaucgcccgccaguauagaggaggagaggcacuccagaaaacggccucgcuccagaagcugcucugagucagaaggugaaagaagcccgcaacaggaggaagaaaccgguaugacaaauggauucggaaaacaucgcaagagaguauag

SEQ ID NO: 14309 - RNA, 3030 nt, Artificial Sequence
  Description of Artificial Sequence: Synthetic coding sequence
augggaucuggaagagucccagggcugugccuacuuguuuugcuggugcaugcuagggcagcacaauacuccaaggccgcucaggauguggaugaauguguggaggggaccgauaacugucacaucgaugcuauaugucagaauacgccacgguccuauaagugcaucugcaagucuggcuacacuggcgacggaaaacacuguaaagacguggaugagugcgagcgugaggacaaugcgggcugcgugcaugacugcgugaacauccccgggaauuaccgcuguacauguuaugacggcuuucaucuagcacacgauggucacaauugccucgacguagacgaaugcgcggaaggcaacgggggaugucagcagaguugcgucaacaugaugggcagcuacgagugccacugccgagaggguuuuuucuuguccgauaaccagcauacguguauccaacgccccgaagaaggaaugaacuguaugaacaaaaaucauggcugugcacacauuugcagagaaacuccuaaaggcggcauagcaugcgagugcaggcccggguucgaguuaacaaaaaaucaaagggauugcaaauugacaugcaauuacgguaauggcggaugccagcacacgugugacgauacagaacaaggaccacgaugcgggugucauaucaaauucguccugcauacugacggaaaaaccuguauuggggaacggagacuggagcagcacauacccacucaggcaguguccaaugagacgugugcugugaauaacggggguugcgauucaaaaugucaugaugccgccacaggaguccacuguacuuguccagucggcuuuaugcuccaaccugaucgaaagacuugcaaagauauugaugagugucgccugaacaaugguggcugcgaccauauuuguagaaauaccgugggcaguuucgaguguucaugcaaaaagggcuacaaauuguuaauuaaugagaggaacugucaggacauugaugaauguaguuucgaucggacaugugaccacauuugcguaaacaccccaggcucuuuucaguguuugugucaucggggcuauuugcuuuacggaauuacccauugcggcgauguugaugaauguucuauuaaccgcgggggcuguagguuugguuguaucaauacaccuggcucauaccagugcacuugcccagccggacagggacgauuacauuggaauggaaaggauuguacagaaccacugaaaugccaggggagcccaggcgccagcaaggccaugcucucuugcaaccgcucugguaagaaagauacaugcgcccuuaccugcccaucccgagcccgguucuugccagaaucugagaacggcuuuaccgugaguugcggcacgccuucaccaagagccgcccccgccagggcaggacacaauggaaacucaacuaacucaaaucacugucaugaagccgccguauuaaguauuaagcaaagggccuccuucaagaucaaggacgcaaaaugucgacugcaccugaggaauaaaggaaaaaccgaagaagcuggccgcaucaccggccccggcggcgccccgugcagcgagugucagguuacguuuauccauuuaaagugugacucgagucgaaaggguaaaggaagacgcgcccgcacccccccagguaaagaagucacuaggcugacauuggagcuugaggcagaggugagagcagaagaaacaacugcaagcuguggcuugcccugucucagacaacgcauggagaggagauuaaaagguucccugaagaugcucagaaagaguauuaaccaggaucgcuuucugcugagguuggcaggacuggacuacgaacuagcccauaagccaggucugguagcuggggagcgagcggagccaauggagucuuguaggcccggacagcaccgagccgguaccaaguguguguccugcccccagggaaccuacuaccauggacagacagagcagugcgugccaugccccgccgggaccuuucaggaaagagaaggacagcugagcugcgaucugugucccgggagcgaugcucaugggccgcuaggagcaaccaaugugaccacuugcgcuggccaaugcccuccaggacagcauucugucgacggauucaagccuugucaacccugcccuagaggaaccuaucagcccgaagccggaaggacccugugcuucccaugcggcgggggcuugacaacuaaacacgaaggcgcuauuucauuucaagauugugacacaaaggugcaguguucccccggucacuauuacaacacauccauucaccgcugcauucggugugccaugggcagcuaccagccagacuucaggcagaauuuuuguagucgaugccccgguaacaccucuacagauuucgacgguaguacuaguguggcccagugcaaaaaucgacaaugugguggggaauuaggcgaguucaccggguacaucgaguccccaaauuacccaggaaacuacccagcuggaguugaguguauuuggaacauuaauccccccccuaagcggaaaauccuuauaguggugccugagauuuucuugccuucugaggaugaauguggcgauguucuugugaugagaaagaacucaagucccucaucuauuaccacuuacgaaaccugccagaccuaugagcggcccauugcguuuacagcuaggucucggaagcuauggauuaacuuuaaaacaagcgaagccaauucugcccgaggguuucagauuccauacguuacuuaugacgaagauuaugagcagcucguagaagacauaguacgcgacggaaggcuguacgcuucagagaaccaccaagaaauccuaaaggacaagaagcucaucaaggccuuuuucgaaguucuugcccacccacaaaacuacuuuaaauauaccgaaaagcacaaggaaaugcugccuaaauccuuuauuaagcuacucagguccaaagugucauccuuucuccgcccauacaaguag

SEQ ID NO: 14310 - RNA, 984 nt, Artificial Sequence
  Description of Artificial Sequence: Synthetic coding sequence
augacugcccuggaacuugcuagacgaggagcucgagugguacuagcuuguagaucucaggagaggggugaggcggcagcauucgaccugaggcaggaauccggaaacaaugaaguaaucuucauggcacucgaucuagcuucgcucgccagcgugagggccuucgccacagcuuuuuuguccagugaaccucggcucgacauccucauccauaaugcaggaauuucuuccugcggaaggacaagggaggcauucaaccugcuguuaagggugaaucauaucggcccauuccuuuuaacacaucugcuacugcccugucugaaagcuugugcccccagcaggguggucgugguagcaagcgcggcucauugcagggggagguuagacuuuaaacgacuugauagaccugugguggguuggcgucaggaacuuagagccuaugcagauaccaaacuagccaauguucuuuuugcaagagaguuagcaaaccagcucgaagccacaggcguaacaugcuaugcugcccacccugggccagugaauucugaacucuuccuccgucaugugccuggguggcugagaccuuuacugcguccucuggccuggcucgugcugcgcgccccacgagggggagcucaaacuccacuauauugcgcccuccaggaaggcauugaaccacucucagggagauauuuugccaauugccacguggaagaagugccacccgccgccagagaugacagagcagcccauaggcucugggaggcaucaaaacgacucgcaggccugggcccaggggaagacgccgagccugacgaggauccucagagugaagauucagaggcgccaagcagccucucaacaccccaucccgaagaacccacggugucucagccauacccaucaccucaguccuccccggaucucuccaaaaugacccaccgaauucaagccaagguugaaccugaaauccaguugagcuag

SEQ ID NO: 14311 - RNA, 1320 nt, Artificial Sequence
  Description of Artificial Sequence: Synthetic coding sequence
augcccgccauugcaguguuggcugcugccgcggcugcaugguguuuccuucaaguagaaagccgccaccucgacgcccuggcuggaggcgcuggcccaaaucauggcaacuuccucgauaacgaucagugguugagcacagugagccaguacgaccgcgacaaguauuggaauagauucagggaugaugauuauuucagaaauuggaacccgaacaagcccuucgaucaggcacucgacccuuccaaagacccgugccuuaaagugaagugcucuccucacaagguaugcgugacacaggauuaccagacagcccucuguguuucacgcaaacaccuguugccacgccagaaaaagggaaauguugcucaaaagcacugggucggcccuucaaaccucguuaaauguaaaccgugcccgguggcacagucagcaauggugugcgguagugacggccacuccuacacuuccaaaugcaaacuggaguuccacgccuguagcacaggaaagagccucgcaaccuugugcgacggccccuguccauguuugcccgagcccgagccaccaaaacauaaagccgaaaggucagcauguaccgauaaggaacuacgaaacuuggccagcagacugaaggauugguucggggcccuccacgaggaugccaaccgcguaauaaagccuacgagcagcaauacugcacaaggcagauuugacacuuccauuuuacccauuugcaaggauucccuaggguggauguuuaauaaauuagauaugaauuaugaccuccugcuggacccaucggagauaaacgcuauauacuuggacaaauaugagccuuguaucaaaccuuuguucaacagcugugacucuuucaaagacgguaaguuaucaaacaacgagugguguuauuguuuucaaaaacccgguggacugccgugucagaacgaaaugaaucgcauccagaagcugaguaaggguaagucccugcugggggcguuuauuccacgguguaacgaagaagguuacuacaaggccacacagugucacggguccacaggucagugcuggugcguggauaaguacgggaacgaacucgcugguucgagaaaacagggggccguaucaugugaggaagagcaagagacuagcggcgauuucggcaguggggggagcgugguguuacuagacgaucuggaauacgaacgagaacucggaccuaaagacaaggagggcaaauuaagggugcacacgcgggcgguaacagaggacgaugaagaugaggacgaugacaaggaagacgaggugggauacauuugguag

SEQ ID NO: 14312 - RNA, 3687 nt, Artificial Sequence
  Description of Artificial Sequence: Synthetic coding sequence
augaaaggcgcacgccuguucguccugcuuagcagcuuauggagcgguggaaucggccugaacaauucuaagcacagcuggaccauucccgaagauggcaacagccagaaaaccaugcccuccgcuucugugccuccgaacaagauccagagcuugcagauuuuacccacgacgagagugaugagugccgagaucgcuaccacaccugaagccagaacuucugaggacucccugcuaaaguccacacuucccccuuccgagacauccgcacccgccgagggcguuaggaaucagacucugaccagcacagaaaaggcugagggcguggugaaacugcagaauuugacacuccccacgaaugcaucuauuaaguucaauccaggugcugaguccgugguccugaguaauucuacacugaaauucuuacaaucuuucgccaggaaaaguaacgagcaggcaacgucccugaacaccgugggcgggacaggagggaucggaggggugggcgguacaggcggggugggcaacagggcacccagggaaacauaucucucccggggcgauagcucuuccucucagcguaccgacuaccagaagagcaauuuugagaccacccgagguaaaaauuggugugccuacguccacacuagacugagcccuacugugauacuugauaaucaggugacuuaugugcccggcgggaaaggccccugcggauggacaggaggaagcugcccccaacgcucacaaaagauaucaaaccccguguaucggaugcaacauaaaauuguuacaucacuggacuggaggugcuguccaggguauagcggacccaagugccagcugcgcgcgcaggaacaacaaucucugauucauacaaaccaggccgagucccacacagccguggggcggggcguggcagagcagcagcagcagcagggaugcggggauccugaagugaugcagaaaaugacagaucagguuaacuaccaagcgaugaagcuuacacuucuccagaaaaaaaucgauaacauuucacucacagucaacgauguaagaaacacauacucuucucucgaggggaaagucucugaggacaaguccagagaauuccagagucugcucaaaggcuuaaagucaaagucuauaaauguacuuaucagggauaucgucagggagcaguuuaaaaucuuccagaaugauaugcaagaaaccguggcucagcuauuuaaaaccgucagcucacuguccgaagaccuagagucaacccggcagauaauccagaaggucaacgaaagugucguuagcauugcagcccagcagaaauucgugcucguccaggaaaaucguccuacccucacugauauugucgaguuacggaaccacaucgugaaugucagacaggagaugacucuuacaugugagaagccgauuaaggaacuggaggugaaacaaacgcaucuagagggagcccuagaacaggaacauucacguagcauucuguauuaugaaucucucaauaagacucucuccaagcugaaagaagugcacgagcaguuauugucaaccgagcaaguuucugaucaaaaaaaugcuccugcagcagaguccgucucuaauaacgucaccgaguauaugucaaccuugcacgagaauauuaagaaacagucucugaugaugcuccaaauguuugaggaucuucauauccaagaaagcaaaauaaacaauuuaaccgugucucuugagauggagaaagaaucucuccguggcgaaugugaggacaugcugaguaaaugucgcaaugacuuuaaauuccaacucaaggacaccgaggagaauuuacacguguugaaccaaacacucgcugagguacucuuucccauggauaauaaaauggauaagaugagugagcagcuuaacgaucucaccuaugacauggaaauucuacagccacuacucgaacagggggcaucucugaggcaaacuaugacauaugagcagccaaaagaagcaaucguuaucaggaaaaaaauagagaauuuaacuucagccgucaacagccugaauuucauuaucaaagagcugaccaagcgacacaacuuguugagaaacgaagugcaaggaagagacgaugcacuggaaagacgcauaaacgaauacgcacuggaaauggaagacggccuuaauaagacuaugaccauuauaaacaaugccaucgacuucauucaggacaauuacgcucugaaagaaaccuugucuacgauaaaggacaacagcgagauucaucacaaguguacuuccgacauggagacuauccuuacauucauaccgcaguuucauagacugaacgauuccauccaaacgcuaguuaacgauaaucagcgauacaauuucguguugcaaguagcaaagacucuggccggcaucccgcgcgacgaaaaauugaaccagagcaauuuccaaaagauguaccagauguuuaaugagacaacuucucaaguucgcaaauaucaacagaacaugucccaccuagaggagaagcuacuuuuaacuacaaagauuucuaaaaauuucgaaacgcgguugcaggacauugagucaaaaguuacucagacccucauaccauacuacauuuccgugaagaaaggcuccguaguaaccaacgagcgagaccaggccuuacaacuccagguccucaacucucguuucaaggcacucgaagccaaauccauccauuuguccauaaacuuuuuuagucuuaauaagacucuccacgagguucucaccaugugucacaaugccucuacuagcgucagugaauuaaacgcaaccauuccuaaguggauaaagcauucccuccccgacauucaacuccugcaaaaaggucugacagaauucgucgaaccaaucauccagauaaagacacaagccgcacuuaguaacuuaacaugcuguaucgauagaucacucccggggucacuggcuaacgucgugaaaucccaaaagcagguuaagucccucccaaagaagaucaaugcucuuaaaaaaccuacaguuaaucucacaaccgugcugauaggucguacacaaagaaauaccgacaauaucauauacccagaagaauauucuuccugcagccgacacccgugccaaaacggaggcaccuguauuaacggcagaacuuccuucacaugugcuugucgccauccuuuuacaggagauaauugcacaauaaagcugguagaagagaacgcacuugccccagauuucuccaagggauccuauagauaugcgccuauggucgccuucuuugccucucauaccuacggaaugacaaucccaggaccaauccucuuuaauaaccuugaugucaacuauggggcauccuauacaccacggacagguaaguuucgcauucccuaccuaggcgucuauguuuucaaguauacgauagagucauuuagcgcucacauauccggauuuuuagucguggauggcaucgacaaacucgcguuugaauccgagaauauaaauucugaaauucacugcgaucgcguucugacgggagacgcccugcuagaacuuaauuacggccaggaaguuuggcugaggcucgcaaaaggcaccauuccugcaaaauucccccccgucacuacuuuuucaggguaccuauuauacagaaccuag

SEQ ID NO: 14313 - RNA, 1596 nt, Artificial Sequence
  Description of Artificial Sequence: Synthetic coding sequence
augaagggggcacgauuauuuguacugcucagcagucuauggucaggcggaauaggccuuaauaacagcaaacauucuuggacuaucccagaggacgggaacucccagaagaccaugccauccgcuuccgucccacccaacaagauucagucccuccaaauccuuccgaccacucgugucaugucugcugaaaucgcaacaacaccugaaaaagcugaaggggucguaaagcugcagaaccugacccugccaacaaacgcguccaucaaauucaacccuggagccgaaagcguuguccucagcaauuccacacuuaaauuccuucagucuuuugcuaggaagagcaacgaacaagccacaagucugaacacaguaggcgguaccgggggaauuggcggggugggcggaacaggcggcgugggaaaucgggcccccagggagacauaccuuucccguggugacagcuccagcucacagcgaacagauuaucagaaaucuaauuuugaaacuacccguggcaagaacuggugugcuuauguucacacucgacucucacccacugugauccuugauaaucaaguaaccuacguccccggagguaaagggcccuguggguggacaggaggaaguugcccucagagaagccagaaaauuagcaaccccgucuacaggaugcagcauaaaaucgugaccucccuagacuggaggugcugcccaggauauucuggccccaaaugucagcugcgggcacaagaacagcagaguuugauccacacuaaccaggcagagucccacacagcaguaggcaggggcguggcagaacagcaacagcagcaggggugcggggaucccgaagugaugcagaaaaugaccgaccaggugaacuaccaagccaugaaacugacucuguuacagaaaaaaauugauaacauaucgcucaccgucaaugacguaagaaauacuuacuccucucuggaagggaaggucagcgaagauaagucuagggaguuccagucucugcugaaggaggaauauucuagcugcucacgccacccuugccagaacggcggcacguguaucaauggcagaaccucguuuacuugugcguguagacaccccuuuaccggcgacaacuguacgauaaaguuaguggaggaaaacgcuuuggcaccagauuuuagcaaaggaucauauagguaugccccuauggucgccuucuuugcaucucauaccuacggaaugacgaucccuggaccuauccuguucaauaaccuggacguaaacuacggugccaguuacacaccaaggacaggaaaauuuaggauuccuuaucugggaguuuacguuuucaaauacaccaucgagagcuucucagcccauauaucugguuuccuggucguugacggcauagauaagcuagcauucgaaucugagaauaucaacucugaaauccauugcgaucgagucuuaacaggagaugcucuccuugaacuuaacuauggacaggaggucuggcuccggcuggcuaagggcaccauuccugcuaaguuccccccagugaccaccuucagcggcuaucuccuuuauagaaccuag

SEQ ID NO: 14314 - RNA, 942 nt, Artificial Sequence
  Description of Artificial Sequence: Synthetic coding sequence
auguccgacuuacugcucuuaggauuaauuggaggcuugacucuauuguugcugcugacacugcuugccuucgcuggauacagcggccugcuugccgggguagagguuucugcugguucuccccccauccggaacgucaccguagcuuacaaauuccacauggggcuauauggggagacaggccgccuguuuaccgaaucuuguucaauuucacccaaacucaggucuauugcuguguacuacgacaacccacacauggucccaccagauaaaugccgcugcgccguuggauccauucugucagagggagaggagagucccucuccugaguuaaucgaccuguaucaaaaguucgguuuuaaaguguuuucguucccggcccccucucacgucgugaccgccaccuuuccauacacaacuauccuguccaucugguuagcaacgaggagaguucaccccgcucuagauacuuauauuaaagaaagaaagcuuugcgccuauccgcgccuagagaucuaucaggaagaccagauucacuucauguguccucuagcuagacaaggagacuuuuacguccccgagaugaaagagacugaauggaaguggagggggcucgucgaggcuauagacacucaaguggacggaaccggagcagacacuauguccgacacuagcagcguuucacuggaaguaucaccuggaucacgggagacuagcgccgccacccuaucaccuggugcaucuuccaggggcugggacgacggagauacacggagugaacacucuuauucagaaucaggugccucuggcucgucuuucgaggaauuagaucuggagggugagggaccccugggugaaagucgucuggauccugguacugaaccauugggcacuacuaaguggcugugggaaccaacugcaccagagaaaggaaaggaguag

SEQ ID NO: 14315 - RNA, 834 nt, Artificial Sequence
  Description of Artificial Sequence: Synthetic coding sequence
augugcacagucguggaccccaggauuguccggcgauaucugcugagaagacaguugggacaaggagcauacggcauaguguggaaagccguugacaggcgaaccggagagguuguggcgauaaagaagauuuuugaugcuuuccgcgauaaaacugaugcgcaacgaaccuuuagagaaauuacuuugcugcaagaauucggagaccacccuaauaucaucagccugcuggacguuauucgggccgagaacgaccgggauauuuaucuagucuuugaguucauggguuguccgccuuccccucccccccccaccgccguccggacccucucagcugacaccgaucugaacgcugucauuaggaaaggaggccuccuucaagacguucacguucgcucuauuuucuaccaacuucuacgugccacuagauuccuccauuccggucacgugguucauagggaccagaagccaagcaauguucugcuugacgcaaacugcacugugaaauugugugauuuuggccucgcccgaucacucggcgaucuucccgaagggccggaggaucaagccgugacagaguauguggccacuagaugguaucgggcccccgaaguccugcugagcagccacagauacacgcugggaguggauauguggucccugggauguauacucggagagaugcuccguggaagaccccuguuuccugggaccucuaccuuacaucagcuagagcuaauucuagaaacuaucccaccacccucugaagaagauuugcuugcccuugguagcggcugccgagccucggugcuccaccaacugggcucucgauag

SEQ ID NO: 14316 - RNA, 765 nt, Artificial Sequence
  Description of Artificial Sequence: Synthetic coding sequence
augugcacggucguggacccgcggauuguacgccgauacuugcugagacgccagcucggccaaggcgcuuacggaaucguuuggaaagcgguugauagaaggacaggagagguuguggccauuaagaagauuuucgacgcguuuagagauaagacagaugcucagcgaacauuuagagagaucacauugcuccaggaguucggcgaucaccccaacaucaucagcuuacuagacgucauuagggcagaaaaugaucgggauauuuauuuaguauuugaguuuauggacacugaccuuaacgcuguuaucagaaaggggggccuguuacaggacgugcacgucagauccauuuucuaucagcugcugcgagcaacacgauuuuugcauuccggucauguggugcaccgugaccagaaaccuuccaacguacugcuggacgccaauuguaccgucaaauuaugcgacuuuggcuuagcccgcucccugggcgaccugccagaaggacccgaggaucaggcagugaccgaguaugucgcaaccagaugguaucgagcccccgaggugcugcucucaucccaccgcuacacacugggcguugacauguggagccuaggaugcauccucggcgaaaugcuccgcggacgaccacucuuuccugguacuucgacgcuacaucaacuggaauuaaucuuggagaccaucccaccccccucugaggaaggcgcccagacagcuugcagguccggaacaggggccagcacuuag

SEQ ID NO: 14317 - RNA, 474 nt, Artificial Sequence
  Description of Artificial Sequence: Synthetic coding sequence
auggcccugcugcuuugucugguuugcuugaccgccgcccuggcucacggaugcuuacauugucacaguaacuucuccaaaaaguucuccuuuuaucggcaucacguaaacuuuaagaguugguggguaggcgacaucccaguuuccggcgcucugcugaccgacuggucugacgauacuaugaaggaauuacaccuggcuaucccugcaaaaauuacacgggaaaagcuggaucagguugccaccgccguguaccagaugauggaucaacuguaucagggaaagauguacuuuccaggauacuuccccaaugaacugagaaacaucuuccgagaacaggugcaucugauccagaaugcaaucauugaaagacaucuagcucccggcaguuggggcggaggucaacugucuagagaagguccaucccuggcaccagaaggauccaugcccuccccacggggagaccucccauag

SEQ ID NO: 14318 - RNA, 699 nt, Artificial Sequence
  Description of Artificial Sequence: Synthetic coding sequence
auggcucuccuauugugucuggugugcuuaaccgcugcccucgcucacggcugucuucauugucacagcaauuuuaguaagaaauuuucauucuauagacaccacgugaacuuuaagucuuggugggugggagacauacccgugucuggagcccuacugacagacuggucugaugacaccaugaaggagcugcaucuggcuauuccagcgaagauaacccgcgagaaacuggaucaagucgcgaccgcuguguaucagaugauggaccagcuuuaccaagguaagauguacuuucccggcuacuuuccaaacgaacugagaaacauuuuucgcgagcaaguccaucucauacagaacgcuaucauugaaagccgcauagacugccaacauaggugcggcauauuccaauaugagaccauuuccugcaacaauugcacugauucacaugucgcaugcuucggauauaacugcgaaucaucagcucaguggaaaucggcggugcaaggauuacugaauuauauuaauaauuggcauaaacaggacacuaguaugagaccccgcucuuccgcuuucuccuggccaggcacucaccgagcuacucccgcuuuccuggugucaccggcucuaaggugcuuagaaccuccccaucuugccaaucuuacccuagaggaugcagccgaaugcuugaaacaacauuag

SEQ ID NO: 14319 - RNA, 396 nt, Artificial Sequence
  Description of Artificial Sequence: Synthetic coding sequence
augggaggugauggccgauacguuuugaacggacacugggucguuuccccaccuggaacuuacgaagcugccggcacccacguggucuacacuagggacacgggcccccaggagacgcugcaggcugcugguccuaccucacaugauuuacuccuucagguccugcuucaggaaccgaaucccggaaucgaauuugaauuuugguugccacgagagagauauagcccauuccaagcccgggugcaggcucugggauggccccugcgacaaccucagccacgcggaguagaaccccagccccccgccgcuccagccguuacgcccgcccaaacccccaccuuagcacccggcccaagugccggccccccaccaccuggcccaggagaccccuuauag

SEQ ID NO: 14320 - RNA, 447 nt, Artificial Sequence
  Description of Artificial Sequence: Synthetic coding sequence
auggccaggaucccaacugccgcccuagguuguauaucacuccucugccugcagcugccugggucucugucucgcucucucggcggcgacccccguccgguaaagccacgcgaaccuccagccagguccccuucuucaucucuccagccccgacaucccgcaccccgacccgugguguggaaauugcacagagcccuccaagcucagcgaggagccggccuugccccuguuaugggccagccacuccgcgauggcggacgacaacacucagggccccguagacauucuggaccgcgacgaacacaagcacagcuccugaggguggguugcguuuuggguacuugccaggugcagaauuuaucccaucgacuguggcaacuaauggguccugcuggccgccaagauuccgcuccugucgauccuuccagcccacauaguuacggcuag

SEQ ID NO: 14321 - RNA, 447 nt, Artificial Sequence
  Description of Artificial Sequence: Synthetic coding sequence
auggcgcggaucccaacugccgcacugggguguauuucccuccucugccuccaacuccccgguucucuuuccagaaguuuagggggggacccccgaccagugaagccucgcgagccuccggcacgcucacccuccucaucgcuucagccuagacaucccgcccccagacccguugucuggaaacuccacagagcccugcaggcccagcgaggcgccggacucgcacccgucaugggucagccuuuacgagacggugguaggcagcauuccgggccccgacgacauaguggcccccgcagaacacaggcacaguuacuaagaguggguugugugcucggaacaugucaggugcaaaacuuaagccacagguuauggcaacucauggggccugccggccgucaagacucugcucccguagaccccuccuccccccauucuuauggauag

SEQ ID NO: 14322 - RNA, 537 nt, Artificial Sequence
  Description of Artificial Sequence: Synthetic coding sequence
auggaucgggccgccaggugcaguggcgcgucuucucugcccuuacuccuugcucucgcauugggacuggugauucuccauugugucgucgcagacggaaauaguacccguucuccagagacaaacggacucuuauguggugacccugaagaaaacugugccgccacaacuacacagucuaaaaggaagggccauuuuagucgcugucccaaacaguauaagcacuauugcauaaaaggccguugcagauuuguaguggcagaacagacgccuucuugcgugugcgaugagggguacauuggagcccggugugagagaguggaccucuuuuacuugcgaggugaucguggacaaauucuggugauuugucucaucgcuguaauggugguuuuuauaauacucguaaucggaguuuguaccuguugucauccuuuacgaaagcgccgcaaaagaaaaaagaaagaggaggaaauggaaacuuuagggaaagacauuacuccaauuaaugaggacaucgaagaaacaaacauugcuuag

SEQ ID NO: 14323 - RNA, 1251 nt, Artificial Sequence
  Description of Artificial Sequence: Synthetic coding sequence
augagcaucagccugagcucucugauccugcuuccuaucuggaucaacauggcccaaauccagcaagggggucccgacgaaaaggaaaaaacuaccgcauugaaagaucugcugucccgcaucgaucuugaugaacugaugaagaaagaugaacccccucuugacuuuccagauaccuuagagggcuuugaguaugcguuuaacgaaaaagggcaauugcgacacauuaagaccggcgagccguuuguauucaacuauagagaggaucugcacagauggaaccagaagagauaugaggcccucggcgaaauuaucacgaaauacguguacgagcuucuugaaaaggauugcaaucuuaaaaaagucucuauuccgguggacgcaacugaauccgagccaaaaucauuuauauucaugagcgaggacgcgcugacgaacccucagaaacuuauggugcucauucacgggagcggaguuguuagagcgggucaaugggcacggaggcuaaucaucaacgaagaucuggauaguggcacccagauuccauuuaucaaacgcgcuguggccgaaggauaugguguaauugugcuaaauccuaacgaaaauuacaucgaaguagagaagccaaaaauucacgugcagucuaguagcgauucaagcgacgaaccagcugaaaaacgggagcggaaagacaaagugucaaaagagaccaaaaaacgcagggauuucuacgaaaaauaccgcaacccacaacgcgagaaagagaugaugcaguuauacaucagagagaauggaucaccggaggaacacgccauauaugucugggaccacuuuauagcucaagccgccgcagagaacguguuuuucguggcucauaguuacgguggacucgcauuuguggaacucaugauucagagagaagccgacgucaaaaauaaaguaaccgcuguggcccucaccgauucuguacauaauguguggcaucaggaagccggcaagacgaucagagaauggaugcgugagaacugcuguaacugggugucaucuucagaaccgcuggacacuaguguggaaucuaugcucccugauugcccccgggucucagcaggaaccgaccgacaugagcugacaucauggaaaaguuucccuucuauauucaaauucuuuacggaagccucagaagccaagacaucuagccuuaaaccagcgguaacaagaaggucucacagaaucaagcaugaagaacucuag

SEQ ID NO: 14324 - RNA, 840 nt, Artificial Sequence
  Description of Artificial Sequence: Synthetic coding sequence
augaaaauuauuauccuguugggcuuccuuggagccacacuguccgccccucucaucccacaacguuugaugagugcuuccaacucaaaugaacuguuacuuaaucucaacaacggccaguuguugccccuucagcugcaggggccccugaacuccuggauucccccuuucagcgguauucugcaacaacagcaacaagcccagauucccggccugucucaauuuagcuugagugcccuugaccaauucgcuggacuacuuccuaaccagaucccacucaccggcgaggccagcuuugcacaaggagcgcaagcaggccaaguggauccccuccagcuucagacuccuccucaaacucagcccggacccucucacguuaugccuuacguuuuuucauucaagaugccccaggagcaaggacagauguuccaguauuauccuguguauaugguccuuccaugggaacaaccacagcagacgguuccacguagcccucagcagaccagacaacagcaguacgaagagcagauccccuucuaugcccaauucggcuauauuccccagcucgcggagccggccaucagcggugggcagcaacaacuugcauucgacccacaguugggcacugccccugagaucgccguaaugagcaccggagaagaaaucccauacuuacagaaagaagcuauuaacuuucggcaugacucagccggaguguuuaugccaagcacuucaccaaagccaucaaccacaaauguguuuaccuccgcuguugaccagaccauaacacccgaguugccagaagaaaaggauaagacagauaguuugagagaaccauag

SEQ ID NO: 14325 - RNA, 444 nt, Artificial Sequence
  Description of Artificial Sequence: Synthetic coding sequence
augggcccugaagcacucucgucucugcucuuauuauuacugguggcuucuggcgaugcugauaugaagggccacuucgaucccgccaaauguagguaugcacugggaaugcaggaccguaccaucccagacuccgauauuucggccucuaguaguuggucagauucgacugccgcuagacauucuaggcuagagucuucagauggggacggggcauggugucccgccggcaguguguuucccaaggaagaagaguauuuacagguggauuuacagagacugcacuuaguagcauuggucggcacacaaggcagacacgcaggagggcugggaaaggaauuuucucgaucguacaggcuccgauacucuagggacggcaggcgguggaugggauggaaggaccggugggggcaggaagugaucucaggcaaugaggauccauag

SEQ ID NO: 14326 - RNA, 618 nt, Artificial Sequence
  Description of Artificial Sequence: Synthetic coding sequence
augggagggccugugcgggagccugcucuaucuguagcuuuguggcucucuuggggcgcugcguuaggcgcuguggcuugugcgauggcccuucugacccaacaaacagaacugcaguccuugcgaagagaagugucccgcuuacaggguaccggaggaccaagucagaacggggaaggcuaccccuggcaguccuugcccgaacagcacucaguguuacaucuugugcccauuaaugcuacaaguaaagaugauuccgaugucacugagguaauguggcagcccgcucuaaggaggggccgcggguugcaggcgcagggcuacggcguuagaauucaagacgcuggaguuuaccuccuguauucccagguucucuuccaggacgucaccuucacaauggggcaagucguguccagagaaggucaagggcggcaagagacguuguucagauguauucggucaaugccaucccacccagaccgagccuacaauagcuguuacuccgccggcguguuccaucugcaccagggcgacauuuugucaguuaucaucccacgagcucgugccaaauugaaccucucaccucacgggacauuucugggguuuguaaaguuguag

SEQ ID NO: 14327 - RNA, 744 nt, Artificial Sequence
  Description of Artificial Sequence: Synthetic coding sequence
augccugccucuagcccauuccuacuugcuccaaaaggaccucccgggaacaugggugggccagugcgcgaaccugcauugaguguagcgcuuuggcuuuccuggggagccgccuugggggccguggcaugcgcaauggccuuacuaacucaacaaacagagcuccagagucugcgaagagaggugagucggcuacagggaacuggcgggcccucacagaacggagagggcuaucccuggcaauccuuacccgagcagagcagcgacgcucucgaagccugggagaacggugaaagaucucggaaaagacgggcuguguuaacacagaaacagaagaaacagcauucaguucugcaccucguaccaauuaacgccaccaguaaggaugacagugacguaaccgaagugauguggcaacccgcgcugagaagagguagaggauuacaggcccagggauauggcguaagaauucaggacgcuggaguguaccuuuuauacucucaaguccuauuucaggacgugaccuucacaaugggacagguugucucaagggagggucaggguagacaggagacacuuuucagauguauccggagcaugccaucacacccagaccgggcuuacaacucauguuacagcgcaggcgucuuucaccuacaccaaggagauauucuauccgucaucaucccacgcgcaagggcaaaauugaacuuguccccgcacggaaccuucuuagggcucuag

SEQ ID NO: 14328 - RNA, 39 nt, Artificial Sequence; identical to SEQ ID NO: 12689
  Description of Artificial Sequence: Synthetic coding sequence

SEQ ID NO: 14329 - RNA, 4266 nt, Artificial Sequence
  Description of Artificial Sequence: Synthetic coding sequence
augaugcucccccagaacuccuggcauaucgauuuuggaagauguugcugccaccagaaccuguuuucugccguggugacuugcauccugcuucugaacucauguuucuuaauaucuucuuuuaacggaacugaccuugaguuacgccucgucaacggagauggcccuuguagugggacuguugaagugaaguuccagggacaguggggaacugugugcgaugauggguggaacaccacagcuaguaccguggucuguaaacaacucgguugccccuuuucuuucgcaauguucagauucggccaagcuguaacccggcauggcaaaauaugguuggaugacgugucauguuacggcaaugaaagugcacugugggagugccaacauagggaaugggggucccauaauugcuaccacggagaagauguuggggugaacugcuauggagaggccaaucugggcuugagacugguggauggaaauaacagcuguagcggaaggguggaggucaaguuucaagaacguugggguacuauuugugaugacggguggaaccugaauacagcugcugugguauguagacagcuggguugcccgaguagcuuuauuaguucaggagucgucaacuccccugccguauuaaggccaauuuggcucgacgacauccuaugucaaggaaacgaguuagcacucuggaacugcagacauagggguugggggaaucacgauugcucucauaaugaagacgugacacucacuugcuacgauuccuccgaccuggaguuacgcuuagugggcggcacaaaucggugcauggggcggguagaguuaaaaauacagggaagauggggaacugugugucaucacaaguggaauaaugccgcugccgacgugguuugcaagcagcuaggcugugggaccgcacuucacuuugcuggcuuaccccaucuccaguccgguuccgacgucguuuggcuggacgggguguccuguaguggaaacgagagcuuucugugggacugucggcacucagggacagugaauuuugacugcuugcaccagaaugacgugagcgugauuugcagcgacggcgcagacuuagagcuccgccucgccgauggaucuaauaacuguucaggacgaguggaagugagaauccaugaacaaugguggacuauaugugaucagaacuggaaaaacgaacaggcacuagucguuugcaagcagcuuggaugucccuuuucgguuuucggcucucgacgagccaaacccucaaacgaagcacgagauaucuggaucaauagcauuucauguacgggaaacgaaucagcucugugggauugcaccuacgacgguaaggcuaagagaacuuguuuuagacgaucugacgcagguguuauuugcuccgauaaagccgacuuggauuugaggcuuguaggcgcacacucacccugcuauggucggcuggaggugaaguaccagggcgaauggggcacagucugucaugauagguggagcacuaggaaugccgcaguggugugcaagcagcuggguugugggaagccguuacacgucuuuggaaugacuuacuuuaaggaagccagcgggcccaucuggcuagaugacguuagcuguauugggaaugagucaaauaucugggacugcgagcacaguggguggggcaagcacaacuguguucauagggaagaugugaucgucacaugcucaggcgaugcaacguggggcuuaagguuggugggcgggucuaauagaugcucuggucgacuugagguguauuuccaagguagguggggaacagugugcgacgacgguuggaacucaaaggcagcagcugugguaugcucacaacuggauuguccuaguucaauuaucgggaugggucuggggaacgcaagcacugguuauggcaagauauggcuggaugaugugucuugcgacggcgacgagucagaucuuuggagcugcaggaacucuggcugggggaacaacgauugcagccacagugaggaugucggcgucaucuguuccgacgcuucugacauggaacuaaggcuggugggcgggucgucucguugugcagguaagguggaagucaaugugcagggcgcgguggggauccugugcgccaacgguugggggaugaacaucgcugaggucgugugccggcaacucgaauguggaucggcuauuagggugucuagagaaccacacuucaccgaacggacauuacauauccugaugucuaauaguggguguaccggaggagaagcaucguugugggacuguauccgaugggaguggaagcaaacagcgugucaucugaauauggaagcaucccuaaucugcucggcacaucggcagccaagauugguuggagcugauaugccuuguucaggucgcguggaagucaagcacgccgauacguggaggucgguaugcgacucugauuucucccuucacgcagcaaauguuuugugccgcgaacucaacugcggugacgcuaucucucuuucagucggcgaucauuuuggcaagggaaauggacucacuugggcugagaaguuccaaugcgaggguagcgagacgcaccuggccuugugcccaauuguacagcacccagaagauaccugcauacauucacgcgagguuggaguuguuugcucucguuacacggacgugcgccuaguuaaugggaaaagccagugcgacggucaggucgaaauuaaugugcugggacauugggguucucugugcgauacacauugggacccugaagaugcaagaguucuguguagacagcucucauguggaacugcacuuuccaccaccggggggaaauauaucggggaaagaucagucaggguuuggggucaccgcuuccacugccucggcaacgaaagccucuuggacaauugccagaugaccguccucggggcaccccccuguauacaugggaacacugugucagugauuugcacgggaagucuaacccagccccuauucccuugcuuagcuaacgucagcgauccguaccugucagccgugccagaagggucggcacuuauaugucucgaagacaagaggcuucguuuaguggauggagauagcaggugugccggucgagucgaaaucuaccaugacgguuucugggggaccaucugcgaugacggaugggaucucucugacgcucauguggugugccagaaacucggguguggcgucgccuucaacgcaacagugucagcccacuuuggggagggauccggccccauuuggcuugaugaucuaaacugcacaggaauggaaagccaccuauggcagugccccucacgagguugggggcagcaugacugcaggcacaaagaagaugcaggcgucauuugcucugaauuuacugccuuaaggcucuauucugagaccgaaaccgaaucgugcgcuggaagauuggaaguguucuauaauggaaccuggggaucaguagggagaaggaauauuacaaccgcaauagcaggaauagucuguagacaacuggggugcggggaaaauggcgugguaucccuggcaccacugucgaaaacuggaagcggguucauguggguugaugacauccaaugccccaagacucacauuucuaucuggcaaugccugagcgcaccuugggaaagaaggauuaguuccccagcagaggagaccuggauaacuugcgaagacaggauccgcguaagagggggugauaccgaaugcucuggaagagucgagauauggcacgcaggcuccuggggaaccguaugugacgauucaugggaucuagccgaagccgaaguggugugucagcagcugggaugugguagcgcccucgccgcgcugcgagacgccaguuucggucaaggcacaggcaccauuuggcuggaugauaugagauguaaaggcaacgaaagcuuuuugugggauugccacgcaaaaccauggggacaguccgauuguggacacaaagaagaugcuggcguuaggugcaguggacagagucucaagagucuuaaugcaucuucuggacaucuugcucucauccucucuagcauuuuugguuuacuccuccucguacuguuuauacuauuucuaaccuggugcagaguucaaaagcagaaacaccucccuuuaagggaugacacacccaaucacggaugcgaagacgccucggauacaucuuugcugggaguauugcccgccucagaagcuacaaaauag

SEQ ID NO: 14330 - RNA, 1410 nt, Artificial Sequence
  Description of Artificial Sequence: Synthetic coding sequence
augaucaccgagggggcccaagcacccagacuccucuugccaccacuuuugcucuuacucacccugccugcaaccggcuccgacccagucuugugcuuuacucaguacgaagaauccucugguaaguguaaaggguuacucggcgguggcgugucaguugaggauugcugucucaauacugcauuugcguaccagaaacgaaguggagggcucugucagcccugccgcuccccccgcuggucacuuuggucuaccugggcaccuuguuccgucacauguucugaaggcucucagcuccgguacaggagauguguagguuggaauggccaaugcucuggaaaaguggcgccugggacguuggaauggcagcugcaggcaugcgaggaucaacagugcuguccugaaaugggaggcuggagugguuggggacccugggagcccugcagcgugaccuguaguaaggggacgcgcaccagacgacgcgccuguaaccaccccgcaccaaaaugcgguggacauugcccuggacaagcucaagagucagaggcaugcgacacgcagcagguuugccccacacauggagcuugggcaacauggggcccauggaccccuuguucugcauccugucacggagggccccaugaaccaaaggaaacacgcucaagaaaaugcucugcaccugagccgagccaaaaaccgccuggcaaacccugccccggacuggccuaugaacagcgccgguguacagguuuaccucccugccccguggcuggcggaugggggcccugggggccugugucucccuguccagugacaugcggucuaggccagacaauggagcagagaacauguaaucacccugucccgcaacaugguggcccguuuugcgccggagacgcuacccguacccauauuugcaacacugccguuccuugccccguggacggcgaaugggacucuuggggugaguggucacccugcauccggagaaauaugaagagcaucaguugccaagaaauucccggccaacagagccguggaaggacuugcagagggcggaaauuugauggacauaggugcgcuggucagcagcaagauauaagacacuguuacucaauucagcacugcccccugaaggguuccuggagugaguggaguacuugggggcuuuguaugccaccaugugguccaaacccaacccgagcccgccagagacuguguaccccucuccuuccaaaauaucccccaacugugucuaugguugaaggacagggggagaaaaacgugacguuuuggggacgcccucucccccgcugugaagagcuccagggccagaaguuaguuguggaagaaaagcgcccuuguuuacauguccccgccugcaaggaucccgaagaagaagaguuguag

SEQ ID NO: 14331 - RNA, 837 nt, Artificial Sequence
  Description of Artificial Sequence: Synthetic coding sequence
augcaauggcuccgcguuagagagucacccggugaagcuacuggccauaggguaacuaugggcacugcggcgcugggaccggugugggcugcauuacuucuauuucuguuaaugugugagauuccaauggucgagcugacuuuugacagagccguugccucaggaugccaacgauguugugacucugaggacccacucgauccggcacacguaucaagcgccagcuccucgggucguccccaugcucuucccgaaauaagacccuacaucaauaucacuauccucaaaggcgacaagggggaccccgguccgaugggauugcccggcuacaugggcagagagggaccccagggggagccuggaccacagggaaguaagggggauaaaggggagauggggucaccaggcgcuccgugucagaaacgcuucuuugcuuucucggugggaagaaagaccgcuuuacacucaggggaggauuuucaaacacuucuuuucgaaagagucuuugugaaucucgauggguguuucgacauggcaaccggacaguuugccgccccccucagagggaucuacuuuuucagucuaaacgugcauagcuggaacuauaaagagaccuauguucacaucaugcacaaucaaaaagaagcggugauucucuaugcgcagccuucagaacgcuccauuaugcagucccagucagugaugcuagacuuagccuauggcgacaggguguggguacgguuguucaaaagacagcgagagaaugcaaucuauucaaacgacuucgacacguauaucacauucagcggacaccucauaaaagcggaggacgauuag

SEQ ID NO: 14332 - RNA, 1128 nt, Artificial Sequence
  Description of Artificial Sequence: Synthetic coding sequence
auggaguucgaaaucaccuuuaggcccgacucuggggauggcguccugcuguacagcuacgacacaggcuccaaggauuuccucaguaucaacuuggccggagggcacguagaauuucgguuugacugugggucaggaacuggaguguuaagauccgaagacccccucacauugggaaauuggcacgaacucagggucuccagaacugcaaaaaaugguaucuugcaaguugauaagcagaaaaucguugaaggcauggcagaaggagguuuuacccaaauaaagugcaauacagacauauuuaucggagguguucccaacuaugacgacgucaaaaagaauagcggugucuuaaaacccuucagcgggucgauacagaaaaucauccugaacgacagaacaauucacguuaaacacgacuucacuucgggcgugaacgucgagaaugcagcucaccccugcguccgugcuccaugcgcccauggaggaucuugccggccccgcaaagaaggcuaugauugugacuguccacugggcuuugagggucugcauugucagaaggccauuaucgaagcaauagaaauuccccaauuuauaggacggucuuaccugacauaugauaaucccgauauccugaaaagagugucagguucccggaguaacguauuuaugcguuuuaagacuacggcaaaggacggguugcuuuuguggagaggugauucccccaugcguccuaauuccgacuuuaucucacuggggcucagagacggggcacugguuuucuccuauaacuugggcucuggaguagccagcauaauggugaaugggucuuuuaaugacgguagguggcaucgagugaaagcagugcgcgaugggcaaagcgggaaaauuacugucgaugauuacggugcucggacaggaaagucaccuggcaugaugcgacagcuuaauaucaauggagccuuguacguggggggcaugaaggagauugcacugcacacaaauagacaguacaugcgggggcuuguaggauguauuucccacuuuacucucuccacagacuaccacauaucauugguggaggacgcaguggauggcaaaaauauuaauacuuguggcgcuaaguag

SEQ ID NO: 14333 - RNA, 459 nt, Artificial Sequence; identical to SEQ ID NO: 12694
  Description of Artificial Sequence: Synthetic coding sequence

SEQ ID NO: 14334 - RNA, 1050 nt, Artificial Sequence
  Description of Artificial Sequence: Synthetic coding sequence
augacggccuuacccggcccccuguggcuacuuggccuugcucugugugcuuuggguggcgguggaccgggccuccgccccccaccagggugcccacaaaggcgacugggcgccagagaacgacgagauguacaacgcgaaauccuggccguguuaggucuaccugguagaccccgcccuagagcgccaccagcugcuagcaggcugccggccuccgccccuuuauuuaugcucgacuuguaucacgcaauggcaggugacgacgacgaggauggcgcaccagcugagaggcgccuugguagagccgacuuaguuaugaguuucguuaauaugguugaacgagauagggcucugggucaucaggagccucauuggaaagaauuuagauucgaccuuacucagaucccugccggggaggcagugaccgcagccgaauuuagaauuuacaagguaccaucuauccaucucuuaaauagaacacugcacguaagcauguuucaagucguucaggagcagagcaaucgcgagucugaucucuucuuucuggauuuacagacacugcgggcuggagacgagggauggcucguccuggacguaacggcagcaagcgacugcuggcuccugaaaagacauaaagaucucggauugcgguuguacgucgaaacagaagacggggaaacuuggaccggcuggggguggacaaaagauucuagacuccaaauguggaagcuccgucugucuagaaccccauggguccucagucugcaugcucccggccccgcacaggcccccgcugagcgcccucugcugugucuccuccagggccacugcccagcuucuccuucccccaucagaacuccuagggccgugagaccucuuagaagaagacagcccaaaaagucgaaugaacugccucaagccaauagacuccccgggauuuuugacgauguccaugguucacacggccgccaggucuguagacgucacgaauuauaugucaguuuucaggaccucggcugguugguuauugcugacuccucaugcuucuag

SEQ ID NO: 14335 - RNA, 1617 nt, Artificial Sequence
  Description of Artificial Sequence: Synthetic coding sequence
augagcuuuucugcgaccauccuguuuucccccccuagcggcuccgaagcuagguguuguugcugcgccuguaaauccgagaccaacggaggcaacaccggaucacaaggaggaaaccccccgcccuccacacccaucacugucacuggacauggccuagccgugcagucaucagaacagcuucugcacgucaucuaucagcgggucgauaaggcugugggauuggccgaggcugccuuaggccucgcuagagcuaauaaugagcuucugaagcgccugcaggaggagguuggcgaccucaggcaagggaaagugagcauccccgacgaggauggggagucgcgcgcacacuccagcccaccagaagaacccggcccccugaaggagaguccaggugaggcauucaaagcccucucugcagucgaagaggagugcgauucagucgguaguggagugcaagucguaaucgaagagcuacggcagcugggcgcugcgucugugggcccagguccucuaggauuuccagccacacaaagagauaugcgauuaccgggaugcacccucgcagcaagcgaagccgccccacuccugaacccucuaguggacgacuacgucgcaagcgaaggagcaguccaacggguccuuguccccgccuacgccaaacagcucucuccagcgacccagcuugccauccagcgggccacaccagagaccgggccagaaaacggaacuaaguuaccaccgcccagaccugaagacaugcugaacgccgcagcugcacuggauucugcucuggaggaaaguggaccagggucuacaggagaacucaggcacagccugggucugacaguuagcccuugccgaacacgggggucuggucaaaagaacucuagaaggaaacgugaccugguacucuccaaacuuguucacaauguccauaaucauauuacuaaugacaagcgguuuaauggcagcgaauccaucaaauccagcuggaauauuuccguugucaaauuucuucuggagaagcugaaacaggaacugguuacaucaccccauaacuacacagacaaggagcugaagggcgccuguguagccuacuuucuuacuaagagacgagaauacagaaauucucuaaaucccuucaagggccugaaagagaaggaagagaaaaaacugaggagcagacgauacagacucuucgcaaaccgauccucuauuaugcggcauuucgguccggaggaccagcggcuuuggaaugacguaacggaagagcugaugucugacgaggaggacaguuuaaaugaaccagguguuugggucgcucgccccccucgauuccgggcccaacggcuuaccgaacuauguuaccaccuugacgccaauucuaagcacgggacuaaagccaaucguguauauggaccaccuagugaccggcucccauccgcagaagcccaguuacugccucccgaauuauauaacccuaacuuccaggaagaagaagacgaagguggcgacgaaaaugcgccugggucaccaagcuucgaccagccucauaagacauguugcccggaucugaauucuuuuauugaaaucaagguggaaaaagacgaauag

SEQ ID NO: 14336 - RNA, 630 nt, Artificial Sequence
  Description of Artificial Sequence: Synthetic coding sequence
augucuuucucugccacgauucuguucagucccccauccggaucugaggcccgcuguuguuguugugcauguaaaagugagacaaacggaggaaauaccggcagccagggaggcaaucccccacccuccaccccuauuacuguaaccggucacgggcucgccguccagucuucagagcaacuccugcaugucauuuaucagcggguggauaaggccgugggacucgccgaagcugcucucggacuagcccgagcaaacaaugaauuacugaagagauugcaagaagaagugggcgaccugaggcaggguaaagucucuauuccagacgaggacggggaaaguagagcccauaguucgcccccagaggaacccggcccguuaaaagaaaguccuggcgaggcauucaaagcacucucagccguugaggaggaaugugacuccgugggguccgguguccagguggucaucgaggagcucagacagcuaggagccgcuaguguugggccgggccccuugggcuucccugccacccagcgagauaugagacuccccggauguacuuuagccgccucagaagccgcaccauuguugaauccgcuaguggaugauuauguagcuucugaaggauag

SEQ ID NO: 14337 - RNA, 1617 nt, Artificial Sequence
  Description of Artificial Sequence: Synthetic coding sequence
augucuuuuagugccaccauccuuuuuuccccaccuucgggauccgaagccagaugcugcugcugcgccugcaaauccgagacuaaugguggaaauaccggcucccagggaggcaaucccccaccuuccacaccuaucaccgucaccggacauggacuggccgugcaaagcucugaacaacugcuacacguaauauaucagcgcguggacaaggcugucggguuggccgaagccgcacuuggccucgcuagagcuaacaaugagcugcucaaaaggcuccaggaggaggugggugaucugcggcagggaaagguaagcauucccgacgaagauggagaaaguagagcucauuccagcccgccggaagagcccggcccccugaaagaaucucccggagaggccuuuaaggcgcuuagugcagucgaggaggagugugauaguguaggauccggaguucaagugguuaucgaagagcugagacagcuaggugcugcgucuguggggccagggccguugggcuucccagccacucaacgcgacaugagguugccgggaugcacauuagccgcuuccgaggccgccccccuguuaaauccccuugucgacgacuacguggccucugagggagcuguccagaggguguuggugccggcauaugccaaacagcugucucccgcuacccaacucgccauucaaagagcgacacccgagacuggcccugaaaacggaacgaaguuaccccccccacgcccugaagacaugcuaaaugccgccgccgcccuggacuccgcgcuggaggaaucagguccaggcucuacaggugagcuaagacauucgcugggcuuaacagugagucccugucggaccagaggaagcggccagaaaaacucacgacgcaagcgcgaccuggugcucaguaaacuuguacauaacguccacaaccauauuacuaacgacaagagauuuaacgggucagagagcauuaaaucuuccuggaacaucagugucgucaaguuccuccuugaaaaacucaaacaagagcucguaacgucuccucacaacuauaccgacaaggaacugaaaggagccuguguggccuauuuccucacaaagcggcgggaauauagaaacaguuugaacccauucaaaggucugaaagagaaagaagagaaaaaacucagauccaggcgauauagacuguuugccaaucgcaguaguauuaugagacacuuuggccccgaagaucaacgccuauggaacgaugugaccgaagaacuaaugucggaugaggaggacucauugaacgaaccuggcguuuggguggcuagacccccccgauuccgcgcacagaggcugacagaacuguguuaucaccuugacgccaacucaaagcauggaacuaaagcaaaccggguuuauggacccccaagugaucggcuccccagcgccgaggcccaauugcuucccccugagcuuuacaacccuaacuuucaagaagaggaagacgaaggcggcgacgaaaaugcccccgguucccccucuuuugaucaaccccauaagaccuguugcccagaccucaauuccuucaucgagaucaagguugaaaaagacgaauag

SEQ ID NO: 14338 - RNA, 1524 nt, Artificial Sequence
  Description of Artificial Sequence: Synthetic coding sequence
augugcacuaagacgaucccugugcuuuggggguguuuccucuuauggaaccuguacgugucaucaucucaaacgauuuacccagggauaaaggcacgcauuacccagagagcucucgauuauggaguacaagccgguaugaaaaugaucgaacagaugcuuaaagaaaaaaaauugccugaccuaaguggcuccgaaucuuuggaauuucuaaaaguugauuacgucaacuauaauuucagcaauauuaagaucuccgcuuuuucuuuccccaauacauccuuagcuuucguucccgggguuggaauaaaagcgcuaaccaaccacggaaccgcaaauauuuccacggauuggggcuucgaaagcccgcuguuucaggauacaggaggugcagacuuauuucucagugguguguauuucacaggcaucaucauccuuacucgcaacgacuuuggucaucccacucugaagcugcaggacuguuacgcgcaacugagccacgcacacgucucauuuuccggcgaacucuccguauuauacaauagcuucgcagagccgauggagaagccgauucugaagaacuuaaacgagaugcuaugccccaucauagcgucugaagucaaagcucuuaaugccaacuuaagcacauuagaaguucucacuaaaaucgacaauuacacgcuccuggauuacucuuugauaagcuccccugaaaucaccgaaaauuaccuugacuuaaaccugaagggaguguuuuacccuuuggagaacuuaacugacccaccguuuucaccagucccuuuugugcucccugaaagaaguaacucuaugcucuauauuggaaucgccgaauauuuuuucaaaagcgccucauucgcacacuucacugccggcguuuuuaacgugaccuuaucaacugaagaaauaaguaaucacuucguucagaacucucagggauuagggaaugucuugucacguaucgcagagaucuauauccugucacagccguucauggugagaaucauggccaccgagccuccaaucauaaaccuccagcccggcaacuucacgcucgauaucccugcaucuauuaugaugcugacgcagcccaagaacuccaccguggagacaauuguaaguauggauuucgucgcuagcacuucugucggacuagucauccuuggacagcgccuggugugcuccuuaagucuaaacagguucaggcucgcgcucccagaguccaaucguagcaacauugaaguccugcgcuuugagaauauccuguccaguauacugcacuucggcgugcugcccuuggccaacgcaaaauuacaacagggcuucccccuaucuaacccccauaaauuucucuucguaaauucugauaucgagguacuggaaggguuucuucugaucucuacugaucugaaguacgaaaccucauccaaacaacagcccagcuuucaugugugggaaggguugaauuuaauuuccaggcaauggaggggaaaaucggcaccauag

SEQ ID NO: 14339 - RNA, 753 nt, Artificial Sequence
  Description of Artificial Sequence: Synthetic coding sequence
auggcuagugagcgauugccuaaucgcccugcuugucugcucguagccaguggggcagcagaagguguuagcgcacaguccuuucugcacuguuuuacaauggcuucaaccgcauuuaaccuucagguugcaacacccggcggaaaagcaauggaauucgucgauguuacggaaucuaaugcccgauggguucaggauuuccgauuaaaggccuacgcauccccugcaaaguuagaaaguaucgauggagcucguuaccacgcccugcucauuccuucuugcccaggcgcacugacagacuuagccucaucgggcucucucgcuaggauccuccaacauuuucacucugaaagcaaaccuaucugcgcugucggccacggcgucgccgcauugugcugcgccaccaacgaggauagaucuuggguuuuugacucuuauucucuuacuggcccuaguguuugugaacuagugcgggccccaggguucgcucgccucccacuggucgucgaggauuucguuaaggauucuggcgcauguuuuucaggcgcagcggccagcugucccaaagcagaucgccacuggcaacauuuuccugucgaggaaauuuuucucgcauguggauucaaaguggcuggauuaggggcugcaccaggauggggcaggggcggcaagcaggaggacagaccaccagaggagcagcgacgcgccggagaggacuuuccaauuuaucagugcguguuuauuuaucccuag

SEQ ID NO: 14340 - RNA, 1386 nt, Artificial Sequence
  Description of Artificial Sequence: Synthetic coding sequence
augucccucgauauucaaagcuuagauauccaaugugaggaguuauccgaugcuagaugggccgagcuccugccccuucuucagcagugccagguggugagacucgacgauugcggguugacagaagcuagaugcaaagauauuuccuccgcccugcgugugaauccagcgcuggcagaacuaaaucugcggagcaaugagcuuggugaugugggcgugcacugcguccuccaggguuugcagacacccucuugcaagauucagaagcugagccuacagaauugcugccugaccggugcuggcuguggcguucuguccucuacgcuacggacacuaccuacccuccaggagcugcaucuaagugauaaucuuuugggagaugcgggccuucaacugcugugcgaagggcuucuagauccccaguguaggcuggagaaauugcaauuggaguauuguucucugucagcagcgaguugugaaccccuggccuccgugcuccgugcaaagcccgacuuuaaggaacugaccgugagcaauaaugacauaaaugaagcaggagugagaguccucugccagggcuuaaaggauuccccaugucagcuggaggcccucaagcuggagucauguggaguuaccucagacaacugcagagaucuguguggaaucguugcaucgaaagcgucccugcgcgaacuugcucuugguaguaacaaacugggcgauguagggauggccgaacucugcccuggauuauugcacccuaguagucgguugaggacccuguggauuugggagugcggaauaacagcaaaggguuguggugacuuaugccggguacugcgugcgaaagaaucuuugaaagaacugagccuagcugguaacgagcuuggagacgagggugcucgacugcugugcgagacuuugcuggagcccgggugucaauuagaaucuuugugggucaagagcuguucuuuuacugcugcaugcugcagucauuuuucaucuguguuagcucagaaucgauuucugcucgaacugcagaucuccaauaaccgccuugaggaugcuggggucagggaacugugucaagggcuaggccaaccgggcaguguacucagagugcuuugguuagcugacugcgacguuuccgauucuucaugcuccucucuggcugccacucuauuggcuaaccacagccugcgcgaauuagaucuuuccaauaacugccugggagaugcggguauccugcaacuaguggaauccgugcgccagccugguugccugcucgaacaacuuguguuauacgacaucuauuggucggaagaaauggaggaucgguuacaggccuuagaaaaagacaaaccgagucugagagugauuucuuag

SEQ ID NO: 14341 - RNA, 1386 nt, Artificial Sequence
  Description of Artificial Sequence: Synthetic coding sequence
auguccuuagauauucaaucacuggacauccaaugugaagaacucuccgacgcgagaugggccgaacuacuaccccuccuccagcaaugccagguggugcgucuggacgacuguggccuaacagaggcgagauguaaggauauaucaagugcuuugcgagucaacccugcucuggccgaacugaauuuacgguccaaugaacugggugauguaggagugcacugcguacugcaaggucuccagacaccgaguugcaaaauucagaagcugucccugcagaauuguugccuaaccggcgccgggugcggagugcugagcucuacacuuaggacccucccgacucuccaggaacugcaccugucagacaaccuacugggcgacgcaggauuacaauuacugugugaaggccuccuugauccgcagugccgccuagagaagcuacaacuagaguacuguucacucagcgccgccuccugcgaaccccuugccucuguccuacgagcuaagccagauuuuaaagaacuuaccguaucuaacaacgacaucaaugaagcaggcgugcgcguccucugccagggccuuaaagacucaccaugucagcuggaagcacuaaaacuggaguccugcgggguuacuucagauaacuguagagaccuguguggcauuguggcaagcaaggccucccuuagagaauuagcccucggaaguaacaaacucggggacgugggaauggcggagcucuguccgggccuguuacaccccucuagucgcuuacgcacccuguggaucugggaauguggaauuacugcaaaaggauguggcgaucuguguagagugcugcgcgccaaggagucguugaaagaacugagucuggccgggaaugaacuuggagaugagggcgcaagacuccucugcgaaacccuccuggagccaggaugccagcucgagucccucugggugaaaaguugcuccuuuacggcugccugcugcucgcacuucucuucaguacucgcacaaaaucgcuuucuucuugaguuacaaauuucgaacaaucgucuggaagacgcaggcguccgagaauuaugccaaggccuuggccagcccgggaguguguuacggguucugugguuggcagacugcgacguuucagacucuucuuguucuagccucgccgccacccuccuggcgaaucauucccuuagggaacucgaccugagcaacaauugccucggagaugccggaauccuacagcucgucgagucaguucgacaaccaggaugccucuuggaacaacugguucucuacgauaucuacuggucagaagagauggaagauagauuacaggcuuuggagaaggacaaaccaucccugaggguaauuucauag

SEQ ID NO: 14342 - RNA, 1386 nt, Artificial Sequence
  Description of Artificial Sequence: Synthetic coding sequence
augagccucgauauccaaaguuuagacauccaaugcgaagaacugagcgacgcucggugggccgagcugcucccccugcuacaacagugccagguggugcgucuugaugauugcggucucacagaagcacgauguaaggauauaaguuccgcccugagggugaaucccgcucuugccgagcugaaucuacggucuaaugaguuaggggaugugggcgugcauugcgugcuccaggguuuacagaccccuucuuguaaaauccaaaagcugagccuccagaauuguugccuuacuggcgccgggugcggcguucucagcuccacacuacgaacccugcccacuuuacaggagcuccaccuguccgauaauuugcuuggagacgcuggguugcaacugcugugugaagggcuucuggauccucagugcagacuugagaaguugcagcuggaauacuguucucucuccgcagcuuccugugaaccucucgcuaguguguuacgugccaaaccagauuucaaggagcuuacaguaaguaauaaugacauuaacgaagccggcgugcggguacugugucagggccugaaggauucgccgugucaacucgaggcacugaaacucgagagcuguggcgucacgagugauaacugcagggaccugugugggaucguugcuagcaaagcuucacugcgcgaguuggcacuggguucuaauaaacugggggacguggguauggcggagcuguguccaggccuuuuacacccaagcagccgguuaaggacucuguggaucugggagugcgguaucacggcuaagggcugcggggaucugugucgcguguugcgggcaaaagaaucuuuaaaagagcucucacuggcuggaaaugagcucggcgacgaaggagcgagacuacuaugugaaaccuugcuggaaccagggugucagcuugaaagucugugggugaaaucgugcaguuuuaccgcggccuguugcagccauuuuucaucuguucuugcccaaaaccgcuuccugcuugaacugcagaucucaaauaacagguuggaagacgcuggaguccgcgaguugugucaaggccugggccaacccgguuccguguuacgaguguuauggcuagccgauugugacguguccgacuccucaugcucuucucucgcagcgacucuacuugcuaaccacagccucagagaacuugaucugaguaauaacugccugggcgaugccggcauucugcagcucguggagucagugcgccagccuggaugccuguuggagcagcuugugcucuaugauauuuacuggucugaggaaauggaagaucgucuucaagcacuagaaaaagacaagccaucauuacgcgugauuucuuag

SEQ ID NO: 14343 - RNA, 1452 nt, Artificial Sequence
  Description of Artificial Sequence: Synthetic coding sequence
augauaaccgcccauuguucacucgaucuucucggcuccguugccguuuuaugcgugugugaccucuccccagcucaaugugacauaaacuguuguugugauccugacuguucaagugucgacuucaguguuuucagugcuugcagcgucccugucguuacaggagauucucaguuuugcucucagaaagcaguaauuuacucccugaauuucaccgccaaccccccucagcggguguucgaacuggucgaccagauuaauccaucaauuuucugcauccauauuacaaauuauaagccugcacuguccuuuaucaauccagaaguucccgaugaaaauaauuuugauacacuuaugaaaaccuccgaugguuuuacucucaacgccgaguccuauguaagcuucaccacaaaacuggauauuccuacugcggccaaguacgaguauggggucccccuucagaccagugauuccuuucugcgguuuccuagcuccuuaacuaguucucuguguaccgacaauaaucccgccgccuuccucgucaaucaggcaguaaaaugcacgcgcaaaaucaaucuagaacaaugcgaagagauagaagcacugucuauggcauuuuacucaucaccugaaauccugagagugccggacuccagaaaaaaagucccuaucacaguucagucuauuguuauucaaucccucaacaagacacucacccggcgcgaggauaccgauguucugcagccuacacuggugaaugcuggccauuucucacugugcgugaauguugugcuugaggucaaauauucacuaaccuacaccgacgcuggcgaagugaccaaagcugacuuaucuuuuguacugggaaccgucucaucuguggucgugccgcuacagcagaaauuugagauccacuuccugcaggaaaauacacagccaguaccucuaagcggcaacccaggguacgugguggggcuuccuuuggcagcuggauuccaaccgcacaaaacaggcgcccucccuugccagcucgucgcgcagaaagucaaaagccuccuguggggacaaggguuccccgacuacguugcaccauuugggaauucacaagcucaagauaugcuggauuggguaccgauucacuucaucacucaaagcuucaaccgaaagcacuuuguacuccaggauaguugccaauuaccuggagcacuuguuaucgagguuaaauggacuaaauacgguagccuguugaauccucaggccaaaauugugaaugugacagcuaauuuaaucaguucauccuuccccgaggcaaacuccggcaacgagcgcacuauucuuaucuccaccgccguaacuuuugucgaugucuccgcgccagcagaggcuggauucagagcacccccagcuauuaacgcacgauugcccuucaauuuuuucuucccuuuuguguag

SEQ ID NO: 14344 - RNA, 1596 nt, Artificial Sequence
  Description of Artificial Sequence: Synthetic coding sequence
augugccagcugcuagagaguacagucauccaaccucaaggagauucccccgucgcggugcuuugugugugugaucuuuccccagcacagugcgauaucaauuguugcugcgacccggacuguuccucugucgauuucucuguguucucagccugcucuguaccuguggucaccggcgacucccaguucugcucacagaaggcaguuaucuauucucuuaacuucacugccaaucccccacagcgcguguucgagcuuguugaucagauuaacccuuccaucuucugcauucauaucaccaauuauaagcccgcccuuagcuuuauuaaccccgaagugccagacgagaauaauuuugauacacuuaugaagacauccgauggcuucacacucaacgccgaauccuauguaagcuuuacuacaaaauuagauauccccaccgcagcaaaauaugaguacgggguuccccugcagacuagugauagcuuccugcgguuccccuccucccucaccuccucauugugcaccgauaacaacccugccgccuuucugguaaaucaggccgugaagugcaccagaaaaaucaaccucgaacagugcgaggaaauugaagcacuuagcauggcuuucuauucaucaccugaaauccuucgugugccagacucuagaaagaaaguucccauuacgguccaaucaauaguuauucagucccuaaacaagacccuuacccgccgagaggacacugacguccugcaaccuacccuagucaacgcuggacauuucucuuuaugcguaaauguagugcuggaggucaaguacucccugaccuauacagaugcaggggaagugacuaaagccgacuuaaguuucgucuugggaacggucuccucugugguaguaccucuccaacaaaaauucgagauacauuuccuacaagaaaauacacaaccggugccucucaguggcaacccuggcuaugugguagguuugccgcuggcugcaggcuuucagccucauaaaauguccgggauuauccaaaccaccaaccguuacggccaguugacuauucuccacaguacaaccgaacaggacugucuagcgcucgagggugucaggaccccuguauuauuuggguauacuaugcagucagguugcaaacuaaggcuaaccggugcccucccuugccagcuuguugcccaaaaagugaaaucucuacucuggggccagggcuuccccgacuacgucgcuccguucggcaacucucaggcacaagacaugcuggacugggucccuauacauuuuauuacgcagagcuucaaccguaaagacucgugccaacuuccuggugcccuugucauugaagucaaguggacaaaauacggcucucuacucaacccacaggcuaagauugugaacgugaccgcaaaccucaucagcuccuccuuuccagaagcaaauucuggcaacgaacgcacgauccugauuagcacagcgguaaccuuuguggauguaucugcuccagccgaggccgguuuucgcgccccccccgcuauuaacgccaggcucccauucaauuuuuucuuucccuuugucuag

SEQ ID NO: 14345 - RNA, 1722 nt, Artificial Sequence
  Description of Artificial Sequence: Synthetic coding sequence
augcgacccagagggcucccaccguugcuuguaguccuauuggguuguugggcgucugucagugcacagacugacgcaaccccugcaguuacuaccgaaggccucaauucaacugaggcugcccuggcuaccuuuggaaccuuccccucuacccgaccucccgguacuccccgagcuccugggcccagcuccgggccacgacccaccccaguaaccgacguugccguucuaugcgugugugaucuuucucccgcccaaugugacaucaacuguugcugcgacccagauugcucuuccguggauuuuagcguguucucugcgugcucgguuccagucguuacaggugauagccaguuuugcucccagaaagcagugaucuacuccuugaauuuuaccgccaaccccccucagcggguguuugaauuggucgaucaaaucaaccccucuaucuucugcauucacauuacuaacuauaagccagcucuaagcuuuauuaacccugaagugccugacgaaaacaacuuugacacccugaugaaaaccucugacggauucacccuuaaugcagaaaguuaugugucuuucacuacaaaacuugacaucccuaccgcugcuaaauaugaauacggagugccccugcaaaccagugacuccuuucugcgguucccuagcucacugacaucuucucugugcaccgacaauaaccccgccggacaggccuacugguucacacccgugauacccgcccugugggaggcagaagcgaggggcucacucgaggucccggacucacgaaaaaaagugccgaucaccgugcagucuaucgucauccagucucugaauaagacccuaacaagaagagaagauaccgacguucuccaaccuacacucguuaaugccggacacuucagccuaugugugaauguuguucucgaggugaaguauagucucacauauaccgaugccggcgaggugacgaaggccgauuuaagcuucguguuggguacaguuagcagcguuguuguaccauuacagcagaaauuugagauucacuuuuugcaggagaacacacaacccguaccccugagcgggaauccuggcuacguuguugggcuaccccucgcagcagguuuccagccucauaagggaaguggaauaauacagacuacaaaccgcuaugggcaacuaacaauucugcacucaacaaccgagcaagauugccuggcucuugaaggugugagaacuccuguguuguuuggcuacaccaugcagucuggcugcaaacugcgucuuaccggggccuugccuugccaguuagucgcacagaaagucaaaagucuucuguggggucaagguuuucccgacuacguugcucccuucggaaacucccaggcucaggacaugcuggauugggugccaauucacuuuauuacacagucauucaaccgaaaggacagcugucaguugccgggggcccucgucaucgaagucaaauggacaaaguacggcucucuuuugaauccacaagcuaagauagugaaugugacagcaaaccuaaucucuucuaguuuuccggaagccaacucugggaaugaacgcacaauucuaauauccacagcaguaaccuuugucgacgucuccgcgccugccgaagccggauuccgagcucccccagcaaucaacgcccgccuuccauuuaacuucuuuuuuccauuuguauag

SEQ ID NO: 14346 - RNA, 1230 nt, Artificial Sequence
  Description of Artificial Sequence: Synthetic coding sequence
augaagacaagcgauggcuuuacccugaacgcugagaguuaugucucguuuaccacgaaacuugauauuccaaccgccgccaaguaugaguauggcguaccacuucagacuagugacagcuuccugcgauuccccagcagucuuaccuccucccugugcaccgauaacaaucccgccgcuuuccucgugaaucaagcugugaaauguacccggaaaauaaauuuggagcagugugaggaaaucgaagcuuugucuauggccuuuuacaguucuccugagauccugcgcguccccgauagccgcaagaaagugccuauuaccgugcagucaauugugauacagucucuuaauaaaaccuugacccgccgcgaggauacagacgugcugcagccaacacuuguuaacgcaggccacuuuucccugugcgugaacgugguacuugaagucaaauauucauuaacuuauaccgaugcuggcgaaguaaccaaagccgaucugaguuuuguccucggaacaguauccagcguagucgugccuuugcagcagaaauucgaaauacauuuccuucaagagaacacccaacccguuccccugagugggaaccccggguauguuguggggcugccgcuugcagcgggcuuccagccacauaaaggaagcggcaucauccaaaccaccaaccguuacggacaauugacaauccuccauuccacuacugaacaagacugccuggcacucgagggggugagaacgccugugcuauuugguuauaccaugcagaguggcuguaaguugcgucuuacuggagcacuuccaugucagcucgucgcccagaaagucaagucucugcuauggggucaaggguucccugauuauguggccccuuuugguaauagucaagcucaagacaugcuagauuggguuccuauccacuuuauuacacagucauuuaaucgcaaagauuccugccagcuccccggcgcacuggucaucgaagugaaauggaccaaguaugggucacuccucaauccccaggcuaagauagugaacguaacggcuaaucuuauuaguucuuccuuuccugaagcaaauucugggaacgagcguacuauucucaucucgacugccgucaccuucguggaugucagcgcacccgccgaagccggauuucgagcuccucccgcuauaaaugcgaggcuuccuuucaacuucuucuuccccuucgucuag

SEQ ID NO: 14347 - RNA, 1779 nt, Artificial Sequence
  Description of Artificial Sequence: Synthetic coding sequence
augcguccccgcggacugccaccccugcugguuguccuuuuagguugcugggcaucuguguccgcucagacagaugcgaccccagccgugacaaccgagggccucaacucuaccgaggcagcccuagccacauuugguacauucccuucaacaaggcccccuggcaccccccgcgcuccuggacccagcagcgguccaaggcccacacccguuacagacguagcuguccuuuguguuugugaccucucccccgcucagugugauaucaauugcugcugcgauccugauuguucuucuguggacuucuccguguuuuccgcgugcuccgucccaguuguaaccggcgauagucaguuuugcucccagaaagcaguuauauacucacucaacuuuaccgccaaucccccacagcgcguuuucgaguuggucgaccagauaaacccaucaauuuuuugcauccacauuacaaauuacaagccagcacugucuuucaucaaccccgaggucccggacgaaaauaacuucgacacuuuaaugaaaaccagcgacggauuuacgcugaacgccgaaucguaugucuccuuuacgacaaaacucgauauaccgacagccgcaaaauaugaauacggagugccccuucagacuuccgacaguuuucugagauuccccuccucacuuaccucuucgcugugcacagacaacaauccagcugcauuccuggugaaccaagcugucaagugcacacguaagauaaacuuagagcagugugaagagauugaagcuuuaucaauggccuuuuauuccagccccgagauuuugcgggugcccgacagcagaaaaaaagucccuaucacaguccaaagcaucgucauccagagccugaauaaaacguuaacucgcagggaagacaccgaugugcuucagccuacccuuguuaaugccggccauuucucccugugugugaacgucguauuggaagugaaauauucccugacuuacaccgacgccggagaaguuacuaaagccgaucugagcuucgugcugggaaccgugucuaguguagucgugccacugcagcaaaaauuugagauacacuuucugcaggagaauacccaaccggucccucuguccggaaauccagguuacgucgucggacugccccuggcugccggcuuccaaccccacaaagguagcgguaucauccaaaccacuaaccgauacggccaguuaacuauccuccauucgacuacagaacaagacugucuugcacuggaaggaguccgcaccccaguucucuuugguuacacuaugcaaaguggguguaaauugcgccuuacuggugcucugccuugccaacucguagcccaaaaagugaagucucucuugugggggcaaggguucccagacuacgucgcacccuucggaaacucucaggcucaggauaugcucgacugggucccaauucacuuuauuacccagucauuuaacagaaaacauuuugugcugcaagauucgugccagcuucccggcgcccuggugauugaaguuaaauggaccaaguacggaucccugcugaacccccaagccaagaucguuaauguuacagccaaucuaaucucuuccuccuuuccugaagcuaauagcggcaaugaaagaacuauccugauuuccacugccgucacuuucguggacgugagcgccccugccgaagcgggauuccgcgcucccccugcaauuaacgcgagacugcccuucaacuucuucuuucccuucgucuag

SEQ ID NO: 14348 - RNA, 552 nt, Artificial Sequence
  Description of Artificial Sequence: Synthetic coding sequence
augaucuuccuccuguuaaugcucagccuggaacuccagcuacaucaaaucgcagcccuuuucaccgucaccguccccaaagaauuguauaucaucgagcauggcagcaaugugacccuggaauguaauuuugacaccggcagccacgucaauuuaggcgccaucacagcauccuugcaaaagguugagaacgacacaucaccacaucgagagcgagcaacgcugcuggaggagcaacucccuuuaggcaaggcaucauuccauauuccucagguccagguccgggaugagggccaauaucagugcauuauaaucuacggcguagccugggacuacaaguaccugacacucaaagugaagggucaaauggaacccagaacucauccgacuuggcuucugcauauuuuuaucccuuuuugcauuauagccuuuauuuucaucgcaaccguuauagcacugagaaagcaauugugccagaagcucuacagcaguaaggauaccacuaagcguccuguuaccacuaccaaacgugaaguuaacucugccauuuag

SEQ ID NO: 14349 - RNA, 822 nt, Artificial Sequence
  Description of Artificial Sequence: Synthetic coding sequence
augaucuuucuucugcuuaugcuuucccuggagcuccaacuucaccaaauugcugcucucuucacugugaccgugccaaaagagcuguacaucaucgaacacggcaguaacgugacuuuggaaugcaauuucgauaccggaucacaugugaaucuaggagcuaucaccgccucuuugcagaaagucgaaaaugauaccucaccccaccgcgaacgggcaacgcuacucgaagaacagcugccucuaggcaaggccagcuuucacauuccacagguccaagugagagaugagggccaguaccaauguaucauuaucuacggcgucgccugggauuacaaauaccugacacucaagguuaaagcuagcuaucggaaaaucaacacccauauacuaaaggucccugagaccgacgagguugaacugacaugccaggcuaccgguuacccacucgcagaggugucuuggccaaacgucuccgugcccgcaaauaccucucauagccguaccccagaagguuuguaccaggugacuaguguccuucgauuaaagcccccaccgggaagaaacuucucuugcguguucuggaauacacacguucgggagcuuacacuggcuagcauugaccuucaaucccaaauggaacccagaacucacccgacauggcucuugcacauuuuuaucccuuucugcaucaucgccuuuauauuuauugccaccgucaucgcccugaggaaacaacuaugccagaaacuguacucgagcaaggacacgacgaaaagaccggugacaaccaccaagcgcgaagugaauagugccauuuag

SEQ ID NO: 14350 - RNA, 372 nt, Artificial Sequence
  Description of Artificial Sequence: Synthetic coding sequence
cugggcgauaggagaggucguaguucaggagcaagagcagccgcugugggcucaacaggcgagagauuggagauggaggaagauauacugcagcuccaagccgaggcaaccgcugaaguguugggggaggucgcucaagcacagaaaguucugagagauucggugcaacggcuagaaguucaguugcguagcgcuuggcucgguccagcauaucgggaauucgagguccuuaaggcacaugcugacaaacagucacacauccugugggcucuuacgggucauguccagcggcaaaggagagagauggucgcccaacagcaucggcuccgccaaauccaagagcgccuacacaccgcagcccuaccggcuuag

SEQ ID NO: 14351 - RNA, 345 nt, Artificial Sequence
  Description of Artificial Sequence: Synthetic coding sequence
auggccuccuucaagcuagcagauagugugugggaagacagucuuucaaaacgccaaaggaaucagggccgcaugaaaacuuugccugugcugguccucucacugacacuccugacuguauucagcgaaacuucuccuauacucacagagaagcaagccaagcagcuccugaggucucguagacaagauaggccauccaaaccaggcuuuccagacgaaccuaugagagaguauaugcaucaccuucuggcucuggagcaccgggccgaagagcaauucuuagaacauuggcucaauccccacuguaaaccucauugugauagaaaucgaauccaccccguguag

SEQ ID NO: 14352 - RNA, 345 nt, Artificial Sequence
  Description of Artificial Sequence: Synthetic coding sequence
auggcauccuucaagcuggcugauagugucugggaggauucucuuucaaaaaggcagcggaaucaaggcagaaugaagacuuuaccggugcugguucuaucccugacucugcugaccguguucuccgaaaccagcccgauuuugacagaaaaacaagccaaacagcuccugcgaagcagaaggcaagaccgaccuuccaaacccgguuuuccagacgaaccaaugagagaauacaugcaucaccuccucgcucuugagcaccgagcagaggaacaguuucucgagcauuggcuuaauccacauuguaagccucacugugacagaaaucgaauucacccaguuuag

SEQ ID NO: 14353 - RNA, 444 nt, Artificial Sequence
  Description of Artificial Sequence: Synthetic coding sequence
auggcccuacagagaacucauagccuacugcuucucuugcuucucacucuccuuggauugggguuaguucaaccuucauauggccaagauggaauguaccaacgcuuucuuagacagcacguccauccugaagagacuggugggagcgauagguauugcaauuuaaugaugcagcgcaggaagaugacucuauaccacugcaagagauucaacaccuucauucaugaggauaucuggaauauccgcuccauuugcucuacuaccaauauccaguguaagaacggaaaaaugaauugccacgaaggaguugucaagguuacagacugcagggacaccgguagcucaagagcccccaauugccgcuauagagccauagccaguacucggagagucgugaucgcaugcgaaggaaacccacaagucccaguccauuucgacggguag

SEQ ID NO: 14354 - RNA, 1302 nt, Artificial Sequence
  Description of Artificial Sequence: Synthetic coding sequence
auggaaccccagcuuggucccgaagccgccgccuugcgacccggaugguuggcccuacuuuuguggguuucagcccugucuuguucuuuuucucucccugccagcagucugagcucccuugugccucaggugcggacguccuauaauuuuggucgaacauuuuuaggccuggacaaguguaacgcguguaucgguacuucgauuuguaaaaaguuuuuuaaagaagaaauccgcucugauaacugguuggcuucccaccuaggccuaccuccugauucccuccugagcuacccagcaaacuauagugaugacagcaaaauuuggcggccagucgaaauauuccgccuuguaucuaaauaucaaaacgaaaucuccgaccgacgaauaugugcaucugcuucagccccuaagaccugcuccauugaacggguccugcggaagaccgagcgauuucagaaguggcugcaagccaaaagacugacccccgauuuagugcaggguuuggcuucaccacugcuucgcugucccucucagaggcugcucgaucgcguagugcggcgguacgcugaggucgcugacgccgggucaaucuuuauggaucauuuuacagaccgggauaagcuccguuuauuguauacacuggccguuaauagucauccaauccugcugcagauuuucccaggugcugaaggcuggccccuuccaaaauaccucggaucgugcggcagguuucuuguguccacaagcacccguccccuccaagaguuuuaugacgcaccuccagaucaggcagcagaccuugcauaucaguuacuggguguccucgaaucucugcguuccaaugaccugaauuacuucuuuuacuuuacacacauugaugccgggauguuugguguuuuuaauaacggacaucuuuucauucgcgaugcauccgccguaggcgugaucgacaaacaggaggguucucaggaagcgaaucgcgccggagagaacaaagauauuuucuccugucucguuagcggcugucaggcucaacugccaaguugugagucaaucuccgagaaacagagccuggugcucgugugucaaaagcuccuuccacgacuucuccagggacgcuuuccuaguccagugcaggacgacaucgauucuauucuggugcaauguggagauucuauacggcccgauccugaagugcuuggcgccgcuucucaacucaaggacauccuccggccucuucguaccugugacucgcgauuugccuaucgguauccugacuguaaauacaaugacaaauucuag

SEQ ID NO: 14355 - RNA, 600 nt, Artificial Sequence
  Description of Artificial Sequence: Synthetic coding sequence
auggaaaccuucccccuguugcuccucuccuugggacuuguguuggccgaggcuucagaguccacaaugaagauuaucaaagaagaauuuacggaugaagaaaugcaguacgacauggcgaagucaggccaggaaaagcagacaauugaaauccucaugaauccaauucuucucgucaaaaauaccagccucucuaugagcaaagaugauaugucaucaacucugcuuacauuccgaucccuccacuauaacgauccaaaggggaauucaagugggaacgauaaagaguguugcaaugacaugaccguuuggcgcaaaguguccgaagcuaacggcuccuguaagugguccaacaacuucauccgcucuuccacagagguuaugagaaggguccaccgcgcaccuuccugcaaguuuguccagaaccccggcaucaguuguugugagagccucgaguuagagaauaccgugugccaauuuacuaccggcaaacaauucccuagaugucaauaucauuccguaacuagccuagagaagaucuugacggugcuuacaggucacagccugaugucuuggcucguaugcggaucuaagcucuag

SEQ ID NO: 14356 - RNA, 600 nt, Artificial Sequence
  Description of Artificial Sequence: Synthetic coding sequence
auggaaacauuuccccuccugcuccucucucucggacuggugcuagcugaggccucagagucaacuaugaagaucaucaaggaagaguucacugacgaagaaaugcaguacgauauggccaagagcgggcaagaaaaacagacuaucgagauucuaaugaaccccauccucuuggugaaaaacaccuccuuaucaaugucuaaagacgacaugucaaguacccugcugaccuuccgaagcuuacacuauaacgaccccaaggguaauucaagcggcaacgauaaagaguguuguaaugauaugacuguguggaggaaagugucugaagccaauggaucuugcaaauggaguaacaauuucauccguucuaguacugaagugaugcgccggguccaccgggccccuucuugcaaauuugugcaaaauccuggaauuucaugcugcgaaucucucgaacucgagaauacagugugucaguuuaccaccggaaagcaguuuccuagaugccaguaucacuccgugaccucacuugaaaaaauccucaccgugcugacaggacacucccuuaugagcuggcuaguaugcgggucuaaacucuag

SEQ ID NO: 14357 - RNA, 291 nt, Artificial Sequence; identical to SEQ ID NO: 12718
  Description of Artificial Sequence: Synthetic coding sequence

SEQ ID NO: 14358 - RNA, 981 nt, Artificial Sequence
  Description of Artificial Sequence: Synthetic coding sequence
augaccggccuuugugguuacagcgcccccgauaugcgcggccuacguuugaucaugauuccuguggaauuacugcucuguuaccugcugcugcacccaguggacgcaaccucguauggcaaacagaccaacguucugaugcacuucccccucucccucgaaucacagacucccucauccgaucccuuauccugccaguucuugcacccaaaaaguuugcccggcuucucccacauggcccccuuacccaaguucuuagugagucuugcccugcguaaugcuuuagaagaggccgguugccaggcagauguuugggcucuccaacuucagcucuaucgccaggggggaguuaacgccacucagguacuuauccaacaucugcgcggacuacagaaagguaggucaaccgaacgcaacguuucuguggaggcccucgcuucggcccugcagcuccuggcucgcgagcagcagucuacgggaagggugggcagaucacuaccaacagaggauugugaaaaugaaaaagaacaagcaguucauaaugucguucagcuucucccaggggucggcacauucuacaaccucgggaccgcuuuguacuacgccacccaaaacugucucggaaaagcaagggaacgagggcgggauggcgccaucgaucugggauacgaucucuuaaugacaauggcaggcauguccggagguccaaugggacuggcuauuucugcugcacugaaaccugcgcuuaggagcggaguacaacaacucauccaguacuaccaagaccaaaaggacgcgaauauuagucaaccagagacaacuaaggagggucugcgcgccauuuccgacguaagcgaucuagaagagacaaccacucuugcuucauucaucagcgaggugguuaguagugcaccuuacuggggcugggccauuaucaagaguuacgauuuagauccaggagccggcucuuuggaaaucuag

SEQ ID NO: 14359 - RNA, 1476 nt, Artificial Sequence
  Description of Artificial Sequence: Synthetic coding sequence
augcgguggauacucugcuggagccuuacccugugcuugauggcucagacagcacugggcgcacuacauacaaagagaccccagguggugacuaaguacggcacgcuccaggguaaacagaugcacgucggcaagacaccaauacagguuuuucucggugucccuuucucuagaccuccccugggcauucuucguuucgccccgcccgaaccaccagaaccuuggaaaggaauuagagacgccacuacauaccccccgggcugcuuacaagaguccuggggacaacucgccucuauguaugucaguacaagagaaagguacaaguggcugagauucuccgaagacugccucuauuugaacguuuacgcccccgccagagcucccggugauccccaacucccagugauggugugguuuccuggaggcgcuuuuaucgugggagcggccucgaguuacgaagggucagauuuggcggcaagagagaaggugguguugguguuccuacagcacagacugggcauauuuggauuucugucaacagaugacucacacgcccgcgguaauuggggucuccuggaucagauggcagcccugcggugggugcaagagaauauagcagcguucggcggagauccaggaaauguuacucucuucggacagucugcuggagcaauguccauuuccggccuuaugaugucuccucuugccuccgguuuguuucaccgagcuauuucucagagcggcaccgcacucuucagacuguucauaacuucuaauccauugaagguggcuaaaaagguugcgcaccuugcaggcugcaaccauaauucgacgcaaaucuuggugaauugucugcgagcccuguccgggacaaaggucaugaggguaucuaacaaaaugagauuucuucagcuaaauuuccagcgcgauccagaagagauuauauggucaaugagucccguggucgauggcgucgugauucccgacgacccccuggugcuccugacgcagggaaaaguuucuaguguuccguaccugcuugggguuaauaaccuggaauucaauuggcuccugccguauaacaucaccaaagagcaagugccacuuguaguggaagaguaccuugacaacguaaaugagcaugacuggaaaaugcuacgcaaccggaugauggauauaguacaggacgccacauucguguaugcaacauugcagaccgcccauuaccaucgcggauuaucaaugggaaaagaaaaagccuugucccuacagaugaugaaguacugggcaaauuucgcuaggacaggaaauccaaacgacggcaaccuuccgugcuggccacgguauaauaaagaugagaaauaucuccagcuugacuuuacgacucgcgugggcaugaagcuuaaagaaaaaaaaauggcguucuggaugucacucuaccagucgcagcggccugaaaagcagagacaguuuuag

SEQ ID NO: 14360 - RNA, 285 nt, Artificial Sequence; identical to SEQ ID NO: 12721
  Description of Artificial Sequence: Synthetic coding sequence

SEQ ID NO: 14361 - RNA, 402 nt, Artificial Sequence
  Description of Artificial Sequence: Synthetic coding sequence
augagacagagauuacuuccaucugucaccucacuuuuacucguggccuugcuguuccccgggagcucacaagcucgacaugucaaccauagcgcgacugaagccuuaggcgaauuacgcgaaagagcuccggggcaaggaaccaauggcuuucaauuacuaagacaugcugucaagcgcgaccugcuaccuccccgcaccccucccuaucagggcgaugugcccccaggaauacggaauaccaucugccacaugcagcaaggaaucugucgucuguuuuucugucauaguggcgagaaaaagagggacauauguucagaucccuggaacagaugcuguguuuccaauacagacgaagaaggcaaagagaaacccgaaauggaugguagaucugggauauag

SEQ ID NO: 14362 - RNA, 564 nt, Artificial Sequence
  Description of Artificial Sequence: Synthetic coding sequence
augggcugcugcggcuguucgggugguugugggucgggcugugggggaugcggcucagguuguggcggauguggauccucuugcugcgugccgauauguugcuguaaaccugugugcuguugugugccagcuuguucgugcuccagcugcgguuccuguggaggcucgaaggguggacgugguaguugcgggggcucuaagggcgacuguggaucuugcggcgguucuaaagguggauguggaucaugugguuguucccaguguuccuguuacaaacccuguugcugcagcuccgggugugggaguuccugcugccaguccagcugcugcaaacccuguuguucccaauccaguuguuguaagccuuguucuuguuccucaggaugcggaucgucuuguugccagucuuccuguuguaaaccuugcuguucacagagcagcugcugcaaaccuugcugcuguucuuccggcuguggcucuuccuguugucaguccucaugcugcaaacccuguuguucucagaguuccuguugugugccaauuuguugccagugcaagaucuag

SEQ ID NO: 14363 - RNA, 564 nt, Artificial Sequence
  Description of Artificial Sequence: Synthetic coding sequence
augagaccacuugcaggcgccccaguucccaagcgacaaaagugcgaucauuggacaccuugccccuccgauacauaugcauaccgucuguugucugguggaggacggucuaaguacgcaaaaauauguuuugaagauaaccuguuaaugggggagcagcuggguaacguggcacguggcaucaacauugccaucgucaacuaugucacggguaacguuaccgccaccaggugcuucgacauguaugaaggcgacaauagcggcccaaugacgaaauuuauucagucugcagccccaaaaagccugcuguuuauggucaccuacgacgaugguagcacgcgccugaacaaugacgcaaaaaacgcaauugaagcacuugggagcaaagagauucgaaauaugaaauuucggucuuccuggguuuuuauugcugcaaaaggccuagaguuaccuucugagauccagcgagagaaaauaaaucauagcgacgcuaagaauaaccgcuacuccggauggccugcagagauccagauugaggguuguauuccaaaagagagaucguag

SEQ ID NO: 14364 - RNA, 249 nt, Artificial Sequence; identical to SEQ ID NO: 12725
  Description of Artificial Sequence: Synthetic coding sequence

SEQ ID NO: 14365 - RNA, 186 nt, Artificial Sequence; identical to SEQ ID NO: 12726
  Description of Artificial Sequence: Synthetic coding sequence

SEQ ID NO: 14366 - RNA, 1056 nt, Artificial Sequence
  Description of Artificial Sequence: Synthetic coding sequence
auggggaaucuguucauguuaugggcugcccuggggaucugcugugcugcuuuuagugcaucggcuuggaguguuaacaauuuccugauuaccggcccaaaggcguaucuuacuuauacgacaucaguggcccugggugcacagagugggaucgaagaguguaaguuucaguuugcaugggaacgcuggaauugccccgaaaacgccuuacagcuguccacacauaauaggcugagaagcgccacccgcgaaaccuccuucauacaugccauuucuucggcaggagucauguacaucauuacgaagaauuguucaaugggggauuucgaaaacuguggaugcgauggaucuaacaaugggaagaccgguggucacggguggauuugggguggauguuccgacaacgucgaguucggagaacggaucuccaagcuguucgucgauuccuuggagaagggcaaagacgcacgugccuuaaugaacuugcauaacaaccgagccggcaggcuagcagugagggcgacuaugaagcgaaccuguaaaugucacggaaucagcgggagcuguagcauacagacguguuggcuccagcuggccgaguucagggaaaugggagauuacuugaaagcuaaauacgaccaggcccuuaaaaucgagauggacaaacgacagcugcgcgcuggcaauucugcugagggccacuggguaccagcugaggcauucuuaccauccgccgaagccgaauugaucuuucuugaggaaucuccagauuacuguacgugcaacucuucccucgguauuuacggaaccgagggccgcgagugcuugcagaauucucauaauacauccagaugggagaggcguaguugcggcagauugugcaccgaauguggccuucagguugaggaaagaaaaacugaagugauuagcuccugcaauuguaaauuucaaugguguuguacaguuaaaugugaccaauguagacacgucgugucuaaguauuacugcgcucggaguccgggaagcgcccaaagucucgggaaagguuccgcuuag

SEQ ID NO: 14367 - RNA, 1446 nt, Artificial Sequence
  Description of Artificial Sequence: Synthetic coding sequence
augcaaucuagacugcugcuucucggggcacccggcggacacggcggucccgcaucuagaaggaugaggcuucuauuacgacaggugguacagcggcgaccaggcggugaucggcagagaccagaggugaggcugcuucaugcggggucuggagccgauaccggggacacaguuaauauuggcgauguguccuacaagcuuaagauacccaagaacccugagcucgucccgcaaaauuauauuucugauucccuggcccagagcgucguacagcaucuccgauggauaaugcaaaaagaccuccugggacaggauguguuccuuauuggccccccuggcccacuccgcagauccaucgcaaugcaauaucuggagcugacuaagcgagaaguugaauacauagcccuuagucgagauacaacugaaacugaccuuaagcaacgacgggagauccgcgccggcacugccuucuauauugaccaaugcgccgugagagccgccacggaagguaggacacugauacuggaaggguuggagaaggcggaacggaacguccuccccguguugaacaaucugcuugaaaacagagaaaugcagcuugaggauggcagguucuuaaugagcgcagaacgcuacgauaaauuacugcgcgaucacacuaaaaaggaacuugacaguuggaagaucguucggguuucugaaaacuuucgggucauugccuuaggacuccccgugccuagauacuccgguaacccucuggacccuccucuaaggucacgcuuucaggcucgcgacaucuacuauuuaccauucaaagaucaguuaaaguuacuauacucgaucggagccaauguuuccgccgagaaggugagucaauugcugagcuuugcaaccacuuuguguucacaagagaguucuacucugggucuacccgacuucccucuugacucucuggccgccgccguacagauucuagauucauuuccaaugaugccuauuaagcacgccauccaguggcuauaccccuacuccauucuccuggggcaugagggcaagauggcuguggagggcguacucaaaagauuugaacuccaagauuccggcuccaguuuacuacccaaggagauugugaagguagagaagaugauggagaaccaugucagccaggcauccgugaccauucguauugccgauaaggaaguuaccauuaaaguuccagccggcacuaggcuccucagccagcccugcgcuucagacagauucauucaaacauugucccauaagcaauuacaggccgaaaugaugcagucucauauggugaaagacauuugccugaucgguggcaaagggugcggaaaaacagucaucgccaaaaauuuugcugacacccucggguacaauauugaaccaauuauguuguaucagcacaaaguaccccauaucuag

SEQ ID NO: 14368 - RNA, 786 nt, Artificial Sequence
  Description of Artificial Sequence: Synthetic coding sequence
auggcaucacuggcagugagcaacuggccaaagcccaugccccugaucccuugucugucaugguccaccgcgucuggcguauuuacuacagguguacuauccaaaagcaucaacuggcgcgaacuugaaaagcaauauuacacccagacuguguaugaagaggagauuauacauaugcuggaguacugcgggaccgauucuuucaaaaugggacaagaauuuguuaaacacuucacuuccucagccgauaaacucaccaaucugaaccuagucagucgaacacuuaauuuagacauauccaaucaagugguaucccaaaagcccgccgauugucauaauagcucgaaaacuagcguuucugcaaccagugaaggucuguuacuucaggacaccuccaagaugaagcguuucaaccagacccucucgacaaauaagucaggauauacaagucggaauccacagucauaucacuugcuuagcaaggaacagucuaggaauucuuuaagaaaggagucucugauuuuuaugaaagguguuauggacgaguguacacauguagcuaauuucuccgugcccguagacccauccuugaucaucguuguacaagccaaagaggacgcauauauaccaaggaccggugugcgcucgcugcaggagaucuggcccgggugugagauucgcuacuuagaggggggacacaucuccgcauaucuguuuaaacagggguuauuuaggcaggcuauauacgaugcuuucgaucgcuuucuacacaaauacgccaacuag

SEQ ID NO: 14369 - RNA, 1245 nt, Artificial Sequence
  Description of Artificial Sequence: Synthetic coding sequence
augggugucagcaagcuagauaucuuauaucgucgccuucuccugacaaaacuuuuuauucgcggcuggggacgacccgaggaucugaaacgucuauucgaguuccgcaagaugauuggaaacagggaacgcugccagaaucucgucuccucagacuacccuguucauauagacaagauagaagaacagucugacugcaagauucuggacggacacuucgucuccccuauggcccauuacgugcccgauauuaugcccauugaaucaguaaucgcccgcuuccaauuuaucgugccaaaagaguggaacucaaaauaccggccuguguguauucaucucgcuggaacaggugaccaucacuacuggcguaggaggacucuuauggcgcgcccuaugaucaaagaagcaaggauggccucccugcuguuagagaaucccuacuacggaugccgaaaaccgaaggaccaaguucggucuucucucaagaacguguccgauuuguuuguuaugggcggcgcuuuagugcuggagucugcugcucuauuacauugguuggaacgcgagggguauggaccauuagggaugaccggcauuagcaugggaggucauauggcaagccucgcuguuaguaacuggccaaagccuaugccacugauccccugccugucauggucaaccgcauccggggucuucacaacaacagacagcuuuaaaaugggacaggaauucguaaagcauuuuaccuccagcgcagauaaacugacuaaucugaaucuagugagucguacgcucaaccucgauauauccaaucagguugugagucaaaaaccagccgacugccauaauucaucaaaaacaucugucagugcuacuucggagggauuacugcugcaggauacaucaaaaaugaaacgguuuaaccaaacucuguccaccaauaaauccggauauacguccagaaacccucaaagcuaccaucuacuuucaaaagagcagucgcguaacucccugaggaaggaaucucuuauuuuuaugaaggggguuauggaugaaugcacacacguggccaacuucucaguuccaguugaucccagucuaaucauagugguccaagcaaaggaagacgcauacauaccuagaaccggaguucgcucucugcaggaaaucuggccaggaugcgagauuagauaccuggagggaggacauauuuccgcguaucuuuuuaaacagggucuuuuucgguag

SEQ ID NO: 14370 - RNA, 747 nt, Artificial Sequence
  Description of Artificial Sequence: Synthetic coding sequence
augaaguugacauucuucuuaggucugcuggcccucauuuccuguuuuacaccguccgaaagccagcgauucucccgccgcccuuaccucccugggcaacugccaccuccuccccuguacaggccgagaugggugccaccaucaccucccccacccuacgauagccgccucaauucaccucugucccugccauucguuccaggccgggugccucccagcucauuuagccgcuuuucucaagcugugauacuuagccaacuauucccucuggaauccauaagacaaccucgacuguuccccggauacccgaaucuucacuucccucuuagaccguauuaugugggaccuauccgaauacugaagccgccuuuucccccaaucccauucuuucuggccaucuaccucccuaucucaaaccccgaaccgcagauuaacauuaccaccgccgacacaacgaucacaacaaacccgccgacaaccgcaacugccacaaccucaacaagcacuaagccaacaaugaccaucagcucguccaccgucccaaucucaucuacacccgaacccgccacaucgauaucagcugcuacucccgccgccucaacagagaacacuacgcagauccucgcaaaucgcccucacacaguccuucucaaugcaaccguucaggugaccaccucuaaucagaccauacuuucaucuccagcauucaagucuuuuuggcaaaaguuguucgcaauuuucggauag

SEQ ID NO: 14371 - RNA, 231 nt, Artificial Sequence; identical to SEQ ID NO: 12732
  Description of Artificial Sequence: Synthetic coding sequence

SEQ ID NO: 14372 - RNA, 1536 nt, Artificial Sequence
  Description of Artificial Sequence: Synthetic coding sequence
augcugguugauggcccaucugagagacccgcgcucugcuuucuacuucuugcaguugcaauguccuucuuuggcucugcacuaucuaucgacgaaacaagggcucaccugcuuuuaaaggaaaaaaugaugagacucgggggacggcucguccugaacaccaaggaagaacuggcaaacgagagauugaugacacugaaaaucgcugaaaugaaggaagccaugcguacacugauuuuuccucccaguaugcauuuuuuccaggccaagcaucugauugaacgcucacaaguguucaacauucucagaaugaugccuaaaggagccgcacuucacuugcacgacauuggaauuguaaccauggacuggcuuguacgcaauguaaccuaucggccucacugucauaucugcuucacaccacggggcaucaugcaguuuagauucgcacacccgaccccgcggcccucagaaaagugcucaaaguggauucugcuggaagauuaccguaaaagaguucagaauguaaccgaguuugacgacagccuccugcgcaauuuuacgcuugugacucagcaccccgaggugauauauacaaaccaaaacgugguauggucaaaauuugagacaauuuucuucacaaucuccggauuaauucauuaugccccaguuuuucgggauuacgucuuuagauccaugcaggaguuuuaugaggauaacguucuguauauggaaauucgagcccgacuuuuaccuguuuaugaacugaguggggagcaccacgaugaagaauggagcgugaaaaccuaccaagaggucgcccagaaguuugucgaaacucauccagaguucauaggaaucaaaauuauuuacuccgaucacagaaguaaggacguggcagucauugccgaaagcaucagaauggccaugggacuucguauuaaauuccccacagugguagcgggcuucgaucuagugggacacgaagacacaggacacagcuuacacgacuacaaggaagcuuuaaugauucccgcgaaagauggaguuaaacuaccuuauuucuuccaugccggcgagacagacuggcaggguacuucuauagauaggaauauccuggacgcucucaugcuaaauacuacaagaauuggucauggguucgcacuuuccaagcauccagcagugcgcaccuacuccuggaaaaaggacauuccaaucgaagucugcccuauuucaaaccagguacuaaagcucgucagugacuugagaaaccauccagucgcuacccuuauggccacuggccacccaauggugauaucuagcgacgauccagcuauguucggcgccaaaggguugucauacgauuucuaugaagucuucaugggcaucggaggaaugaaggccgaucuacgcaccuuaaagcagcuggcaaugaauucaauuaaauauuccacucuacuugagucugaaaagaauacauuuauggagaucuggaaaaagagaugggacaaauucauugcagacguugcuacuaaauag

SEQ ID NO: 14373 - RNA, 1536 nt, Artificial Sequence
  Description of Artificial Sequence: Synthetic coding sequence
auguugguugacggcccaucugaaagacccgcguuaugcuuccugcugcuggcaguugcaaugagcuucuucggcucagcccugagcauugaugaaacgagagcacaccuccuguuaaaggaaaaaaugaugcgguugggcggccguuuggugcugaauaccaaagaggagcuggccaacgagcgccugaugacacucaagauugcugaaaugaaggaagccaugcgcacacuuauauucccaccaucuaugcacuuuuuccaagccaaacaucugaucgaacgaucucaaguauucaauauacuccggaugaugcccaaaggagcagcacuccaccuucaugacaucggaauuguuacaauggacuggcuugugcguaauguuacauauagaccucacugucacauuugcuuuacuccacgugguauuaugcaguuucguuucgcccacccuaccccucggcccuccgaaaaauguaguaaauggauucugcuagaagauuaccgaaaaagagugcaaaacguaacugaguuugaugauaguuuacuuaggaacuucacacucgugacacaacaccccgaggugaucuacaccaaucagaauguaguuugguccaaguuugaaacgaucuucuucacuaucagcgggcuaauucacuaugcccccguguucagagacuacgucuucagaucaaugcaggaauuuuaugaggacaaugugcuuuauauggagauuagagcaagauuacugccaguuuaugaguuauccggagagcaccaugaugaggaauggucagucaagaccuaucaggagguugcccagaaguucgucgaaacccauccagaguuuauuggcauuaaaauaauuuauucggaccacagauccaaggauguugcugucauagcagaaaguauacgcauggcuaugggccuaagaauuaaauuucccaccguuguagccggcuuugaucugguuggucaugaagacacaggacauucccuucacgauuauaaggaggcucuuaugaucccugcgaaagacgguguaaaacucccguauuucuuucacgcaggagagacagacuggcagggcacaucaauagacaggaacaucuuggaugccuugaugcucaauacuacucggauagggcauggguucgcccuaucaaagcaccccgcugucagaacuuacucauggaaaaaagacaucccuauugaaguuugccccaucagcaaccagguauuaaaacuaguguccgaucuuaggaaccauccagucgcuacuuuaauggccacagggcaccccauggugauauccucagaugacccugccauguuuggagccaagggacuaucuuacgauuucuacgagguauucauggggauuggagguaugaaggccgacuugagaaccuuaaagcagcuggccaugaacucaauuaaauauagcaccuuguuggaauccgaaaagaacacuuucauggagauuuggaagaaacgaugggacaaauuuaucgccgacguagcaacuaaguag

SEQ ID NO: 14374 - RNA, 240 nt, Artificial Sequence; identical to SEQ ID NO: 12735
  Description of Artificial Sequence: Synthetic coding sequence

SEQ ID NO: 14375 - RNA, 351 nt, Artificial Sequence
  Description of Artificial Sequence: Synthetic coding sequence
auggcagcuggcuccgcgccuaugcaacuacauuugcgugccacaauucggaugaaagacgggcucugcguaccccgcaaauggauuuaucacuugacugagggcaguacugaucuaaggaccgaaggccgcccagauaugaagaccgaacuuuucuccaguagcuguccaggcggaauuaugcucaaugaaaccggacagggcuaccaacgguuucuguuguacaaccgcuccccucacccccccgaaaagugugucgaggaauucaagucucuuacuucaugccuugauuccaaagccuuucuacucaccccacggaaccaagaagcgugcgaacugucuaauaauuag

SEQ ID NO: 14376 - RNA, 543 nt, Artificial Sequence
  Description of Artificial Sequence: Synthetic coding sequence
caggugaucccaauaaacucaggugaucuuuucguacauccguuguggaaccgguccuguguagcuugcggaaacgacauagcccugaucaagcucucccggagugcacaguuaggugacgcuguccagcuggcauccuuaccacccgcaggggacauauugccaaaugaaacaccuuguuauaucacuggcugggguagacuuuauacgaauggcccucucccagauaagcuccaggaagcccuucuacccgugguggacuaugagcacuguagucguuggaacugguggggaucuuccgugaaaaagacuaugguuugcgcaggcggggacauucggucugggugcaacggcgauuccggcggaccucuaaacugucccacagaagauggcggcuggcaaguucauggaguuacaucuuuuguuucagcauucggcuguaacacacgacggaaacccaccguguucacaagggucucugcguuuauugauuggaucgaagagaaguugcaagggaauaaggcaccugaaucccguacuuag

SEQ ID NO: 14377 - RNA, 1215 nt, Artificial Sequence
  Description of Artificial Sequence: Synthetic coding sequence
augccaccuuuccuuauaacucuauuucuuuuucauuccugcugcuuacgcgccaauggccaccugagggaggguaugacgcuucugaagacugaguucgcccugcaucuguaucagucgguugccgcuugucguaacgaaaccaacuucgucauuagcccagccggaguaagccuaccucucgagauccuccaguucggcgccgaagggucaaccggacagcaauuagccgaugcacucggauauacugugcacgacaaaagagugaaagauuucuuacaugcaguguacgccacacugccuaccagcucacagggaaccgaaauggaauuggccuguagucuguuugugcagguggguacaccacugucuccauguuuugucgagcauguaucuuggugggcuaauucuucccuggaaccggcugauuuguccgaaccuaauuccacagcaauacagacuucugagggugccucucgagaaacugcugggggcgggccuagugagggaccugguggcuggccaugggagcaagucuccgcagcuuucgcccagcugguguuggucagcacaaugucauuccagggcacguggagaaagagauucucuucuacugacacacagauucucccauuuacuugugcuuacggccuugugcugcaaguuccaaugaugcaccagacgaccgaagugaacuacggccaguuucaagacacugcaggacaccaggugggggugcuggaacugcccuaucuuggauccgcuguuucucucuuccugguccuaccucgggacaaagacacgccucuuucacacaucgagccccaccucacugcgagcaccauucaccuuuggacuacaucccuucgccgcgcuaggauggauguuuuccuaccacgguuccguauucagaaccaguuuaauuugaaaagcauucuuaauuccuggggggugaccgauuuauuugacccucugaaagcaaacuugaagggaauaagcggccaagacggauuuuacguaucagaggcuauucacaaggcgaagauagaaguccuugaggaagggaccaaagcaagcggcgccacagcuuuacuucugcucaagagaucucgaauucccaucuuuaaggccgaucgccccuuuaucuacuucuugcgcgaaccuaauacgggauuuguuuucagcauugguagagucuccaauccauuagacuag

SEQ ID NO: 14378 - RNA, 444 nt, Artificial Sequence
  Description of Artificial Sequence: Synthetic coding sequence
auggggcccgaagcacuaaguagcuugcugcuccuccuccucguagcuucaggcgaugccgauaugaaaggccacuucgauccggcuaaauguagauaugcacuagggaugcaggaucgcacgauuccagacagugacauuucggcgucuucgucuugguccgacuccaccgcggccaggcauucucggcuagaaucuucggacggcgacggcgccuggugcccugccggcagcguguuuccaaaagaagaggaauauuugcaaguagacuugcagcggcuucaucuuguggcgcucgucggcacacagggaagacacgccgguggucugggcaaggaauuuucacgaaguuaucgccuuagguauucuagagacggacgaagauggaugggcuggaaggaucgguggggacaagagguuauaucaggcaacgaagaccccuag

SEQ ID NO: 14379 - RNA, 2631 nt, Artificial Sequence
  Description of Artificial Sequence: Synthetic coding sequence
augggccccgaagcccugucuucuuugcucuugcucuuguugguugcgucaggcgaugcagauaugaaaggucauuucgauccagcuaagugcagauacgcccuggguaugcaagacagaacaauccccgacagcgauauaagugccucaaguucuuggucggauaguacugccgcaaggcacagccgguuagagucauccgacggcgauggugcauggugcccagccggcagcguguuuccaaaagaagaggaauaucuucaaguugaccugcagcgccugcaucuaguggcucuugucggaacucagggccgccaugcgggcggucucggaaaggaguuuaguagaucauauaggcugagauauagccgagaugggagaagauggaugggguggaaagaucgcuggggacaggaagugaucucuggcaaugaggauccagagggugucgugcuaaaagauuuaggcccgccuaugguagcaaggcugguccgauuuuacccuagggcugaucggguuaugagugucugcuugcggguggaacuguacgggugucuguggcgagauggacuguuguccuacacugcuccuguaggacagaccauguaccugucugaagcagucuaucucaaugacagcaccuacgacggccauacaguuggcggccugcaguacgggggacucggacaacuggcggacggcgucgucggacucgacgauuucaggaaaucucaagagcuuaggguguggccugguuacgacuacguuggcugguccaaucauuccuuuucuucuggcuacguggagauggaauuugaauuugacagacugcgcgcuuuccaagcgaugcaaguccauugcaauaacaugcacacgcucggagcuagacucccgggaggcguugaaugucguuuccgcaggggaccugcaauggcaugggagggugagcccaugcgucacaaccucggcgggaaccuuggagauccucgcgcccgcgccguuucaguuccacucggaggccguguugcucgauuucugcagugucgguuucucuucgccgggccuuggcugcuguucuccgagauauccuucauuucagauguggucaacaacucuucucccgcacucggaggcacauuccccccggccccaugguggccaccaggaccuccgcccacuaauuucucuucucuugagcuggagccuagaggccagcagcccgucgccaaggcugaaggaucucccaccgcaauauugauagggugcuugguggccauuauccugcuauugcuguugauuaucgcccuuauguuauggagacuucauuggcgccgacuguugagcaaagccgagcggcguguucucgaggaagagcugaccguccaccuguccgucccuggagacacaauucuaauuaacaacaggccuggcccccgcgaacccccacccuaccaggagccccgaccaagaggcaaucccccucacuccgccccuugcgugccaaauggcucagcauauucaggagacuacauggagccagaaaaacccggggcaccuuugcuaccaccacccccacagaauuccgugccgcauuacgccgaagcggauauaguuacucuacagggggucacaggcggaaacacuuaugcuguccccgcccucccccccggagcuguaggagaugggccgccacggguagauuucccuagaagcagacugagauucaaagaaaagcuaggugagggacaguuuggcgaggugcacuuaugugaaguugauucaccacaggaccuagugucucuggauuuuccacuuaauguuagaaaaggccauccccucuugguugccguuaagauucugagaccagacgcaaccaagaacgccaggaaugauuuucuaaaagaggugaaaauuaugagccggcucaaagacccaaauauaaucagacugcuuggcguuugcguacaggacgauccucuuugcaugaucacugacuacauggagaauggagauuugaaccaauuccucagugcccaccagcuggaagacaaagccgcugagggcgccccaggcgauggucaggccgcacaggguccaaccaucagcuacccaaugcugcugcacguggcugcccagaucgcaucuggaaugagguaucuggcgacccuuaacuuugugcaccgugaucuggcgacaagaaauugccuuguuggagagaacuuuacaauuaaaauugccgauuuuggaaugucucguaaucucuaugcuggggacuacuaccgaguucagggaagagcagugcugccuauuagauggauggcaugggaauguauucucauggggaaguucacaacagcgucugacguaugggcauuuggagucacacugugggaggugcugaugcucugccgugcgcaaccuuucggccaacugacugaugaacaagugaucgagaaugcaggggaauuuuuucgggaucaggggagacaggucuaucugagucggccucccgccuguccucagggccuuuacgaacucaugcuaagaugcuggagcagagaauccgagcaacggccuccauucucacagcuucauagguucuuagccgaagaugcuuugaacacugucuag

SEQ ID NO: 14380 - RNA, 2631 nt, Artificial Sequence
  Description of Artificial Sequence: Synthetic coding sequence
augggcccagaagcacucucaucccuauuacugcuguuguugguggccuccggagaugccgacaugaagggucacuuugauccugcuaaaugucgcuacgcucucgguaugcaggaccgaacuauuccggacucagauaucucagcgucaaguagcuggucagauagcacggcagcccgccauucccgccuggaaucuucugacggcgauggcgcuuggugcccugcaggcagcguguuccccaaagaggaagaauaucuacagguggaucuccagcgucuucaucuugucgcucugguugggacucagggcagacacgccggagggcugggcaaagaauucucacggaguuaccgccuaagguauagccgggauggcaggagauggaugggguggaaagacagauggggacaggaagugauaagcggcaacgaagacccagaaggugucguccugaaggacuuaggcccuccaaugguugcuagguuaguccgauuuuauccucgcgccgaccgcguuaugagcgugugucucagaguggagcuauaugguugcuuauggagagauggccucuuaucauauacugcucccgugggccagaccauguaucuaagugaggcaguuuaccuaaaugauaguacauacgauggucauaccgugggcggccuucaguacggaggcuugggccaacuggcagacgguguagugggucuggaugauuuccgaaaaagucaggagcugcgcguguggccuggauaugauuaugucggauggagcaaucacucauucagcagcggauacguggagauggaauuugaauuugacaggcuccgggcauuccaagcuaugcaagugcauugcaacaacaugcauacacugggcgcuaggcuaccagggggggucgaaugcagauuuagaagaggucccgcaauggcaugggaaggagaacccaugcgucauaacuuggggggcaaucugggcgauccacgcgcuagagccguuuccgugccgcugggcggacgcguugccagauuucuccaaugccgguuuuuguucgcgggcccauggcuacuguucagcgaaauuaguuucaucucagauguggucaauaacucuagcccagcccugggagguacauuucccccugccccuugguggccaccaggaccgccaccaaccaauuuuagcucuuuggaauuggagccccgcggccagcagccuguugcaaaagcggaaggauccccuaccgccauacugaucggcugccugguagccaucauccuccugcugcugcugauaauagcacuuaugcucuggcgauugcauuggcgcagauugcuaucuaaagcugaaaggcgaguacuagaagaggagcugaccgugcaccuguccgugcccggagacacaauccugaucaauaauagaccuggcccaagagaaccuccccccuaccaagagccucgcccuagagguaauccgccccacucugcacccuguguuccgaaugguuccgccuauagcggggauuauauggaaccugagaagccaggagccccucuccugccccccccaccucagaacuccguuccccauuaugcugaagcugauaucgugacccuucagggggugacuggcgggaauacuuaugccguaccagcucugcccccaggcgccguuggagauggaccuccaagaguggauuucccgaggucuagauugagauuuaaagagaaacucggagagggacaguuuggcgaagugcaucugugugaaguugacaguccccaggacuuggucucucucgacuucccucuuaacguacggaaaggucauccacugcuuguagccguuaagauucugcguccagacgccacaaaaaaugccaggaaugacuuccuaaaggagguaaaaaucaugucuaggcugaaggacccaaacaucaucagacugcugggagugugugugcaagacgacccucugugcaugauuaccgauuacauggaaaacggcgaccugaaucaauuucugucagcacaccaacucgaagauaaagccgccgaaggugcuccaggcgacggccaggccgcucagggccccacuauuucuuacccuaugcuuuuacauguggcagcccaaaucgcaagcggcaugcgcuacuuggcaacccucaacuuuguacaccgagauuuagcuacucgcaacugucuggucggggaaaauuuuaccaucaaaauugcagauuuuggaauguccagaaaccucuaugcuggcgacuacuaccgaguccagggccgcgcaguuuuacccauccgguggauggccugggaauguauacugaugggcaaauuuacgaccgcaucugaugucugggccuucgguguaacuuugugggagguccugaugcugugucgcgcccagccuuuuggccaauugaccgaugaacaggugauagagaaugccggcgaauuuuuuagagaucagggaaggcagguauacuugucucggcccccagccuguccccagggcuuguacgaguuaaugcuucgauguuggagucgcgaaagugaacagagaccgcccuuuucacaguugcaucgguuucuugcugaggaugcccuuaauaccgucuag

SEQ ID NO: 14381 - RNA, 2742 nt, Artificial Sequence
  Description of Artificial Sequence: Synthetic coding sequence
auggggcccgaggcacucucaucucucuuacuucuccuacuugucgcgaguggcgaugcugauaugaaggggcauuuugacccggccaagugcagguaugcucucggaaugcaggacagaaccauaccagacagcgauauuuccgcuucaucuuccuggucagacaguaccgcugcgaggcauuccagacuggaauccucagauggcgauggggcauggugcccagcuggauccguuuucccaaaagaagaagaauaccuccagguugaucuacaacgauugcacuugguugcgcucguggguacucaggggcgccaugccgggggauugggcaaggaauucagcagaaguuauagauuaagauacucccgugacggucguagguggaugggguggaaggauagauggggacaggaagugauaagugguaacgaagacccagaaggugugguuuugaaagacuuagguccgccgaugguggccaggcuaguacgcuucuacccacgggccgacaggguuaugagcgugugccuccguguggaacuuuacgggugcuuguggagggauggccuguugucuuauacugcacccgugggccagacgauguaucuuagcgaagccguuuaucuuaacgauaguacuuaugacggacauacuguggggggacugcaguacgggggcuugggccaacuggcagacggcguugugggccuugaugacuuuaggaaaagucaggagcuuagaguuuggccugguuacgauuacgugggguggucuaaucauagcuucucuucagguuacguggaaauggaguucgaauuugaccggcugagagcuuuucaggcuaugcaaguucauuguaacaacaugcauacgcugggagccagacugccaggcggagucgaaugucgcuucaggagagggcccgccauggccugggagggugagccuaugagacauaaccugggaggcaaucucggugauccccgagcccgcgcagugucaguuccccuuggcggacggguagcacgguuccuccagugucgcuuccuuuuugccggccccuggcugcuauucucagaaauuucguucauauccgacgucguuaacaauaguucuccugcauugggggguacauucccaccagcuccaugguggccaccugguccaccaccgaccaauuuuucuagucuggagcucgaaccaagaggucagcagccugucgcaaaagcagagggaucuccaaccgccauucuuauuggaugcuuaguggccauaauccucuuguuauuacucaucauugcucugaugcuguggcgcuugcacuggcguagacuguuguccaaagcagagaggcgcguguuagaagaagagcugacaguccaucucucagugccaggggacacaauucugauuaacaauagacccgguccucgggagccaccacccuaccaagagccaagaccccgcgggaauccuccccacucugccccuugugugcccaaugggucugcacugcucuuaucuaauccggcguaccgucugcugcucgccacauacgcucgucccccucgaggacccgguccuccgacuccugcuugggcuaaacccaccaauacucaagccuacucuggagacuacauggaaccugaaaagccuggagcucccuuguugccgccccccccccaaaauucagugccacacuaugcagaagcagauauagucacgcugcagggcgucaccggcgggaauacuuaugcugugccagcgcucccucccggagcggugggagacggcccgcccagaguagacuuccccagaucaaggcugagguuuaaagagaaacuuggcgaggggcaguuuggugagguucaucuuugugagguagacucaccccaggacuugguaucucuggauuuuccgcucaacgucagaaaagggcauccacuacuggucgccgugaaaaucuuaagaccugaugcuaccaaaaacgcucgaaacgacuuucugaaagaagugaagaucaugucacggcuaaaagacccaaacauaauccgccuguuaggugucuguguacaggaugauccacugugcaugauuacagacuauauggaaaauggagauuugaaucaguuucugucagcucaucaacucgaggauaaggcugcugaaggcgcuccgggugacggacaggcugcccaaggccccacuauuucauacccaaugcuucugcauguggcugcccaaauugccucugggaugcgauaucuggcaacucugaacuucgugcacagggauuuggcuacacgcaacugccugguaggagaaaauuuuaccaucaagauugccgauuuugggaugagucgcaaucuguacgccggcgauuacuacagaguacagggucgagcuguuuugccuaucagauggauggcgugggaguguauucugauggggaaauucacaaccgcgucagacgucugggcuuucggggucacauugugggaaguucuuaugcuaugcagggcucaacccuuugggcagcuaacggacgagcaagugauugagaaugcaggggaauuuuuucgagaucaagggcgucagguguaccucucuagaccuccagcuuguccucagggccuguacgaguuaaugcugagauguuggagucgggaauccgaacaacggccgccuuucagucaauugcauagauuucuggccgaggacgcacugaauaccguuuag

SEQ ID NO: 14382 - RNA, 444 nt, Artificial Sequence
  Description of Artificial Sequence: Synthetic coding sequence
auggguccagaagcacugucaagucuucucuuacuucuccugguggccagcggcgaugccgauaugaagggacauuucgauccagccaaauguagauaugcucucgggaugcaggacaggacgaucccagacucugauaucagcgcaagcaguagcuggucagacucuaccgcugccagacauagucgccucgaaaguucagauggggacggggcuuggugccccgccggaagcguguuccccaaagaagaagaauaucugcaaguagaccuccagcgacuccaccucguagcccucgugggaacacagggaagacacgcuggcggccugggaaaggaguuuagcagaagcuauaggcuaagguauaguagagauggaaggagauggaugggcuggaaggaccgguggggacaggaagucauaaguggcaaugaggaucccuag

SEQ ID NO: 14383 - RNA, 2631 nt, Artificial Sequence
  Description of Artificial Sequence: Synthetic coding sequence
auggggccugaggcccugaguucucugcugcugcuucucuugguugcaucaggagaugcugauaugaaaggccauuucgacccugcuaaauguagauaugcccucggaaugcaagaccguacgauucccgauucugauauuucugcuucuagcucaugguccgacaguacagcggcgcgacacucccgacuugagucuuccgauggcgacggcgcguggugcccugcagggucgguguuuccuaaggaagaagaguaccugcagguugaccuccaaagacuccaucugguggcgcuggucggcacccaaggcagacacgcugggggucugggaaaggaauuuucccgaagcuauagacugagauacagcagagacgggagacgcuggaugggguggaaagacagauggggucaggaggugauuagcgguaacgaggauccugagggugucgugcucaaagaucucggcccaccaaugguggcaagacucguucgguucuauccaagagccgaucgcguaaugagcguguguuugcgaguggagcucuacggaugucucuggagggaugguuugcugaguuacacugcucccguuggacaaacuauguacuuguccgaggcaguguaucucaacgauaguacuuacgacggucacacgguaggaggucugcaguacggaggauugggacaguuggccgauggcguggugggucuggaugauuuuagaaaaucucaagaacugcggguuuggccuggguacgauuaugugggcugguccaaccauagcuucucuaguggguacguggaaauggaguuugaguuugacagacucagagcauuucaggcuaugcagguacauuguaauaauaugcauacacuaggggcccgguuaccuggaggcguggaaugcagauucaggcggggacccgcaauggccugggaaggagagcccaugaggcauaaucugggaggaaaucugggugauccacgcgcuagggccgugucaguccccuugggaggccgcguggccagauuccugcaguguagauuccuauucgccggcccuuggcuucuuuucagugaaauuucuuucaucuccgaugucgucaauaacucaaguccugcucucggaggcaccuuuccccccgccccuugguggccgccagggccccccccuacuaacuucucuucucuggaacuggaaccacggggacaacagccaguugcuaaagccgaaggaucacccaccgcuauucuuauugguugccuugucgcaauuauucuacuucuccuccuaauuaucgcacugaugcuuuggcggcugcacuggcgucggcugcugagcaaggcugagcgacgugugcuagaagaggaacugacugugcaucugucagugccaggagacacaauuuugaucaauaauagacccgggccaagagaaccuccacccuaucaggaaccaagacccagggguaaucccccucacagcgcgccuuguguuccuaacgggucagcauacuccggagacuacauggaaccugagaagccaggagcccccuugcugccuccuccuccccaaaacucagugccucauuaugccgaagccgauauuguaacccugcagggcgucaccgguggaaacacauacgccguccccgcucuaccaccgggcgccguaggcgauggacccccgagagucgauuucccucguucacgacugcguuucaaagagaagcugggagagggccaguuuggcgaaguacauuugugcgaaguggauuccccccaggaccugguuagccucgauuuuccacuaaaugugcggaaggggcacccacugcuggucgcugugaagauucucagaccagaugcuacaaaaaaugcccggaacgauuuucugaaagaggucaagauaaugagccgccugaaagacccaaacauaauuaggcuucuuggcgugugcguucaggacgacccccuguguaugaucacagacuacauggaaaacggagaccugaaccaguuucuaucagcucaccagcuagaggacaaggcagcugaaggagcaccuggcgauggacaggcagcccagggcccuaccauuagcuacccuaugcuucugcauguagcagcucagauagcaagugguaugagauacuuagcaacguugaacuucgugcaccgagaccuggcuacaagaaacugucuggugggagagaauuucaccauuaagauagcugacuucggaaugucaaggaaucuguacgcaggagacuacuaccgagugcagggcagggcuguacugccaauuagauggauggcuugggagugcauucuuaugggcaaguuuaccacagcaagcgaugugugggcuuucggcgugacucugugggaggugcucaugcuuugcagagcucaaccauucggucagcugacggaugagcaaguuaucgaaaacgcuggcgaguucuucagggaucagggccgccaagucuaccucucccggccaccugccuguccacagggacuauacgagcugaugcuccguuguuggucucgagaauccgaacagcgcccacccuucucucaacuucaucgcuuucuggcugaagaugccuuaaauaccguguag

SEQ ID NO: 14384 - RNA, 2631 nt, Artificial Sequence
  Description of Artificial Sequence: Synthetic coding sequence
augggcccugaggcucugagcagcuugcugcugcugcuucugguugcuucuggagacgccgauaugaaagggcauuucgacccugccaaaugccguuaugcacuagguaugcaagacagaaccauuccagacuccgacauuagcgcaaguucuagcuggucugacagcacugcugcccggcacagccgccucgaauccagcgauggggauggggccuggugucccgcuggaucaguuuuccccaaagaagaagaauaccugcaaguugaccuacagcgccuccaucucguggcacuggucggcacacaagguaggcaugccggcggacugggcaaggaauucagccggucuuaucgacuuagguacuccagagaugggagaagauggauggguuggaaagacagauggggacaggagguuauuucugggaacgaagaucccgagggugugguauugaaggaccuggggccuccaaugguugcuaggcugguucguuucuacccgagggcggauagggugaugagugugugcuuaagggucgaacuguacggaugccuuuggcgcgauggucuccugagcuauaccgcuccagugggacagacaauguaccuaagcgaggcuguuuaccugaaugauagcacuuacgauggccauacagugggaggacuccaguauggcggacuaggccaacucgcugacggugucguaggacuugaugauuuucggaaaucucaggagcugcguguuuggccaggcuaugacuaugugggauggaguaaucacaguuuuucuagcggcuaugucgagauggaguucgaauucgacagacuuagggcuuuucaggcuaugcaggugcacuguaauaauaugcacacacugggcgcaagauugccagggggagucgaaugccgguuccgaaggggcccagccauggcuugggaaggugagccaaugagacauaaucuuggcggcaaucugggagacccgagggccagagcagugagcguuccacuuggaggaagagucgccagguuucuucagugccgauuucuguuugcaggcccauggcuccuuuuuagugagaucuccuucauauccgacgucgugaauaauucgucccccgcccucggagggaccuuuccaccugccccaugguggccaccaggcccuccaccaacaaauuucagcaguuuagaacuugaaccucgaggacagcagcccguugcaaaagcugaggguucccccaccgcuauacugaucgguugucucguugcaauaauccuucugcuacuacucaucauugcccugaugcucuggcgacuucacuggcggcggcuguugaguaaagcugagagacgagugcuugaggaagaacugaccgugcaccuguccguucccggcgauaccauacuuauuaacaaccggccugggccucgcgagcccccacccuaccaggaaccuagacccaggggaaauccuccacacucugcacccugcguacccaacggaucugccuauucuggagacuauauggaaccagagaaacccggugccccguugcuucccccuccuccgcagaauagcgugccccacuaugcugaagccgauauagugacucugcaaggcgucaccggcgguaacacguacgccgugccagcucucccucccggugcagugggggauggacccccuaggguugacuuuccucguagcaggcugcgguuuaaggagaaacuaggugagggccaauuuggagaagugcacuuaugugaagucgacuccccucaggaccucguuucccucgauuucccguugaaugugaggaaaggccauccucugcucguugccgucaagauuuuacgcccagacgccaccaaaaaugcucguaaugacuuccugaaagaggugaaaauuaugucccggcucaaagaccccaacaucauccgacuguuggggguuuguguacaagacgacccacucuguaugaucacugauuacauggagaauggcgaccuuaaccaguuuuuaucagcgcaccaacuugaagauaaagccgccgaaggggcaccaggggacggucaggcugcccaaggccccacuauaucguauccuaugcugcuccacgucgccgcacagaucgcgucaggaaugagguaccuugccacccucaacuuuguacauagagacuuggcaacgcggaauugccuggugggggagaacuuuacaauuaaaaucgccgauuucggaaugagcagaaaccuguaugcuggagacuauuaccggguucaggggagagccgugcugcccauuagguggauggcuugggaguguaucuuaauggggaaauuuaccacagcaagcgacgucugggcuuucggagugacccugugggagguuuuaaugcugugucgggcccagccuuuuggccagcugaccgacgaacagguuauugagaaugcgggagaguuuuuccgggaucaaggucgccaaguguaucugagucgcccccccgcuugcccacagggacuuuaugagcuuaugcugagauguuggaguagagaaagcgagcagagaccaccuuuuagucagcuccacagguucuuagcagaagacgcauugaauacaguuuag

SEQ ID NO: 14385 - RNA, 2631 nt, Artificial Sequence
  Description of Artificial Sequence: Synthetic coding sequence
augggucccgaggcucuuagcagucuacugcugcugcugcucguagcaucaggugaugccgacaugaaagggcauuuugaucccgccaaaugccguuacgcacugggcaugcaggaccgcacuauucccgacagugauauuagcgcuucaagcucauggucagauagcacagccgcccggcauucaagacuggagucaucugauggagacggggccuggugccccgccgguucagucuuuccuaaggaggaagaauauuugcagguagaucuccagcgccuccacuuggucgcuuuaguagggacacagggaagacaugcaggaggccuuggcaaggaguucucccguuccuaucgcuuaagauacagucgagauggucgcagauggaugggauggaaggaucgcuggggucaagaaguaauuucuggcaacgaggacccagaaggaguuguguugaaagaccugggcccccccaugguugcuagacuggugcgguuuuauccgagggcugaucgcgugaugucaguuugccugcgcguggaacucuaugguugccuuuggcgcgacggacuccugaguuacaccgcuccugugggucagacaauguaucucagcgaagcuguauacuuaaaugauaguacuuacgacggccacacagucggcggcuugcaguauggcggcuugggacagcuggcggacggaguaguaggucuggaugauuuucggaaaucacaagagcuccgcguguggcccggcuacgauuauguaggcuggucuaaucauuccuucagcucugguuacguugagauggaauuugaguuugaucgacuccgcgcguuucaggcuaugcagguccauugcaacaauaugcacacacugggugcucgucuuccuggagguguagaauguagguuuaggcggggccccgcaauggccugggagggugagccuaugaggcacaaucucgggggaaauuugggagaucccagagcaagggcaguauccgugccucuaggagggcgggucgcccgguuucuacaaugucgauuccucuucgcaggccccuggcuccuguuuucugaaauuuccuuuauuagugaugucguuaacaauucuuccccagcucuuggagggacuuucccccccgcccccugguggccaccaggcccaccacccaccaauuucucuagccuugaguuagagcccagagggcagcagcccguggcuaaagcagaagggaguccuaccgcaauuuuaaucggguguuuagucgcuaucaucuugcugcuguuacucaucaucgcauuaauguuauggagacuccauuggagaagguuacugucuaaagccgagagacggguccucgaggaagagcucaccguucacuuaucaguuccaggagacacaauucuuaucaacaaccggccaggcccaagggagccaccaccuuaucaggagccaagaccacgggguaauccuccucauuccgcgcccugcgugccuaaugggagcgcuuauaguggcgacuacauggaaccugaaaagccaggagcaccacugcugccuccacccccccaaaacucugugccacauuacgccgaggccgacaucgugacacugcagggagugacaggugggaauaccuacgcgguuccagcucuacccccaggcgcaguuggcgauggaccaccgcgaguagacuucccucgaucccgccucagauucaaagaaaaguugggagaaggccaauucggagagguucacuuaugcgagguugacuccccacaggaccucgucucgcucgacuuuccauuaaaugugcguaaaggacaucccuugcuugucgccguuaaaauucugcgccccgacgcuaccaaaaacgcccggaacgacuuuuuaaaagaggugaaaauuaugagccgguugaaggaccccaauaucauacgccuacugggcguauguguccaagacgauccucuguguaugauuaccgacuacauggagaauggcgaccugaaccaguuucucagcgcucaccaguuagaagauaaggcggccgaaggagccccaggagauggacaggcugcccagggcccaacuauaaguuauccgaugcuccuucacguagcagcccaaauugcgagcgggaugcgcuauuuagcgacgcugaacuuuguacauagggauuuggcgacucgaaacugccuaguuggggagaauuuuacaauuaagauugcugacuucggaaugagcagaaaucucuaugcuggagacuauuacagggugcagggcagagcaguuuugccuauuagauggauggcaugggaauguauuuuaaugggcaaguuuacaaccgcuagugauguaugggcauuuggcgucacuuugugggaggugcugauguugugccgagcccagccuuuuggucagcuaacagaugagcagguaauugagaaugcaggagaguuuuuuagagaucaaggacgccaggucuauuuauccaggccacccgccugcccucaaggucuguacgaacugauguugagauguuggucacgggaauccgagcagcguccuccuuucucacagcuacaccgcuuucuugccgaggaugcacuaaauacuguguag

SEQ ID NO: 14386 - RNA, 2742 nt, Artificial Sequence
  Description of Artificial Sequence: Synthetic coding sequence
augggcccugaagcauuaucuagccugcugcuucuccuucucguugccaguggcgaugccgauaugaagggccacuuugauccagcgaaaugucgauacgcucugggcaugcaggacagaacuauuccugauagugauauaagugcaucaucgucguggagcgacucuacagcugcccggcauagucgccucgaaagcucggacggggauggcgcuuggugccccgcuggcucugucuuccccaaagaagaggaguaucugcaaguagaccuccaaagacugcaccuuguggcauuggugggaacacaaggccgacaugcaggagguuuggguaaggaauucucaaggucuuacaggcugagauauagcagagacgguaggcguuggaugggguggaaggaucggugggggcaggaaguuaucuccgguaacgaggacccggagggggugguguugaaagauuugggcccaccgaugguugcacgauuggugagguuuuacccuagagcagaucgagucaugagugucugcuugcgcguagaacuguacggaugccuguggagggacggccugcucaguuacaccgcgcccguagggcagacuauguaccugucugaagccguauaucugaacgauucaaccuaugauggccacacgguuggaggacuccaguaugggggccugggacaacucgcagacgggguuguuggccuugaugacuuuaggaagagccaggaauuaagggucuggccuggcuaugacuaugugggauggucuaaccauucauucagcuccggcuauguagagauggaauucgaauuugacagacugagagccuuucaggccaugcaaguccacugcaauaacaugcauacgcuuggugcacgucuuccaggcgguguggaauguagauuuagaaggggcccagccauggccugggagggagaacccaugcgacacaaucuuggcggcaacuuaggcgauccacgggcaagagccguuucagugcccuuggguggacggguggcuagauucuugcagugcagauucuuauucgcaggaccuugguugcuauucucagaaauuagcuuuauaagugaugucgucaauaauucaagcccagcucuuggagggacauuccccccugcaccuugguggccaccagggccuccgccuacuaacuucaguucacucgaauuggaaccaagaggacagcagccugucgcaaaggcugaaggcucccccaccgccauccugaucggcugccuggucgccaucaucuuacuccuucuccucauuauugcccucaugcuguggagacuccauuggagaaggcugcugagcaaagcugaaagaagaguacuggaagaggaacucaccguacacuuaucagucccaggggauacgauccucaucaauaaccgccccgggccucgggaacccccaccuuaucaagagcccaggccgcgaggaaaccccccccauucugcacccugcguucccaauggcucagccuugcucuugucuaaccccgccuaucgcuuacuccuggccacuuacgcacggcccccacgaggacccgguccuccaacucccgccugggccaaaccuacuaacacucaagcauauagcggugauuauauggaaccggagaaaccuggcgccccccucuugccgccaccuccacaaaacucagugccccacuacgccgaagccgacaucgucacucuccaaggcgucacaggugguaacacauaugcugugcccgcauuaccgccuggugcugucggggacggaccgccucgaguggacuuucccaggagcagacuacgauucaaagaaaagcuaggugaagggcaguuuggagaaguucaucugugcgaaguggacagcccacaagaccuggucucacuugauuucccacugaacgugcgcaagggccacccauuacuuguggccgugaagauccugaggccugaugcuacaaagaaugcgcgaaaugacuuccucaaagaggugaagauuaugucuagacucaaagacccaaauauaauccgucuucugggcgugugcguucaagacgacccacucugcaugauaaccgauuauauggaaaacggcgaucugaaucaguucuuaucagcccaccaacuggaggauaaagcugcagaaggugcacccggugauggccaggcugcccaggguccaacaauuuccuauccgaugcuacuccauguggccgcgcaaauagcuucaggaaugagguauuuggcaacacugaacuucguccaccgagaucucgcaacccggaauugucucguaggagagaauuuuacaaucaagaucgcugacuucggaaugaguaggaaucuauaugccggggacuacuaucguguucagggacgcgcggugcugccaauaagguggauggcuugggaguguauacucauggggaaauuuacaaccgcuuccgauguuugggcauuuggaguuacauuaugggaaguauugaugcucugccgcgcacagccauucggucaacugacagacgaacaggugauugagaaugccggcgaauuuuucagagaccaaggcagacagguuuaucugagccgcccgcccgccugcccccagggguuguaugaacugaugcugagauguuggucucgagagucugagcaaagaccucccuucucccaacuccaccgauuucuggccgaagacgcacucaauacaguauag

SEQ ID NO: 14387 - RNA, 2742 nt, Artificial Sequence
  Description of Artificial Sequence: Synthetic coding sequence
auggggcccgaggcacuaucuucacucuugcuguuacugcucgucgccaguggcgacgcggauaugaagggccauuucgacccagccaaaugcagauaugcccuuggcaugcaagaccgcacuaucccugacucggacaucucugcaaguuccucauggucugacuccacagcagcucgccacucaagacuugaaucuagcgacggcgacggugccuggugcccagcuggcaguguauuccccaaggaagaagaguaucuccagguggacuuacagagacuccaucuaguggcgcuuguugguacucagggacgacacgcggguggucucgguaaggaguuuucaagaagcuacagacugagguacaguagggacggaaggcguuggaugggauggaaggaccguugggggcaggaagucauuucaggcaacgaggauccggaaggcgugguucuuaaggauuuaggacccccuaugguggcucguuuggugagguuuuauccgagagcggacagagugaugagugugugucuuagagucgaguuauauggcugucuguggagagauggauuacuuuccuauacugcccccguggggcagaccauguaucucucugaagcugucuaucucaacgauucuacuuaugacggccacacggugggaggccugcaauauggagguuuaggucaauuagcagauggggugguaggauuggaugacuuucgaaagucccaggaacugaggguuuggccgggauaugacuaugucggguggaguaaccacuccuuuucaagcggauacguggaaauggaauuugaguuugaccggcugcgcgcauuccaggcaaugcagguacacugcaauaacaugcauacacugggagcaaggcugcccggcggcguugaaugucgguuucgacgcggaccagcaauggccugggaaggugagcccaugcggcauaaucucggcggcaaccugggcgacccacgggcacgcgcaguuucagugccacugggggguagggucgcacgguuucuucagugucgauuccucuuugccggaccuuggcugcucuucucugaaaucuccuuuaucucagaugucgucaacaacucgucaccugcucuuggcggaacauucccaccugcaccuugguggccucccggaccaccuccuacuaauuuuucaaguuuggaguuagaaccccgcggccagcaaccuguggcaaaagcugagggcagcccaacugcaauauugaucggcugccuggucgccauuauacugcuacugcuucucaucauugcuuugaugcuguggagacuccauuggagacgauuacugagcaaggcggaacgaagagugcucgaagaggaacuuacuguucauuuaucugugcccggcgauacuauacugauuaacaacaggcccggcccucgggaaccaccucccuaccaagaaccuaggccucgaggcaauccuccccacagcgcccccugcgucccaaauggcuccgcuuuacuuuuguccaaccccgcguaucggcuccuccuggcaacguacgcucggcccccccggggaccaggcccccccacaccugccugggcaaaaccgaccaacacccaggccuauucuggugacuauauggagccugagaaacccggagccccucuacugccgccacccccccaaaauucugugccucauuacgccgaagcggauauugucacacugcagggaguuaccggaggcaauacauacgcuguacccgcacuucccccuggugccgucggagaugggccaccacgagucgacuuuccccgguccagguugcgguucaaagagaaauuaggugaggggcaguucggcgagguacaccuuugcgaagucgauaguccacaggaccuagucucacuugauuucccccugaaugucaggaaaggacauccauugcugguugccgucaagauccugcgccccgacgcuacuaaaaaugccaggaacgacuuucugaaggaagugaagauaaugagcagauugaaggaccccaauauuaucagacuucucgggguaugugugcaggaugauccauuaugcaugaucacugauuacauggagaacggagaccugaaucaguucuuaagcgcacaccaacuagaagauaaagccgcugagggagccccgggagacggucaggccgcacagggacccaccauaaguuaccccauguugcugcauguagcugcccagauugccuccggcaugcgcuaucucgccacgcucaacuuugugcaccgugaccuugcaacgcguaacugccuugugggcgaaaauuucacgaucaaaaucgcugacuuuggcaugucaaggaaucucuacgccggggacuacuaucggguccaaggcagggcuguguugccgauaagauggauggcaugggagugcauucuuauggggaaguucacaacugcaagcgacgugugggcauuuggcgugacguugugggaggugcucaugcugugucgugcccaaccauuuggacaacuuacagacgaacaagucaucgagaaugccggcgaguuuuuucgggaucagggcagacagguuuaucuauccagaccaccagcuuguccccagggucucuacgagcuaaugcugagauguugguccagagaauccgaacagcgcccucccuuuagucaguugcaccgauuucucgccgaagaugcccugaauacugucuag

SEQ ID NO: 14388 - RNA, 309 nt, Artificial Sequence
  Description of Artificial Sequence: Synthetic coding sequence
augucgguaaugaaaccgugucucaugaccauagcaauucuuaugauccuagcacagaagaccccgggcggccuuuuuagaagucauaacgggaaaucuagagaaccguggaacccuugugaacuguaccaggggaugugucgcaaugcaugccgcgaguaugagauucaguacuugaccuguccuaaugaucagaaguguugucuaaaacuuagcgucaaaaucacauccaguaagaaugucaaagaagacuaugacucaaauaguaaccuuagcgugaccaacuccucuaguuacagccacauuuag

SEQ ID NO: 14389 - RNA, 267 nt, Artificial Sequence; identical to SEQ ID NO: 12750
  Description of Artificial Sequence: Synthetic coding sequence

SEQ ID NO: 14390 - RNA, 1401 nt, Artificial Sequence
  Description of Artificial Sequence: Synthetic coding sequence
augaagccuccacugcuaguauucauugucugccugcuguggcugaaagacucccacugcgccccaacguggaaagauaaaacagcaaucucugaaaauuugaaaagcuucucagaggugggcgagauugacgcugacgaggaggugaagaaggcacucacaggcauuaaacaaaugaaaauaaugauggaaagaaaagaaaaggagcauaccaaccugauguccacccuuaaaaaaugcagagaagaaaaacaagaagcgcuuaaguuacuuaacgaaguacaggaacaucuugaggaagaagaacggcuuugccgcgagucguuggccgauuccuggggagaaugccgguccugcuuggagaauaauuguaugaggaucuacacgaccugccagccaucaugguccuccguuaaaaauaaaauagaaagguuuuuccggaagauuuaccaguuucuguucccuuuccaugaagauaaugaaaaggaucuacccauuuccgaaaaauugauugaagaagacgcccagcuuacacagauggaagacguauuuagccagcuuacaguagacgucaauagucuguucaaccguucauucaauguauuuagacaaaugcaacaagaguuugaucagacuuuccaaucacacuucaucuccgacacagaucuuacugaaccuuauuucuuucccgccuucucuaaggagccuaugacaaaagcagaucucgagcagugcugggauauuccaaacuucuuucaguuguucugcaacuuuucagugucuauuuaugagucaguauccgaaaccauaacaaaaaugcugaaagccauugaggaucugcccaagcaggacaaagcccccgaccaugguggcuugauuagcaaaaugcugccaggccaggacaggggucugugcggcgaacuggaccaaaacuugagccgguguuucaaauuccaugaaaagugucaaaagugccaggcccaccuaucggaggauugcccagacgugccugcucugcauacggaacuggaugaagcuauuagacuugugaacgucagcaaccaacaauacggacagauacugcagaugaccagaaagcauuuagaggacaccgccuaccucguugaaaagaugcguggccaguucgguuggguaagugaacucgccaaccaggcacccgagacugagaucauuuucaacucaauucagguaguuccuaggauccacgaagguaacauaagcaaacaggaugaaacuaugaugacugaucuaucaauacuaccuucauccaacuuuacacuuaaaaucccucucgaggaaagcgccgagucuucgaacuucaucggcuacguagucgccaaagcccuucagcauuuuaaagaacacuucaaaacuugguag

SEQ ID NO: 14391 - RNA, 207 nt, Artificial Sequence; identical to SEQ ID NO: 12752
  Description of Artificial Sequence: Synthetic coding sequence

SEQ ID NO: 14392 - RNA, 420 nt, Artificial Sequence
  Description of Artificial Sequence: Synthetic coding sequence
auguauaaacuggccuccugcugccuucuguuuauuggguuccuaaacccacugcugucccucccucuguuagacucgcgcgagauaucguuccagcuuagcgcuccccacgaagaugccagauuaacuccugaagaacucgagcgugcgucucucuugcagaucuuaccugaaaugcucggcgcagaacgcggcgacauccuccgaaaagcagauagcucuaccaacaucuuuaauccacgcgggaaucuccguaaguuucaagacuuuaguggucaggacccuaauauacugcuaucacauuugcuugcuagaauuuggaagccuuacaaaaaacaaaggaggaagcuacgccaggaucuaagacuauggaaaaaggagccaggucuccguauauucaagaacuacgucuacauuuag

SEQ ID NO: 14393 - RNA, 1974 nt, Artificial Sequence
  Description of Artificial Sequence: Synthetic coding sequence
augcgcacaguuguacugaccaugaaagcgucugugauugaaauguucuuaguacuucuggugacugguguucacucaaacaaggagacagcaaagaaaaucaaaagacccaaauucacuguuccacagaucaacugugacgucaaagccgguaagauuaucgauccugaguuuaucguuaaaugcccagcaggcugucaagaucccaaguaucacgucuacggaacugacguguaugccuccuauuccagugucuguggggccgccgugcauucaggggugcucgacaauucuggggguaagauccugguacguaagguggcugggcagagcggguacaaagggucuuauucuaacggcguccagagcuuaagucugcccagguggcgagaaagcuucauuguacuggaaagcaaaccaaaaaagggcguuacuuauccauccgcacuuacauauucuuccagcaaauccccggcagcacaggcgggcgagacaacaaaggccuaccagcggccucccauaccuggcacuacugcacaaccuguuacucuuaugcagcugcuugccgugaccguggccgucgcaacaccaacaacacucccaaggcccagcccaagcgccgccucaacgacauccauaccacgcccccaguccguaggucaccguagccaagagauggaucuuuggagcacggccaccuacacuuccucacagaaccggccucgagccgaccccgguauucaacgccaggaccccagcggagcagccuuccagaagccaguuggcgccgauguuagccuugacugcaagauagaucuuuccuucuuaauugaugguucuaccucuauuggcaagagacgcuuuaggauucaaaaacaauuacucgcagacguugcccaagcucuggauauagggccagcagguccacucaugggcgugguacaguacggcgauaaccccgccacacauuuuaaucuaaagacucacacaaauucucgugacuugaagacggcgauugaaaagaucacucagaggggcggcuugucgaacgugggcagggccaucucuuuuguuacaaaaaauuucuucucuaaagccaacggaaacagaaguggugcacccaacguaguugugguuaugguagacgguuggccaacugauaagguggaagaggcaucuaggcuugcuagagaaucgggaauuaauauuuuuuucaucacuauagagggcgccgcagaaaaugaaaaacaguacguggucgagcccaauuuugcgaauaaggcaguuugcagaaccaacgguuucuauucccugcacgugcagagcugguuuggacuccacaagacccugcagccacuugucaaacguguuugcgacaccgaucgccuggcuugcuccaagacgugccugaauuccgcagacauuggcuuugugaucgacgguagcaguuccguuggcacagguaauuuuagaaccgugcuacaguucguuacgaaccugacuaaggaguucgagaucagcgauaccgauacaaggauuggcgccguacaauauacauacgagcaacggcuagaauucggauuugacaaguacagcucuaaacccgauauccucaaugcaaucaaacgaguggguuacuggagugggggcacuuccaccggugccgccauaaacuuugcauuagaacaacuguuuaaaaagucuaaaccaaacaaacgaaaacuuaugauacucauuaccgacggucguuccuaugaugaugugcgaauccccgcuauggcagcccaccugaagggaguuauuacguaugcuauuggggucgcuugggccgcucaagaagaacucgagguaaucgccacacacccugcucgcgaccacuccuuuuucgucgacgaguuugacaauuugcaccaguauguuccacguauuauccaaaauaucuguacagaauuuaacagccagccucgcaauuag

SEQ ID NO: 14394 - RNA, 3975 nt, Artificial Sequence
  Description of Artificial Sequence: Synthetic coding sequence
augagacauggcguugcuugggccuugcugguagccgcugcucuggggcugggcgcgagaggaguucguggggcgguugcucucgccgauuucuaucccuuuggggcggagaggggcgaugccguuacgcccaaacaggaugacggcgguucuggauugcgcccgcuguccgugccuuuuccuuucuucggcgcugaacacaguggacuguaugugaacaauaaugggauaaucaguuucuugaaagagguuucacaguuuaccccaguugcguuuccuauagccaaagaccgcugcguggucgcagccuucugggcugacguagacaaccgccgcgcaggagacgucuauuauagggaagcgaccgaucccgcaaugcucagacgcgcuacagaggacgugcgacacuacuuuccagaacuguuagauuucaaugccacuuggguguuuguugccacuugguaucgaguaaccuuuuucggcgggagcuccuccucuccgguaaauacuuuucagacuguauugauuaccgacggcaagcucagcuuuaccaucuucaacuaugaaucuaucguauggaccacaggcacacacgcaucuucaggagguaacgcuaccggacucgggggaaucgccgcccaggcuggguucaacgcuggcgauggucagcgcuauuucucgaucccuggaucacgaacagcagacauggccgaagucgaaaccacuacuaauguggguguacccgggcggugggcuuuccguaucgacgaugcccaggugagggugggcggaugcggccacacuacaagcgugugccuggcucugcgaccuugucuuaacggaggaaaaugcauugaugacugugugaccggcaauccuuccuauaccugcagcugucucucuggcuuuacugguagaagaugccaucuagacgugaaugaaugcgccagccagccaugucagaacggaggcaccugcacacaugggauuaacucuuuuaggugccaauguccagcuggauuugggggaccuaccugcgaaacagcccaaucuccuugugauacuaaggaaugccagcacgggggacagugccaaguggaaaacggauccgcuguaugugugugccaagcaggauauaccggagccgcaugugaaauggacguggacgacugcucccccgauccuugucucaauggaggcucuuguguggaccuaguaggcaacuauaccugucugugcgccgaaccguucaagggacuucgcugugagaccggcgaccaccccgugcccgacgcaugucugucagcaccuugucacaaugggggcacauguguugacgccgaucaagguuacgugugcgaguguccggaagguuucaugggccucgauugcagggagagaguuccugaugacugcgaaugccgaaauggcggaagaugucuaggcgccaacacuacccugugccaaugcccucuagguuucuuuggccuccugugcgaauucgagauuacagcgaugcccuguaacaugaauacccagugucccgauggcggcuauuguauggaacacggcggcucuuaucucugugugugccauaccgaccacaaugcuucacacucccuacccuccccuugcgauucagacccauguuucaaugguggaucuugugaugcccacgacgacuccuauaccugugagugcccccgaggcuuucacgguaagcacugcgaaaaggcacguccucaccuuugcaguucugggcccugcagaaauggaggaacguguaaagaggcaggaggcgaauaucacuguucuuguccuuauagguuuacaggcagacacugcgaaauuggaaaaccugacucaugugcaagugguccaugccauaacggcggcaccuguuuccacuacaucggaaaguauaagugugacugcccuccgggguuuagcggacgccauugcgaaauugcuccaaguccuugcuuccgaagcccaugcguuaacggaggaacuugcgaggauagagauaccgauuuuuuuugccacugucaagcaggguacaugggcagacggugucaggccgaaguggauugugguccacccgaagaggugaaacaugccacucugcgcuuuaacggaacccggcucggagcaguggcccucuaugcaugugauagagguuacaguuugagcgcaccuucgcgaauccgagugugucagccccacggagucuggucagaaccuccacagugccuggaaaucgacgaaugcagaagucagccuugucugcacggggguagcugucaggacagaguggcaggauaccucugccucugcucaaccgguuaugaaggagcccacugcgagcucgaaagagacgaaugucgcgcacauccaugcaggaacggcgguuccugccguaaucucccaggggccuacguuugucggugucccgcuggauuuguaggagugcacugugaaaccgaaguagaugcgugugacagcucaccaugccaacauggcggccgcugugaauccgguggcggugcuuaucuguguguuugucccgaaucauuuuuuggguaccauugcgaaacagucucggaccccuguuucaguagcccuuguggcggccgcggauacugcuuagcuuccaaugggucucacucaugcacauguaaggucggguacacgggcgaggacugcgcuaaagagcuuuucccgccaacagcacuaaaaauggagcggguugaggaaucuggcguuucuauuucuuggaauccccccaauggacccgccgccagacaaauguuagacggauacgcaguuacuuacgugucgagcgauggcucuuacaggcgaacagacuucguagaucgcacccguuccagccaccagcugcaggcgcucgcugccggacgggccuauaauaucagcguauucucuguuaagcggaauuccaacaauaaaaaugauaucucaagacccgccguccuccuugcuagaacgagaccucgaccgguugaggguuucgaagucaccaacguaacagcauccacuaucuccguccaaugggcgcuucacaggauccgccacgcaacugugucuggaguccgcguguccauccgccauccagaggcucugagagaucaagcaacugacgucgauagaucaguggacagauuuaccuuucgcgcccuacuuccaggcaagagguauacgauccaacuaacaacuuugagcggccugcggggggaggaacacccuaccgagucucuggccacugcaccuacccauguauggacaaggcccuugccacccgcuaaccuuaccgcggcacgugugacagcaaccagcgcucaugucgugugggaugcaccaacacccggcucacuauuagaggcuuauguuauaaaugugaccaccucucaguccaccaagagucgauauguccccaauggaaagcuggccaguuauacagugcgggaucuccucccuggacgucgcuaccaguuguccgugaucgccguacagucaacggaacucggaccacagcauucugagcccgcucaucuuuacauuauuacuucaccccgagacggcgccgaucgacgcuggcaucaaggaggccaccacccuagggucuugaaaaaccguccucccccagcacggcucccugagcucagacuccugaacgaucauuccgccccagaaacuccaacacaaccuccaagauucagugaacucguagauggaagggggcgaguguccgccagauucggaggaucuccaucuaaagcggccaccgugcgaagccaacccacagccagugcacagcucgaaaauauggaggaagcccccaagagagugagucucgcacugcagcugcccgaacacggaucaaaggauaucggaagugaaucagccgcacucgucggaacacuuggucugacagacuguucucaagggccuuag

SEQ ID NO: 14395 - RNA, 732 nt, Artificial Sequence
  Description of Artificial Sequence: Synthetic coding sequence
augggcaucuuccugguuuacguaggcuuuguguucuucucagugcuguacguacaacagggacuuaguagucaagcuaaauuuacagaguucccccgaaauguaaccgccaccgaaggccagaauguugaaaugucgugugcguuucagagcgggucugccagcguauaucuugagauccaauggugguuuuugagaggcccagaagacuuggauccaggcgcagaaggagcuggcgcacagguggagcugcugccagaccgggacccagauagugacgguacaaagauuucuacagucaagguucagggaaacgauauuucacacaagcuccaaaucucaaaagugcgaaaaaaagaugaaggacuguacgaaugccgcgugaccgaugccaauuauggggagcuccaggaacacaaggcccaagcauacuugaaagugaaugcuaacagucaugccagacgcaugcaggcuuucgaagccucgccaauguggcugcaggacaugaagcccaggaaaaacgucagugccgcaauaccuuccucaauccacggcucugcgaaucagcgaacacacucaacuuccucgccccaaguugucgccaagaucccuaagcagagcccucagucagggauggaaacucauuuugaaccguucauccucccccuuaccaacgcaccacagaaaggccagucauaucgcguggacagauuuaugaacggcgacuucuag

SEQ ID NO: 14396 - RNA, 1218 nt, Artificial Sequence
  Description of Artificial Sequence: Synthetic coding sequence
augugguacguuuccacacggggaguggcuccgaggguuaauuuugaaggagcucuauucucaggcuacgcccccgacggcggacuguucaugcccgaagagcucccccagcuggacagaggcacccugugccagugguccacacuguccuauccaggcuuggugaaggaacugugcgcacuguucauaggcucagaauuguuaccaaaggacgaacugaaugaucuaaucgacagagcauuuucucguuucagacaccgagaaguagugcaucucagccggcugcguaacggacuuaauguauuagaguuauggcauggggugacauacgcuuucaaggaucucucucugagcugcaccacacaguuucugcaguauuuccucgagaaaagggagaagcacgugacaguaguggugggcaccucuggcgauacagguucugcagccauugaaaguguucaaggggcuaagaacauggacauuaucguucugcucccgaaaggucauugcacuaaaauucaagaacugcaaaugacaacaguuuuaaaacagaauguacacguguucgguguggaagggaacagcgacgagcucgacgagccaaucaagacagucuuugcagauguggccuucguaaaaaagcacaaucucaugucucuaaauucuauuaacuggucaaggguuuuggugcagauggcacaccacuucuucgcguauuuucaaugcacuccaagucucgauacacacccacugccacuggucgaaguuguggucccaacaggcgcugccgggaaucuggccgcaggcuauaucgcgcagaaaaucgggcuuccuauccguuuagucguggccgucaaccgcaacgacaucauucaccgcacgguacagcagggcgacuucucacucucugaagccgugaagucuacguuggcaagcgccauggacauucagguccccuacaacauggaacgcguguucuggcugcuaaguggcucugauucccaaguaacccgcgcucugauggaacaauucgagaggacacagagcguuaaucugcccaaagagcugcacaguaagugggagagacaagauuacgagaaaauggcuguaauggaaugugacggcuguugugucgaauugugccuggguaacuguggaccaagaaggggauccgugaccgauauaccagggacugcgaugguacggggcgggggguag

SEQ ID NO: 14397 - RNA, 573 nt, Artificial Sequence
  Description of Artificial Sequence: Synthetic coding sequence
augagaacaguagugcuuacuaugaaagccagcgugauagaaauguuccuaguucuucuggugacagggguucauucuaacaaagaaacagcaaagaagauaaagcggcccaaauucaccgugccccagaucaauugcgacguuaaagccggcaagaucaucgauccugaauucaucguuaagugcccugcagggugucaagacccgaaguaucauguauacgguacagacgucuacgccagcuauuccagcguguguggugccgcagugcauucuggaguuuuagauaacagcggcggcaaaauccuagucaggaaaguggcuggucaguccggguacaagggcuccuauucaaauggaguacagucacucagccugccaagauggagagagagcuucauaguguuggagaguaaacccaagaaaggaguaaccuaccccagugccuuaacuuauuccagcuccaaaucaccagccgcacaagccgaccucuggagcacggccaccuauaccucuucccagaaccguccccgugccgauccagugcagagacaacccuguuauuccuuguag

SEQ ID NO: 14398 - RNA, 399 nt, Artificial Sequence
  Description of Artificial Sequence: Synthetic coding sequence
auggcacccucuccacgcaccggcucgaggcaagaugcaacagcacuucccucuaugaguucuacguucugggcauuuaugauucucgccucucuucuaaucgccuacuguucacagcuugcagcuggaaccugcgaaaucgucacucucgaucgggauuccucacaaccuagaaggacgaucgccagacagacugcacggugcgcuuguagaaagggccagaucgcaggaacaacaagggcccgccccgcuuguguugacgccaggaucauuaaaacaaagcaauggugugauauguugccaugucuagaaggagaaggaugugaucugcuuaucaauagaucagguuggacauguacccagcccggaggaagaaucaaaacaacaaccgugucuuag

SEQ ID NO: 14399 - RNA, 957 nt, Artificial Sequence
  Description of Artificial Sequence: Synthetic coding sequence
augcugccuuuaacaaugacagucuugauucugcuccugcucccaacaggacaagcugcgccaaaagacggcgucacuagaccagacuccgagguacaacaccagcugcucccgaacccauuccagccaggccaggagcaguugggcuuauugcagucauaucugaaaggccuuggcagaaccgaaguccaacuugagcaccucuccagagaacaaguguugcuauaccuuuucgcccuacaugauuacgaccagagcggccaguuagaugggcuugagcuguugucuaugcugaccgccgcccucgcacccggugcagccaauuccccaacaacaaaccccguuauauuaauuguggacaaagucuuagaaacucaggauuugaacggagauggucugaugacaccagccgaacugauaaacuuucccgguguagcauugaggcacguugagccgggggagccucuggcccccagcccucaagagccacaagcuguuggccgccagucacugcuggcuaagagcccacuuaggcaggaaacccaggaggcacccggaccacgggaggaagcuaagggacaagucgaagcgagacgggaaagcuuggacccugugcaagagccaggcggacaggcggaagcagauggcgacguacccgggccuagaggcgaggcggagggucaagccgaagcaaaaggcgacgcucccggaccaagaggcgaggcaggugggcaagccgaagcagagggcgaugccccuggcccucgcggagaagcaggcgggcaggcggaggcugagggagacgcaccggggccacgaggugaggcgggcggacaggccgaagccagagagaauggcgaagaggcaaaggagcugccgggggagacucuggaaucaaagaauacucagaaugauuucgaagugcauauaguucagguagagaaugacgaaauuuag

SEQ ID NO: 14400 - RNA, 399 nt, Artificial Sequence
  Description of Artificial Sequence: Synthetic coding sequence
augcugcccuugacaaugacuguacuuauucuguuguuguuacccacuggacaggccgcuccuaaggacgguguaacucgaccagacucagaggugcaacaccagcugcugccuaacccuuuccagccuggccaggagcaacugggccuuuugcaaucuuaccugaaaggucuaggacgcaccgaagugcagcuugaacacuugucucgggaacaaguuuugcuuuaucucuucgcccugcacgauuacgaucaguccggccagcucgacgggcucgaacuccucaguauguugacagcugcccuggcccccggcgccgcaaauuccccuacaacaaacccaggcaaccuugaugcuagacucgacggcggugaaaaagcaaugcagccccaaugguag

SEQ ID NO: 14401 - RNA, 732 nt, Artificial Sequence
  Description of Artificial Sequence: Synthetic coding sequence
augcuguugagccuccugggagccugugcaguuguagggcccuuccauggaccagaaugggaaccugugcagggccugcugucgcagaaucacucauguagggauccucaguguuguggaaacuuauuagugcucugccuguuucuuguguggcagguacggcacuguuggcaccaagugacacgaacccgguucucaacucgaaacguaauaaaaguaccucuucagaaacgcgcugugccaucuaugagaugugaaaccguguucaagcuuacccccgaauuuuucagcccagggaaaucacguggccuugacucacagcaaugcgcccagcggcagagauggggcuaccguagaucucuccaggaaaguugggcccagaacuugcucaguccucagcauccaugcccgggcccuccuucuggcguccauacacauuccgaacccauauuuugcacuacaucaaucuccaauacuugucuuuuaccccagaauaguuccuggaaagcuuggcaagugcccuggugccuccacgacggacagaccaggccugcccuugacaugugucaagagauggaacaacuacuuuuacauucgcaggagcgucuagugagccuugaaccugugaucucugugcggagccguccgacuuccaugacccugaccacuucccugcccaaucuccuuucugccgagcgacuccaguuuuguccucagcgugcaccggccuag

SEQ ID NO: 14402 - RNA, 2505 nt, Artificial Sequence
  Description of Artificial Sequence: Synthetic coding sequence
augaagcauacuuuagccuuacucgccccccugcuggggcugggucucggcuuggcccucucacagcucgcugccggcgcaacugacuguaaauuucucgggcccgccgagcaucuuacuuuuacucccgcugccagagccagguggcuugcaccccgcguccgcgcccccggacuccuugauagccucuacggaacuguucggagauucuuaaguguugugcaacucaaucccuuuccuuccgaacuggucaaagcacuauugaacgaauuggcuucggucaagguuaacgaggugguucgguaugaggcagguuacgugguaugugcggucauugcaggacucuacuuacuguuaguuccaaccgccggguugugcuuuuguugcugucgaugccacagacguuguggugguagagugaagaccgaacauaaggcccuugccugcgagcgugcugcacugaugguuuuccuacuucuaaccacacuccugcuccugauugggguuguuugcgcauuuguuaccaaucaaagaacccacgagcagauggguccaagcaucgaagccaugcccgagacuuuauuaucacucuggggacuggugagcgaugugccucaggaguuacaagcagucgcacaacaauuuucccucccccaagagcaggugucggaagaacucgaugggguuggcgucucuauaggaucagcgauccacacccaauugcgcagcucugucuacccccuccucgcugccgucggcucacuuggacaggugcuccaggugucuguucaccaucuacaaacccuaaaugcgaccgugguagaguuacaggcugggcaacaggacuuggaaccugcuauacgcgagcaucgagaccgucuacuugaguuguugcaggaggcccguugccagggggacugcgcaggcgccuugucuugggccagaacacuggaguugggggcugacuuuucccaagugccaagcguagaucacgugcuucaccagcuuaaggggguccccgaagccaauuuuucaagcauggugcaggaggaaaacucaacguucaaugcccuucccgccuuagccgcuaugcaaacaaguagcgucguucaggaacucaaaaaagccguggcacagcaacccgagggagugcgcacucuagccgaaggauuccccggccuggaggcagcuagucggugggcccaagccuuacaggagguagaagaguccucacggccuuacuugcaagaaguccagagguacgagacuuaucgguggauuguaggaugugugcuaugcuccguggucuuguuuguggugcugugcaaccugcugggucucaaccucgguaucuggggccugucagcuagagacgaucccucucaucccgaggcaaaaggagaagcuggggcucgcuuucuaauggccggcguaggccuuuccuuucuguuugcugccccccugauccuacugguguuugcaacauucuuagucggugguaauguucagacacuagucugucagucgugggaaaauggagaacucuuugaguuugcagauaccccagggaaucugccccccucuaugaaccuuucacaacugcugggacuaaggaaaaauauuucaauucaucaggcuuaccagcaaugcaaagaaggugccgcacuguggacugugcuucagcugaaugauuccuaugaccuggaagaacaccuggacauaaaucaauacaccaauaaguuacgucaggaacugcaaucucucaaggucgacacucagucacucgaucuccuuucuucugcagcuaggcgcgaucucgaagcccuucaaucuagcggacugcaaaggauucacuacccugacuuucuuguucagauucaacguccggucguaaagaccuccauggagcaauuggcccaagaacuacaggguuuggcucaagcacaggauaauuccguucucggacagcgccugcaggaggaagcucagggguugcggaaccuccaccaggaaaagguugucccccaacagucucuggucgcaaaacucaaccugucugugagagcacuugaaagcucggccccuaaccugcagcuagagaccuccgacguucuggcaaaugugacauaucugaaaggcgaacuccccgcaugggcugccagaauacugaggaaugucucagaaugcuuucuagcgagagagaugggcuacuucucacaguaugucgccugggugagggaagaggucacccagcguauugcuacaugucagccucuguccggugccuuagacaacucgcgugucauucuuugcgauaugauggccgacccauggaacgcauuuugguuuugcuuggcuuggugcacuuucuuucugauuccuucuauaaucuuugcggugaaaacguccaaguacuuccgccccauccguaaacgacugucaagcacuagcuccgaggaaacccaacuauuucauaucccaagaguuacgucucugaaacuuuag

SEQ ID NO: 14403 - RNA, 1185 nt, Artificial Sequence
  Description of Artificial Sequence: Synthetic coding sequence
auguggagguguccccucgggcugcugcuccuucugccacuggcaggacauuuagcgcucggugcucaacaggggagaggccggagagaguuagcaccagggcugcaccugcgggggauuagagacgccggaggccgcuauugccaggaacaggacuuauguuguagaggcagggccgacgacugugcccucccuuacuuaggcgcuauauguuacugugaucuguucuguaaccgcaccgucagugacugcuguccauucccccccauacagggauguaugcacggcggaagaauuuacccugugcucgguaccuacugggauaauugcaaccgcuguacaugccaggaaaaccgccaguggcagugugaccaagagccuugucuuguggaccccgauaugaucaaggcgauaaaccaaggaaauuauggguggcaagcaggaaaucacucagcauucuggggcaugacauuggacgaaggaauacgcuacagguuaggaacgauuaggccuucaucgaguguuaugaauaugcacgagaucuauacuguccuaaacccaggagaaguauuacccacggccuuugaagccuccgaaaaguggccuaaccugauccacgaaccacuggaccaaggcaauugugcaggcucaugggccuuuuccaccgccgccguggccagugaccgcgugucuauucacucucucggacauaugacacccguacucagcccgcaaaauuugcuaucuugugauacacaucagcagcagggaugccgaggaggacgacucgacggcgcuuggugguuuuuaaggagacgcggaguagugagcgaucauugcuaucccuucagcggccgcgaaagagaugaagccggcccugccccaccauguaugaugcacucaagggccaugggcagagguaaacgccaggcaaccgcucauuguccuaauucuuacguaaacaacaaugacaucuaccaagugacgcccguauauagacuaggaaguaaugacaaagagauuaugaaggaacugauggagaacggacccguucaggcucuuauggagguccacgaagauuuuuuuuuguacaaaggaggcauauacucccauacaccugucagucuuggcagaccugaacgguaucggaggcacggcacccacagcgugaaaauuacugguuag

SEQ ID NO: 14404 - RNA, 303 nt, Artificial Sequence; identical to SEQ ID NO: 12765
  Description of Artificial Sequence: Synthetic coding sequence

SEQ ID NO: 14405 - RNA, 978 nt, Artificial Sequence
  Description of Artificial Sequence: Synthetic coding sequence
augagacugccuagacgagcugcccucgguuuacucccucuccuucuccuccugcccccugcgccagaagccgccaaaaagccaaccccaugucaccgcugcagaggacuggucgauaaguuuaaccagggaauggucgacaccgcuaagaagaacuuugggggcggcaacacugcuugggaagaaaagacgcugaguaaauacgagagcagcgagauucgguuacuggaaauucucgaggguuugugugagucaagugauuucgaaugcaaccagaugcuugaagcccaagaggagcacuuggaggccuggugguuacaguuaaaaucggaauaccccgaccuauucgagugguuuugcguaaagacccugaaagugugcuguagucccggaacauacggaccugauugucuggcaugucagggcggaucucagcggccauguucaggaaauggacacuguucuggcgaugguucucgccagggugaugggucguguagaugucauaugggguaccagggaccuuuauguacugacuguauggacggauacuucuccucucuucgcaaugaaacccacagcauuuguacggccugugacgaaaguugcaagaccuguucaggcuugaccaauagagacugcggugagugcgagguaggaugggugcuugaugaaggcgccugcguggaaugcgacagcagcugcgucgguugcacaggagaaggcccuggaaacugcaaagaauguauuagcggcuacgccagagaacacggacagugugcagauguggacgaauguucucucgccgagaagacaugcguuaggaagaaugagaacugcuauaauacccccggcagcuacgugugcgugugccccgacggcuucgaagaaacagaggaugccugcgucccuccugcugaagcugaagccaccgaaggagagucaccaacacaacuaccaucccgggaggaccucuag

SEQ ID NO: 14406 - RNA, 459 nt, Artificial Sequence
  Description of Artificial Sequence: Synthetic coding sequence
augcggggaccaggacacccacuuuuacucggcuuacuguugguccuuggggcugccgguaggggaagagggggagcagaaccucgggaaccagccgacgggcaagcacugcugagacuggugguagaacuuguucaagagcuccgcaaacaccacuccgcugaacauaaggggcugcaacugcuggguagagacugugcacucggucgcgcugaggcugcaggacuggggccaucccccgagcagcgcguggaaaucguuccccgcgaccuccguaugaaggauaaauuucuuaagcaucucacuggaccacuguauuuuuccccuaaauguucgaaacacuuccaucggcuuuaucauaauacaagagauugcacuauccccgccuacuacaaaagaugcgccagacuccugacgagguuggcuguaagccccguaugcauggaagacaagcaauag

SEQ ID NO: 14407 - RNA, 411 nt, Artificial Sequence
  Description of Artificial Sequence: Synthetic coding sequence
auggcacgaaccaagcagaccgccaggaaaaguacggguggcaaggcaccacgcaagcagcuggccaccaaggcagccagaaaauccgccccagcuaccggcggagucaagaaaccacacagguaccggcccggcacaguggcacuacgagaaauucgccgauaucagaagucuacugaacucuuaauccgaaagcugccuuuucagagacugguacgugagaucgcccaggacuuuaagaccgaucuucgcuuucaaagcucagcugucauggcacugcaggaagccagugaggcauaucuugucgggcuguuugaggacacuaaccucugugcuauucacgcuaaacggguaacaauuaugccaaaggacauucaacuggccaggcgcaucaggggcgaaagagcguag

SEQ ID NO: 14408 - RNA, 1209 nt, Artificial Sequence
  Description of Artificial Sequence: Synthetic coding sequence
augaggcuucccagacgcgcggcucugggacugcugccccuauugcuccuacugccgccagcaccggaagccgcuaaaaaacccacaccaugucacaggugccggggccuaguugacaaguucaaccaggguauggucgacacugcgaaaaagaacuuuggcggagggaacaccgcuugggaggagaagacacucucuaaauacgaaucauccgaaauuagacuccuugaaauacuggaaggccucugugaauccagcgauuucgagugcaaucagaugcucgaggcacaagaagagcauuuagaggcuugguggcugcaacugaaguccgaguaucccgaucucuucgaaugguuuugugugaagaccuugaaagugugcugcuccccaggaacguacggaccugauugccuggccugccaaggggguucucagcggccauguucugguaacggccauuguucuggggauggaagucgucaaggagacggauccugccgcugccacaugggcuaccagggcccccuuuguacugacuguauggacggauacuucucuuccuuacgcaacgaaacgcacucuauuuguacggugagaacuggauugagugacaguuaccccccauguugcuugucccuaggaugcuggagaggaguaggacacgcuuggauuagaggccgcaacacacacacacaaccaggguauucuuccagaguguggaucgcagcuuuuucaccggccugcgacgagaguugcaagacaugcagcggacugacuaaucgagacugcggagagugugaggugggcuggguguuggaugaaggcgcuugcguggacguugacgagugugcagcagaaccaccacccuguagugcugcccaguucuguaagaaugcuaauggauccuauaccugugaagaaugugauuccuccuguguaggauguaccggagaagggccaggaaauugcaaagaguguauuagcggguaugcgcgcgagcacggccagugugcugacguggaugaguguagccuggcggaaaaaaccugugugagaaagaaugaaaauugcuauaacaccccggggagcuacguauguguauguccagauggcuuugaggaaaccgaagaugccugcguaccgcccgccgaggccgaagcaaccgagggugaauccccuacucagcugcccucaagagaggauuuauag

SEQ ID NO: 14409 - RNA, 633 nt, Artificial Sequence
  Description of Artificial Sequence: Synthetic coding sequence
augucagcuggcaagaugaugcgaacccugaucaccacccacccguuaccacugcuccugcucccccagcagcugcugcaauugguccaauuucaagaaguagacacagacuuugacuuccccgaggaagauaaaaaggaagaguucgaagaaugucuagagaaauuuuucagcacaggucccgcacgaccaccgacaaaggaaaaagugaaacguagaguauugaucgaacccggcaugccucucaaucacauagaauacugcaaucacgaaaucauggggaagaacgucuacuacaagcaucgaugggucgccgaacauuauuuccugcucaugcaguaugaugaacuccagaagaucuguuauaaccgguuugugccaugcaaaaaugggaucaggaaguguaaccgaaguaaaggacuggucgagggcguuuauuguaaccucacugaggcauuugagauacccgcuugcaaauacgaaagucuguaucguaagggauaugugcugaucacuugcaguuggcaaaaugaaaugcaaaagagaaucccacauaccauuaacgaucugguugagccuccagagcaccgcagcuucuuaagcgaagacggcguauuugugaucaguccuuag

SEQ ID NO: 14410 - RNA, 585 nt, Artificial Sequence
  Description of Artificial Sequence: Synthetic coding sequence
augacaaugagacauaauuggacccccgaucugucuccuuuguggguacuguugcugugugcacaugugguaacucuacuuguccgcgcgacucccgugucacagacuacuaccgcagcuacagccagcguacgcucuacuaaggacccuugcccuucccaaccuccaguauuuccagcagcuaagcaauguccugcccucgaagucaccuggcccgaaguugagguuccauuaaauggcacccuuaguuuaucaugcguagcuuguucacgauucccaaacuuuuccauucucuacuggcucggaaauggcucauucauugaacaucuacccggacgucugugggaggggaguacaaguagggaacgggguaguacaggaacucagcucugcaaggcccuggugcuggagcaacugacucccgcacuacacuccaccaacuuuucauguguacuuguggaccccgagcaagucgugcagaggcacgugguacucgcacagcucugggccggccuucgugcgacccugccucccacgcaggaagcccucccaagcucucauucuucaccacaacaacaggguuag

SEQ ID NO: 14411 - RNA, 4059 nt, Artificial Sequence
  Description of Artificial Sequence: Synthetic coding sequence
augaggcacggaguggcuugggcccucuuggucgcggccgcuuugggacugggcgcaagggggguacgaggggcuguggcauuggcagauuuuuacccuuuuggcgcagaacgcggugaugccgucacccccaaacaagacgacgguggcaguggauuacgcccgcuaagcguuccguuuccuuucuuuggggcugaacacaguggccuuuacguaaacaacaauggaaucauuaguuuucugaaagaagugagucaguuuacaccuguagccuuccccaucgcuaaagauagaugcguugucgcugccuucugggcugacguagauaaccgacgcgcuggcgauguguacuacagagaagccacugaucccgcuaugcugagacgugcaacugaggauguccgacauuacuuuccagagcuccuugacuuuaacgcuacaugggucuucguggccaccugguaccgggugaccuucuuuggggguuccuccucuucuccaguuaacaccuuccagacaguccugauuaccgauggcaaacucuccuuuacaaucuucaacuacgaaucuauuguguggaccaccgggacucacgcauccucagggggcaacgccacgggacugggaggcaucgccgcucaggcaggcuucaacgcuggugacggccaaagauauuuuucgaucccugggagucgcaccgccgacauggcugaggucgagaccacuacuaacguuggcgucccaggaagaugggccuuucguauugacgacgcacaaguaagaguagggggcuguggacacaccacuuccguaugccuggcacugcggccuugucugaacggcggcaaauguauugaugacugcgugacuggaaauccuuccuauacaugcucuugccuguccggguuuaccgggaggagaugccaucuggacgugaaugagugugcuucacaacccugucagaaugguggaaccugcacccacggcauaaauuccuuuaggugucagugucccgcggguuuugguggccccacaugugaaacggcucaguccccuugcgauacaaaggaaugccagcacggcggccagugccaagucgagaaugguagcgcagugugugugugucaggcagguuacacgggagcugccugugaaauggauguggaugacuguuccccugaucccugcuugaaugggggcuccuguguggaucuagugggaaauuacacuugccuaugugcugaacccuuuaaaggccuucgaugcgagaccggagaccauccugugcccgaugcaugucuuagugcaccaugccauaacggcggcacauguguggacgcugaucagggauacgucugcgagugcccugaagguuuuaugggccucgauugcagggaaagaguaccagaugauugugaguguaggaauggaggaagguguuugggagcuaacacaacccuaugccaaugcccucugggcuuuuuuggguuauuaugugaguucgaaauuacagccaugccuuguaacaugaauacacagugccccgaugggggauauuguauggaacauggaggcuccuaccuguguguaugucauaccgaccauaaugccucucacucauugccaucuccaugcgauucugaccccugcuucaaugguggaucaugcgaugcccacgaugacucguacacaugcgaaugcccuagaggcuuccacgguaaacauugcgagaaagcccgaccccaucuuuguagcucuggucccuguagaaacggcggaaccuguaaggaagcagguggcgaauaccauuguagcugcccauauagguucaccgguagacacugugaaauuggcaaacccgauaguugcgccuccggaccaugccacaacggugggacaugcuuucauuacauugggaaauacaaaugcgauuguccaccagguuuuagcgggagacauugugaaaucgccccgucuccaugcuuucgaaguccgugugugaacggcggaaccugugaagaccgagacaccgauuucuuuugccacugucaggcaggauacaugggaagaaggugccaggcggaaguggacuguggcccuccugaagaggugaaacaugccacacugcgguuuaacggaacaaggcuuggugcuguggcucuguacgcaugugaucgcgguuauucacucucggcuccgucaaggauccgggucugucagccacacggcgucuggagcgagcccccccagugccucgaaauagaugaaugcaggagucagccauguuuacacggagguagcugccaagauagaguagccgguuacuuaugucugugcuccacaggauacgagggcgcucauugcgaauuggagagggaugaauguagagcccacccaugccggaacggcgggaguuguagaaacuuaccuggagcuuaugucuguagaugccccgccggguuuguuggaguacauugugaaacagaaguggacgcgugcgauucgucuccuugccaacauggcgggaggugcgagucuggggguggcgcuuaccuuuguguuugucccgaaagcuucuucgguuaccauugcgaaaccguuucugaccccugcuucucuucacccuguggagggcguggguacugcuuagcuaguaacggcucucacucaugcaccuguaaggugggcuauaccggcgaggauugcgcaaaagagcuguucccaccuacugcgcugaaaauggaacgaguggaagaaucaggggugagcaucucauggaacccaccuaacgggcccgccgcccgacagaugcuugacggcuacgcugugacauauguuuccucugacgguuccuauaggcgcacugacuuuguggaucggaccagaagcucccaccaauuacaagcuuuagccgcaggccgcgccuauaacauaucaguuuuuucugugaaacgcaacuccaauaauaagaacgauauuagucgcccggcagugcuccuggcccgaaccaggccucgcccagucgaagguuuugaggucacuaacguaacagcuucuaccauuaguguccagugggcuuuacauagaauuagacacgccacugugucaggcgucagagucaguauucgacacccagaagcuuugcgagaccaggccacagacguggacaggaguguggaccguuucacauuuagagcucucuuacccggcaagcgguacacuauccaguugaccacuuuaaguggacuccgaggcgaagagcacccgaccgagucccucgcaaccgccccuacacaugucuggacacggccgcuacccccagcuaaccucaccgcugcccgggucacugcuacuucugcccaugucgugugggacgccccuacuccaggcucacuccucgaagccuaugucaucaacguaacgacuagucagucaaccaagucuagauauguaccuaauggaaaguuagccagcuauacagugcgagaccuauugccaggucgccguuaucagcuuucagugauugcaguucagucaaccgaauugggcccacagcacucggagccugcgcaucuuuauauaaucacgucuccuagggacggggccgaccggcgcuggcaccagggcgggcaccauccaaggguauugaagaaucgaccaccuccugccagacuaccugaauugagacuucuaaacgaccauuccgcaccagaaacccccacccagccuccgcguuuuagugaacuaguggauggcagaggacgcgugucagccagauucggcgguuccccaaguaaagcugccacuguccgaagccacguccccgggaauuguucagaaaacccaugccaaaauggggggaccugugugccgggagcugaugcgcacucuugugacugugggccgggcuuuaagggacgccgcugugaauuagcauguaucaaaguuuccagaccauguacccgacucuuuucagaaacgaaggcauucccagucugggaaggaggagucugucaucacgucaagcaguccaaaucacaaacccucgaaaagagcuag

SEQ ID NO: 14412 - RNA, 957 nt, Artificial Sequence
  Description of Artificial Sequence: Synthetic coding sequence
augcugcccuugaccaugaccgugcuaauucuccuucuuuugcccaccggacaggcagcuccgaaggacggugugacgagaccugauucugaagugcagcaucagcuguugcccaaucccuuucagccaggccaggagcaacucggacuguuacagagcuaccucaaaggauuggggagaacagaggugcagcuugaacaucugucucgcgaacaaguacuuuuauaucuauucgcacuucaugacuacgaucagucugggcaacuggacggacuugaacucuugagcauguugacagcugcccuugcuccaggagccgcaaauucgcccaccacgaacccuguaauccugauaguagauaaaguguuagagacucaggauuuaaauggagacggccucaugacgccggcugagcucauuaacuuccccggagucgcauugaggcacgucgaaccaggugaacccuuggccccgucuccucaagaaccacaagccguaggaagacagucucuguuggccaagucuccccuccgucaagaaacacaagaggccccuggcccccgggaagaggcaaagggacagguagaagccagacgugagucauuggacccuguccaggagcccggaggucaagccgaagcggacggggauguuccaggcccuaggggcgaggcagagggucaggcggaagcuaaaggcgacgcaccaggcccuagaggagaggccggaggucaggcagaagcugagggcgacgcgccaggcccucggggagaggcgggcggucaggcugaggcugaaggagaugcaccaggcccacgcggggaagcaggcggccaagcugaggccagggagaauggcgaagaggcaaaagaacugccgggcgagacucuggagagcaagaacacacagaacgacuuugagguccauauagugcagguggagaaugacgagaucuag

SEQ ID NO: 14413 - RNA, 816 nt, Artificial Sequence
  Description of Artificial Sequence: Synthetic coding sequence
augcaggccgcuuguugguauguccucuuccuccugcaaccuacuguuuaccuugugaccugcgcuaaccuaaccaacggcggcaaaagcgaacugcuuaagaguggcucaucuaaauccacucucaaacauaucuggaccgaguccagcaaagaucucucuaucagccggcuucugucucagaccuucagaggcaaagaaaaugauacagauuuggaccugagauacgacaccccugaaccuuacagcgaacaggaccuuugggacuggcugcggaacucuacugaucuacaggagcccagaccgagagcuaaaagaagaccaauugugaaaaccggaaaauuuaagaaaauguucggguggggcgauuuucacucaaacauuaaaaccguuaaauugaaccuguuaauaaccggcaagaucguggaucacgggaaugggacauuuucaguguauuuucgacacaacucuacaggccagggcaauguuucuguauccuuggucccuccuacgaaaauuguggaguuugaccuggcucagcaaacggugaucgacgcaaaggauagcaagaguuucaacugccgcaucgaauacgagaagguugauaaagcaaccaaaaacacccugugcaauuaugacccauccaagacuugcuaccaggaacagacccagucacacgugucuuggcuauguucaaaaccauucaaagugaucuguauuuauauuucauucuauagcaccgauuacaaacugguccagaagguuugucccgauuauaacuaucauucugauacucccuauuuucccuccggauag

SEQ ID NO: 14414 - RNA, 999 nt, Artificial Sequence
  Description of Artificial Sequence: Synthetic coding sequence
augcuguugcucgcagcugccuucuuaguugccuucguuuuguuauuguauaugguuucuccgcucauuagccccaagccccucgcacugccuggagcgcacguugucgugaccggaggcucaagcgguaucggcaaguguauagccauugaguguuacaaacagggagccuucauuacccucguagcccggaaugaagacaagcuacuucaggccaagaaggaaauugaaaugcauaguauuaaugauaagcaagugguucuguguauaucuguggacguaucacaagacuacaaccaggucgagaaugugauuaaacaagcccaagagaagcucggaccgguggauaugcugguuaacugugcaggaauggcagugagugggaaauuugaggaucuugagguuucuacauuugagagauugauguccaucaacuaccuggggaguguguauccuagucgugcugugaucacaacgaugaaagaaaggcgcguuggucgaauuguguuugucaguagccaagcggggcagcugggucuuuucggcuuuacagccuacagcgcuucgaaguuugcuaucagaggauuagccgaggcauugcaaauggaggugaaaccauacaauguguacauuacuguugcauaccccccagacacagacacuccuggauucgcugaagaaaaccgaaccaaaccucuggaaacuaggcuuaucagcgaaacgacuucagucuguaagcccgaacaaguagccaaacaaaucgucaaggacgccauccaggguaauuuuaacaguucccucgguagugacggguauaugcuaucggcauugacaugcggcauggcaccagugaccucuaucacggaaggccuccagcagguggucaccauggguuuguuccguacgauugcccuuuuuuaccuuggauccuuugacucaauaguucguagauguaugaugcagcgcgagaaaagcgagaacgccgacaagacugccuag

SEQ ID NO: 14415 - RNA, 1497 nt, Artificial Sequence
  Description of Artificial Sequence: Synthetic coding sequence
augucuuucucggcuacgauucuauuuuccccuccauccggauccgaggcuagguguuguuguugugcgugcaagucagagacaaacggcggaaacacaggcucacagggagggaacccaccacccuccacuccaauuacagugaccggccauggguuggcuguucaaagcucggagcaguuguugcacguuauauaucaaagaguugacaaagcagucggccuggcagaggcagcucuaggucucgccagagcaaacaaugaacuucuuaagagauugcaagaagagguaggggaucuacgucaaggcaaggugucgaucccugacgaagauggagagagucgcgcccacucaaguccucccgaggaaccgggcccacugaaagaauccccaggagaagccuucaaagcucucagugccgucgaagaagaaugugauuccguggguagcgguguucagguggugauugaagagcuuagacaacucggagcggcuucugucggucccggaccacucggcuuuccagcuacccagcgagacaugagacugcccggauguacacuugcggccagcgaggcagcaccccuauugaacccccuuguggacgacuacgucgcuuccgaaggcgcagugcaacgcguucuggugccggcauaugcuaaacaacuuuccccagcuacacaacuggccauccaacgagcaacuccggaaacaggcccagaaaacggaacgaagcugccuccuccgcgcccugaagauaugcugaacgccgcagcggcucucgacuccgcucuggaagagucaggaccuggauccacaggagagcuacgucauucacuuggacucacaguuucccccugccggacgagagggucuggacagaaaaacagucggagaaaaagggaucucguacuguccaaacugguccacaauguucauaaucauaucacgaaugacaaaagauucaauggauccgaaucuaucaaaagcucuuggaauauuuccgucguuaaauuuuuguuagagaaacuaaaacaagaauugguaaccucuccucacaacuacacugacaaagagcucaaaggcgcguguguugcauacuuccugaccaaacgccgagaguaccggaacucucuaaaccccuuuaaaggucugaaggagaaggaagagaaaaagcuccgcagucgacgauacagacuuuuugcuaaucgaucgagcaucaugcggcauuucggaccugaggaucagcgcuuauggaacgaugucacagaggaauuaaugagugaugaagaagacucucugaacgaaccagaccggcuucccucggcagaagcccagcuacuccccccugagcucuauaauccuaauuuucaggaagaggaagacgaaggcggcgaugagaaugcccccggcuccccgucauuugaccaaccgcacaaaacauguugcccagaccugaacucuuucauagaaaucaagguggaaaaggacgaguag

SEQ ID NO: 14416 - RNA, 966 nt, Artificial Sequence
  Description of Artificial Sequence: Synthetic coding sequence
augagacugccgagaagagccgcuuugggguugcuccccuuguuacugcugcucccgcccgcacccgaggcagccaaaaagcccaccccgugccacagaugccggggauugguggauaaguuuaaccaggguauggucgauacugccaagaagaauuuugguggcgggaacacagccugggaggaaaaaacucuguccaaauacgaaaguucugaaauaagacuccuggaaauucucgaagggcugugugaaucuucagauuuugaauguaaucagaugcucgaagcccaggaggaacaucuggaagcuugguggcugcagcucaaguccgaauacccugaucuguucgagugguuuugugugaagacacuuaaggugugcugcucuccaggcaccuacgggccugacugccuggcuugucaaggaggaagccagagaccuugcagcgggaauggacauuguucaggcgacgguagcagacaaggcgauggauccuguagaugccacauggguuaucagggcccccugugcacggacuguauggacggauacuucucaagucuaagaaacgaaacgcacagcauuuguaccgcuugcgacgagaguugcaagacgugcucaggucugaccaauagggacuguggugagugugaaguuggauggguacucgacgaaggagccuguguagauguugaugaaugcgcagccgaaccuccacccuguagcgcugcccaauuuugcaagaacgcaaacggaucguauacaugugaggauguggaugaguguucacuggcagagaagacuugcgugagaaaaaacgagaauugcuacaacacccccggcagcuaugucugugucuguccagacggauucgaggagacagaagaugcuuguguaccaccugcugaagcugaggccacugagggggaaucuccaacacaacugccaagucgcgaagaucucuag

SEQ ID NO: 14417 - RNA, 711 nt, Artificial Sequence
  Description of Artificial Sequence: Synthetic coding sequence
augaugggaauuuuucuggucuaugugggcuuuguguuuuucaguguacuguacguccagcagggacucuccucucaggccaaauuuaccgaguuuccgagaaaugucacagcgaccgaggggcagaauguugagaugagcugcgcuuuucaaagcggaucggccagugucuauuuagaaauucaauggugguucuugcgcggccccgaggaucuggauccaggcgcagagggugcaggggcucagguagaauugcuuccagacagagaccccgauagcgauggaaccaaaaucucaacugucaaggugcaagggaacgauauuagccauaagcugcagaucucuaaaguaagaaagaaagacgagggacuuuacgaaugcagggugacugaugccaauuacggcgaacuccaggagcauaaggcccaggcauaucugaaagugaacgcaaacucucacgcuagacguaugcaggccuuugaggcgucucccaugugguuacaagauaugaagccccggaagaauguuagugcugcaaucccaucuaguauacauggaucugcuaaccaacggacucauagcacuucuuccccucagguaguagcaaaaauacccaagcaaagcccacaaaguggggccagaaucgcuacaagccacggccugucagucuuacuacuagucugcggauucgugaaaggugcauuacuuuag

SEQ ID NO: 14418 - RNA, 273 nt, Artificial Sequence; identical to SEQ ID NO: 12779
  Description of Artificial Sequence: Synthetic coding sequence

SEQ ID NO: 14419 - RNA, 360 nt, Artificial Sequence
  Description of Artificial Sequence: Synthetic coding sequence
augcccgcuguauuuaugcuugcuagcucuucugcacugcaguguggaagaggcgucccccgcuuuccuagaaccgagguaggcgccggacauagcgugaacgaagaaacaaaagccgaaaaagugggaaaccagacgagcgugaucccugcaacgucucgccaggcugcccuggguacaucuuggacacagcgucgcacccaaccccuucaggagcguucucacuggcacccccggggcaacaacgcuaguggcaugggaggacaccgaauguuuccagguccauugagaggcccagccgcccaagugcucgaaaacgaaugugggagcuuaggaagagccgcagagggaaggucguag

SEQ ID NO: 14420 - RNA, 639 nt, Artificial Sequence
  Description of Artificial Sequence: Synthetic coding sequence
auguugucaucggucgucuuuuggggccuuauugcucugaucggaaccucccgcgggagcuacccauucagucacucgaugaaaccacaccuccacccucgacucuaccacggcuguuauggagauaucaugaccaugaaaaccucaggggcaaccugugaugccaauucagugaugaacugcggaauacgugguagcgagauguuugcugaaauggaccugcgcgcaaucaagcccuaucagacccucauuaaagaagugggacaaaggcacuguguggacccagcagucauugcggcuauuaucuccagagaaucgcauggaggguccguguuacaggacggcugggaccaccgaggauuaaaguuuggccugaugcaacuggauaaacagacauaucaucccguaggcgccugggauucaaaggagcaucucucacaggcuaccgguauauugacggaaagaauuaaagcuauacagaagaaauucccuaccuggucugucgcacagcaccuuaagggcggacucucugcauuuaaauccgggauugaggcgaucgcaacuccgagugacaucgacaaugacuuugugaaugacaucauagcccgagccaaauucuacaagcgacagucguucuag

SEQ ID NO: 14421 - RNA, 387 nt, Artificial Sequence
  Description of Artificial Sequence: Synthetic coding sequence
augcguguugcaagaaggacgcgcaacguuuguagauguccccgagccgccggcccaggagugccagagcccagagcagcaccacucccgcuccucgcaauggccccgccuccggccugccguagcccgaugucuccuccaccuccaccccuccuguuacucuuauuaucccuggcacuacuuggugcuagagcacgagcagaacccgcgggaucagcuguaccugcccagagccgccccugcguagauugccacgccuuugaguucaugcagcgagcccugcaagaucuccggaagacggcauguagucuggaugcucgaacugaaacgcugcucuuacaggcugaacguagggcccuuugugcuuguuggcccgcgggacauuag

SEQ ID NO: 14422 - RNA, 399 nt, Artificial Sequence
  Description of Artificial Sequence: Synthetic coding sequence
augggaccccgagugcugcaacccccuuuacuguugcugcugcuagcccugcucuuggcugcccuuccuugcggugccgaggaagcaagcccuuugagaccagcucaagugacauuaucgccuccccccgccgugaccaauggaagccaacccggcgccccccauaacaguacucacaccaggccgccaggcgccucaggaucggcccucacccgcucauuuuacgugauucuaggguuuuguggccuaaccgcccuguauuuuuuaauuagagcuuuucggcugaagaaaccccaaagaagaagguacggacuacuugccaacacugaagaccccaccgaaauggccagccuagauuccgacgaagaaacaguguuugagucucgcaaucugcguuag

SEQ ID NO: 14423 - RNA, 585 nt, Artificial Sequence
  Description of Artificial Sequence: Synthetic coding sequence
augucagcucuauggcucuuacuaggccugcuggcucugauggauuuaucugagagcaguaauuggggaugcuacggaaacauucagagucuagacacuccaggugccagcugcgggauugggcggaggcacggacuuaauuauuguggcguacgagccucagagcgguuggcagagaucgacaugcccuaucuccugaaauaucagccaaugaugcagaccauuggucagaaauacuguauggacccagcagucaucgccggaguacucagcaggaaguccccuggagauaaaauucuggugaauaugggggaucgaaccaguaugguucaggauccaggaucccaggccccaaccuccuggauaagugagucucaggugucucagacuacagaaguguugacaacccgaauuaaagaaauacagcgcagguuuccaacuuggacuccggaccaguaccuucgagguggcuugugugccuacucugggggagccggcuaugugagaucgagucaagaccuaucuugugacuuuugcaaugacguccuggcucgggcaaaguaccuuaaaaggcaugguuucuag

SEQ ID NO: 14424 - RNA, 441 nt, Artificial Sequence
  Description of Artificial Sequence: Synthetic coding sequence
auggugauaacaauuuauuaugacgugaaggugcgcuucaucguuagagguuguggucaauauauuaguuacaggugucaagagaaacgcaauacauauuucgccgaguacugguaccaagcgcaauguugccaguacgauuauugcaacagcuggucaucuccacagcuucaguccucccuuccagagccacaugaucgaccucucgccuuaccguuauccgacucucaaauccagugguuuuaccaggcacucaaucugucucuccccuugccuaauuuucaugccggcacugagccagauggauuggaccccaugguuacgcucucccugaauuuaggccuuagcuuugccgaacuuagacggauguauuuguuccuaaauagcagcggacuacucguauuaccucaggccgggcucuuaaccccccaccccucuuag

SEQ ID NO: 14425 - RNA, 234 nt, Artificial Sequence; identical to SEQ ID NO: 12786
  Description of Artificial Sequence: Synthetic coding sequence

SEQ ID NO: 14426 - RNA, 444 nt, Artificial Sequence
  Description of Artificial Sequence: Synthetic coding sequence
auggggcaggaggugcacggauccuguugggccuugggcgcaggaggggggcagagacaauggguuggacggucaaugcccccauuagcuccucaauuaugucgcgcaguguuccuuguucccauacuguuacuauuacaagucaaaccccuuaacggcucucccggccccaaagacggcucccagaccgaaaagaccccauccgcggaccagaaccaggaacaguucgaggagcacuuuguugcaaguuccguuggcgaaauguggcaagucguggacauggcacagcaggaagaagaccaaagcucaaaaacagcugcggugcacaaacauucuuuccaucugucguuuuguuuuucccuagccucggucauggucuuuucugguggaccccuuagacgaacuuuccccaacauccaauugugcuucaugcuuacccacuag

SEQ ID NO: 14427 - RNA, 1695 nt, Artificial Sequence
  Description of Artificial Sequence: Synthetic coding sequence
auggccccuaaaaaauuguccugccuucguaguuuguugcuuccacucucucucacgcucuuguugccucaggccgacacgcgaagcuuuguuguggaucggggccaugacagauuccuacuugauggagcaccuuuccgguaugugucuggaucucugcauuacuuucgcguuccccguguucuuugggccgauagguuacugaagaugcgauggagcggccucaacgcaauccaauucuacgugcccuggaauuaccacgagccucagccaggaguauauaauuucaauggcagucgcgaucugaucgcuuuucucaacgaagccgcccucgccaaucuccuuguuauucugcggccuggcccauauauuugcgccgagugggagaugggaggucugccaaguuggcuccuaaggaaaccugaaauccaucuucggaccagugaccccgcugacaacaugacaaagauuuuuacacuguugcggaaauaugagccucacggccccuuagugaacuccgaauacuacaccggauggcuggacuacuggggacaaaaucauucuacucgcucuguguccgccgugaccaagggacucgagaacaugcucaagcucggagccucaguaaauauguauauguuccauggagggacuaauuucgguuacuggaacggcgcagacaagaagggaagauuucuuccgauuacgaccucuuaugauuaugaugcuccaauaucugaagccggagacccaacuccaaaguuauuugcuuugcgcgacgugauuucuaaguuucaggaagugccccucgguccacuucccccaccuagcccgaagaugauguuaggucccgugacacugcacuuagugggucaucuucucgcauucuuagaucuccugugcccccgaggaccaauucauagcauacugccgaugacguucgaggccgugaaacaggaccauggauuuaugcuguaccgaacuuauaugacccauacaauuuuugaacccacuccauuuugggugccgaauaauggggugcaugauagagccuacguuaugguggacggaguauuucagggugucguugaacgcaauaugagagauaaacuauucuuaacugggaaauuaggcaguaaacuggacauccuggucgagaauaugggccgacucucuuucggaucaaacaguagugauuucaaaggacuucuaaaaccccccauucugggacagaccauacugacucaguggaugauguuucccuugaaaauugacaaccucgucaaguggugguuuccucuccaguugccaaaguggccauauccucaggccccaucaggacccaccuucuauaguaagacuuucccuauuuugggcucugugggcgacacuuuucuuuaucucccugguuggacaaagggacaaguguggauuaacggcuuuaaucugggacgcuauuggacuaagcagggcccccagcagacacuguaugugcccagauuccuccuguucccccggggagcccuaaauaagauuaccuugcucgagcuugaagacgugccucuccaaccccaggugcaauuucuugauaaacccauucuuaacucuaccucuacccuccaccgcacccauaucaauagccuaagugccgacaccuuaucagccagcgaaccuauggaacugucaggucacuag

SEQ ID NO: 14428 - RNA, 423 nt, Artificial Sequence
  Description of Artificial Sequence: Synthetic coding sequence
auguuuuuuaccauuagccggaagaacaugucucaaaaacuaagucucuugcuccuggucuuuggacucauuuggggauuaaugcuucuucacuauacauuccaacagccacgucaccaaaguuccguuaagcugagagagcaaauucuggauuuaaguaagcgauacgucaaagcucuagcggaagagaacaaaaacacuguggacguugaaaacggcgccagcauggccggguacgccgaccucaaacgcacuauagcugugcugcuggaugacauucugcagcggcuugugaaacuagagaacaaaguagauuacauaguggugaacgggucugcagccaacaccacgaacgguaccucagguaacuuagucccaguaacaaccaacaagagaacuaauguguccgggagcauucgguag

SEQ ID NO: 14429 - RNA, 528 nt, Artificial Sequence
  Description of Artificial Sequence: Synthetic coding sequence
augcuuccaccuauggcucugccuucuguuucauggaugcugcuuucuugcuugaugcuccugucacaaguccagggugaggaaccucaaagggaacugcccucugcuagaaucagauguccaaaaggcagcaaagcauauggaagucacugcuacgcguuguuccugucaccuaaaucauggacagaugccgaccuugccugccagaagaggccgucugggaaccucgugucaguccugucuggagccgaggguucuuuuguaagcucuuuagucaaaagcauaggaaacuccuacagcuauguuuggauaggccuacaugacccgacccaggggacugaaccuaauggugagggcugggaguggaguucuucagacguuaugaauuauuuugcuugggaaagaaauccuucaacaaucaguucuccaggccacugcgcgucacuaucacggaguacugcguuucuuagauggaaggacuacaacugcaacguucgucugcccuacguuugcaaguuuacagauuag

SEQ ID NO: 14430 - RNA, 381 nt, Artificial Sequence
  Description of Artificial Sequence: Synthetic coding sequence
augcaucuaagccagcuacuggcuugcgcgcugcugcugacccuacucagucuuagaccuagugaggcgaagccuggagccccaccaaagguaccaagaacuccaccggcugaggagcuggccgaaccccaagcggcgggagggggacagaaaaagggugacaaggccccuggcggcggaggagccaaucucaaaggugauagguccagauuacugcgagaucugaggguggacacaaagaguagagccgcaugggcccgacugcuccaagagcacccuaaugcaaggaaguauaaaggagcaaauaagaagggucuuucuaaaggguguuuuggacucaagcuugaccgcauugguagcaugucuggacuggguuguuag

SEQ ID NO: 14431 - RNA, 288 nt, Artificial Sequence; identical to SEQ ID NO: 12792
  Description of Artificial Sequence: Synthetic coding sequence

SEQ ID NO: 14432 - RNA, 423 nt, Artificial Sequence
  Description of Artificial Sequence: Synthetic coding sequence
auguucuuuaccauuuccaggaagaauaugucccaaaagcuuucccuccuacuucugguauucgguuugauuuggggccugaugcuccuucauuacacauuucagcaaccucggcaccagagcucaguuaaguugcgugaacaaauucuugaccuauccaaaagguaugugaaagcguuggcugaggagaauaagaacaccgucgacguggaaaauggagccaguauggcuggcuacgccgaucucaagaggacuaucgcaguccuucuagaugacauacuucagcguuuagugaaguuagaaaauaagguagacuacauaguuguuaacgguagcgcagcuaauacaaccaacggaacaagcggaaacuuggugccagucacgacgaacaaaaggaccaacgucuccggcucgaucagauag

SEQ ID NO: 14433 - RNA, 291 nt, Artificial Sequence; identical to SEQ ID NO: 12794
  Description of Artificial Sequence: Synthetic coding sequence

SEQ ID NO: 14434 - RNA, 678 nt, Artificial Sequence
  Description of Artificial Sequence: Synthetic coding sequence
uaagcagauuugcccaguugcuggggagcaggaccauguuacacaggccacaaggucggcgcuuugagacgggacacuguaauauguuguugucgccacggagacuacucgacaccgugccucuuuacucccggaaaaccaucccggaacccuagccccuggaagcggacacuguggacacuuagcgcacccugggccgguccugccggguggacaggagaagagcagaacgccacaaaaaccggauuaauuaccaggagacccaggccucuuagaaggcgcccacauccggcaccugcuucuccgcugccagagauaauucgaggcaauaucccuagaaugcugggcaaauuuguaccagucaauugggaaccaccacagccgcuacccuuccccaaguaccugagauguuaucguugucuucucgagacuaaagaguuggggugucuccugggcagcgauauuuguuuaaccccugccgggaguagcugcauuacacuccauaaaaaaaacucuucuggcuccgacgugaugguaagcgacugccgcuccaaggaacagaugucagauugcucaaauacaagaacgagcccugucucgggcuucuggauuuuuagucaguacugcuuucucgacuucuguaaugacccacaaaaccgcggacuuuauacucccuag

SEQ ID NO: 14435 - RNA, 684 nt, Artificial Sequence
  Description of Artificial Sequence: Synthetic coding sequence
augggagcuguaaugggcacuuucuccucacuccaaacuaaacagagaaggccgagcaaggauaucgccuggugguauuaccaguaucaacgcgacaagauugaagacgaauuagagaugacaaugguaugucaccggccugaaggcuuggaacagcuggaagcgcagaccaacuucacuaaaagagagcugcaggugcuuuaucgaggcuuuaagaaugaaugucccuccggggugguuaaugaggauacguuuaaacaaauauacgcacaauucuuuccacauggggaugccucuacuuaugcccacuaucuguuuaaugcauuugacaccacacaaacuggcuccguaaaauucgaagacuuuguuaccgcucuguccauucuguugaggggcacaguccaugagaagcuacgcuggaccuucaaucucuacgacauuaacaaggauggcuacauuaauaaagaagagaugauggauauaguuaaggccauuuacgacaugaugggaaaauauacauacccugugcucaaggaagauacuccaaggcaacauguggacguguucuuccaaaaaauggauaaaaacaaggacggaaucgugacccucgaugaauuuuuagaaucaugccaggaagacgauaauauaaugagaucauuacaguuauuucaaaaugugauguag

SEQ ID NO: 14436 - RNA, 546 nt, Artificial Sequence
  Description of Artificial Sequence: Synthetic coding sequence
augcaagugaacuucgucuccuacguucagcuaaccaguagagcucuuccaucacucacagacucuaaggggucucucgucgucguguccagccuccugggccgcguucccacuucuuuuagcaccccauacagcgccgcaaaauuugcccuggauggcuuuuuuggaucacuucgccgcgagcucgacguucaggaugucaacgucgcgauaaccaugugcgugcugggccugagggaucgugccuccgccgcagaagcaguucgcucgucuacuagcaggccacgccagccugagcaccgcggaguuccauuacaaucucagacagccauguuucuaccaccaaccguuccaggcgccaggacgcuuacagagaccccccuccguggcuggccucagcccaagaugaagucuucccgucagaaaucgaagacagagaagaacgauggccaccucgagccugugacagcaugggagguccaggugccacgcguccgacgacuguguaggggccucgcccgcccacaccuuuucggccaugacuag

SEQ ID NO: 14437 - RNA, 423 nt, Artificial Sequence
  Description of Artificial Sequence: Synthetic coding sequence
auguccgaucucuugcugcucggucucaucggcggccugacacuucuguuauuacucacacuguuggccuucgcuggcuauaguggccuccucgccggcguggaaguuagcgccgguucccccccuauccggaauguuaccguggcauauaaauuucacaugggcuuauacggcgaaacagggagacucuuuaccgaauccugcagcauuucucccaagcugagaaguauugccguuuauuacgacaacccacacauggugccaccugauaaguguagaugcgcugugggaucgauccucucugaaggugaagaguccccaucucccgaauuaaucgaucuguaccagaaauuugguuucaaaguuuucucguuuccagcaccgucacacguagugacagcaacuuucccuuauacuaccuag

SEQ ID NO: 14438 - RNA, 177 nt, Artificial Sequence; identical to SEQ ID NO: 12799
  Description of Artificial Sequence: Synthetic coding sequence

SEQ ID NO: 14439 - RNA, 2742 nt, Artificial Sequence
  Description of Artificial Sequence: Synthetic coding sequence
augggucccgaagcucugaguucucuauuauuacugcucuuaguggcuaguggcgacgcagacaugaaaggacacuucgauccagccaaauguagauacgcccucgguaugcaggaucgaaccaucccugacuccgauauaucugcuuccucaagcuggucugacagcaccgccgcgcgacacagccgacucgaauccucagauggugacggcgccuggugcccugcagggagcguguuccccaaagaggaagaauacuugcaaguggacuugcagagauugcaucucguggcucugguuggaacccagggcaggcacgcagguggacucggaaaggaguuuucucggucguaucggcuuagguauucuagggacggcaggagguggaugggauggaaggauagauggggucaggaagugaucucagggaaugaagaucccgagggaguuguacugaaagacuugggaccccccauggucgcacgcuuggugagguuuuaccccagggcggacagaguaaugucuguauguuugcgcguggaguuguacgguugccuguggcgcgaugggcuacucuccuacaccgcaccaguuggacagacuauguaucuguccgaggccguuuaccuuaacgacagcaccuacgauggccacacaguugggggucugcaauauggaggguugggccaguuggccgauggcguggugggucucgaugacuuucgcaaaucccaggagcucagaguguggccugguuacgauuauguggguuggaguaaucauaguuuuucaucuggauauguggaaauggaguucgaguuugacagacugagggcguuucaggcaaugcaggugcauuguaacaacaugcauacacugggcgcccgacugccugggggaguugaaugucgauuucgccgaggaccagcgauggcuugggagggagagccaaugcggcauaaucugggaggcaauuuaggcgauccaagggcucgcgccgugucuguacccuuggguggaagagucgccagguuccuucagugcagguuucuguuugcaggcccaugguuauuguucagcgagaucucauuuaucucugauguggucaauaauucaucuccagcacuuggcggcaccuucccgccugccccuugguggccccccgguccccccccuaccaacuucucaucacucgaacuagaaccaagaggccaacaaccaguugcuaaggccgaaggaucuccaacugcaauccucauugggugccuugucgcaauaauccuccugcuguugcucaucaucgcucuaauguuguggaggcugcacuggcgacgacugcuaucgaaagccgagaggagggugcuugaggaagaauugacgguccauuugagcgucccuggggauaccauccucaucaauaaucgccccggacccagagaacccccuccuuaucaagaaccaagaccuagaggaaacccaccucacuccgcuccuugcgugccaaacgguucugcccuucuguuguccaaccccgcauaccgucuccuacucgccacauaugcccggccuccacgcggccccggaccccccaccccugccugggcuaagccaacuaauacucaagcguauuccggugauuauauggaaccagaaaaacccggcgccccguuacugcccccaccuccacaaaacagcgugccucacuaugccgaagcugacaucgugacccuucagggcguaaccggaggaaauacauaugccgugccagcccugccaccuggagcagugggggaugggccaccaaggguggacuuuccucggagcagauugcgauucaaggaaaagcuaggggaagggcaguuuggagaaguccaucugugcgagguugauuccccacaggacuuagugucacuugauuuuccuuuaaaugugcguaagggccacccccuucuaguggccgugaagaucuugagaccugacgcaacaaagaaugcccggaacgauuuccuaaaagagguaaaaaucaugucgagacuuaaagaucccaacaucauccggcuucuaggcguuugugugcaggacgacccucucugcaugauuacggauuauauggaaaauggagauuuaaaccaguuucugucggcacaccaguuagaagauaaagccgccgaaggggcgcccggugacgggcaagcagcgcagggacccaccaucucuuaccccaugcuccugcauguagcugcucaaauagcaucaggaaugcgcuaccuggccacacuuaauuucgugcaccgugaccucgccacaaggaacugcuuagugggggaaaacuuuacaauaaaaaucgcagacuuugguaugucccgcaaccuguacgccggagacuacuaucguguccagggaagagccguuuuaccaauccgguggauggcuugggaaugcauauugauggguaaauucaccaccgcaagcgacgugugggccuuuggugugacccuuugggaggugcucauguugugucgggcccagccauuuggacagcugacagacgaacaggugaucgagaacgccggcgaauucuuucgagaccaggggagacagguauaucuaagccgcccuccagcuugcccgcaaggccuguacgaacucaugcugcgcugcuggucuagagaaucagagcagagacccccguucagccagcuacacagauuucucgcagaagacgccuugaacacaguuuag

SEQ ID NO: 14440 - RNA, 1146 nt, Artificial Sequence
  Description of Artificial Sequence: Synthetic coding sequence
augcgacuguuagcauggcuuaucuuucucgccaauuggggcggcgcgcgcgcagaaccggguaaauucuggcacauugcugaucuccaucuggacccggauuacaaagugaguaaagauccuuuccaggugugucccuccgccggaagccaacccguacccgaugccggaccguggggagacuauuugugugauucacccugggcucuuaucaacuccagcaucuaugcuaugaaagagauugaaccggagcccgacuuuaucuuauggacuggggacgauacaccacauguccccgacgaaaaacugggugaggcugcaguguuagaaauuguugaacgucucaccaaacucauccgcgaaguauucccaggagcauucuauugugaaaagcuccccgggccuucaggcgccggacguauuguaguccugaacaccaaccuuuacuauacaucaaacgcacucacagccgacauggcagauccagggcaacaguuucaguggcuggaagacgugcuaacagacgcgaguaaggccggagauauggucuacaucgugggucacguuccacccggcuucuucgagaaaacacagaacaaagccugguuccgggaaggguuuaacgagaaauaucugaaaguuguccggaagcaucacagagucauagcaggacaauucuuuggacaccaccacacagacucauuuagaaugcuuuacgaugacgccggugugccaaucucugccauguucauuacaccuggcgugaccccauggaagacaacucucccuggaguggucaauggugcgaacaauccagcaauccgggucuuugaauacgaccgcgccaccuugucacucaaggauauggugacuuacuuuaugaaucugagucaagccaacgcucagggaacuccacggugggaacuggaauaucaauccacacuacagagauacuacguuuauaauucuguuucuuacucugcaggugugugcgacgaggcaugcucaaugcagcaugugugcgccaugagacagguagauauugaugcauacaccacauguuuguacgccucaggcaccacucccguaccccagcugccucuucugcucauggcacuccucggacuuugcacuuuggugcuguag

SEQ ID NO: 14441 - RNA, 456 nt, Artificial Sequence
  Description of Artificial Sequence: Synthetic coding sequence
augcgcgucgcuggagccgcaaaacugguaguagccgucgccguuuuccuucugacuuuuuaugugaucagccaaguuuucgagauuaagauggacgcgagcuuaggcaauuuguuugcaaggucagcccucgauacugcagccagaaguacaaagccgccucgguacaaaugcggcauuucgaaagccugucccgaaaaacauuucgcuuuuaagauggcuuccggagcugcaaauguggugggaccaaagauuugcuuagaagacaauguacuuaugagcggagucaagaauaacgucggacggggaaucaacgucgcuuuggccaacggcaaaacaggugaggugcuggauaccaaauauuuugauauguggggcggagauguggcuccauucauagaauuucuaaaggcaauucaggacgggacuauuguacucaugggaacauacgacuag

SEQ ID NO: 14442 - RNA, 936 nt, Artificial Sequence
  Description of Artificial Sequence: Synthetic coding sequence
uaagcuccaagccccuguucacacuuuaauugcggcucccaggucacugacggcgguaccaucaagcagaaaaucuuuaccuuugacgccauguucuccacuaauuauagccauauggaaaacuacaggaaaagagaagacuuggucuaucagucaacugugcguuugcccgaaguacguaucucagauaaugguccuuaugaaugucaugucgggauuuaugaucgagcgacucgugagaaggucgucuuggccuccggaaacauuuuccucaacguuauggcucccccuaccucuaucgaaguggucgcugccgauacaccagccccuuucagccgguaucaggcucagaauuucacauuaguuugcauagucagcggaggaaagccugcaccaaugguauauuucaagagggauggggagcccauagacgcuguuccacuguccgaacccccugcugccagcaguggacccuugcaggauaguaggccuuuccgaucacuccuucaucgcgaucuggacgauacgaaaaugcagaagagccucucccuccucgacgcugagaacagaggcgguagaccuuacacugagcggccuucaaggggauugacccccgauccaaacauuuugcuucaaccaacaacugaaaacauuccagaaaccguagugucacgugaguuuccuagaugggugcacuccgcugagcccacauauuuccugcgucacuccagaacuccuagcucagacgggaccguugagguucgcgcucugcucaccuggacccugaacccacagaucgacaaugaagcucucuuuucaugcgaaguuaaacacccugcccuguccaugcccaugcaagccgaggugacucucguggcuccaaaaggaccaaagauugucaugaccccuucacgagccagagucggugacacauag

SEQ ID NO: 14443 - RNA, 978 nt, Artificial Sequence
  Description of Artificial Sequence: Synthetic coding sequence
augcaaggucgcguggccgggagcugugcgcccuuagggcuguuacucgugugccugcaccugcccggcuuauuugcacgcagcauaggcguggucgaggagaaaguaagccagaaccucgggaccaaccucccccagcugggacagccuucuuccaccgggcccucuaacucugagcauccgcagccagcacuggacccaagaaguaaugaccucgcccguguacccuugaagcuguccguuccugcaucagaugguuuuccaccugccggcgguuccgcugugcaacgcuggcccccaagcuggggucugccugcaauggauaguuggccuccugaggacccguggcagaugauggcugccgcggcugaggauagauugggugaggccuuaccagaagaguugucauaccucucaucagcagcugcuuuagcccccggauccggaccacugccaggggaaucuuccccagacgccacuggguugucgccaaaagcuucgcuucugcaccaggacuccgaauccagaagauuaccacgaucaaacucacugggugcuggcggcaagauccucucgcaacgccccccuuggucucuuauucaccgagucuuaccagaucacccuuggggcacccucaauccuagugugagcuggggcggcggcgggccuggcaccgguuggggaacccgcccgaugccacauccagagggcauaugggggaucaacaaccagccacccgguacaucauggggaaacauaaaccgguaucccgguggaucuuggggaaacauaaaccgauauccuggcggcaguuggggcaauauuaaucgguauccuggaggaagcuggggaaacauccauuuauacccuggcaucaacaacccuuucccccccggaguucuucguccucccggcucauccuggaacauccccgccggcuuuccaaaccccccuucuccucggcugcaguggggcuag

SEQ ID NO: 14444 - RNA, 957 nt, Artificial Sequence
  Description of Artificial Sequence: Synthetic coding sequence
augggacuccauuuacgacccuaucgcguuggccuguugccggacggucugcucuuccugcugcugcugcuaaugcugcuggccgaccccgcucuccccgccggaaggcacccgccuguggucuugggaugguucaccacgaaacacccugggccuccgucauuccucaugguauggauguauguuucccuagcacugggccggcccagucacuggucauccuggacuccagcaaaagcagcuugggugccgaucucaaccccaugguggagggcccucugggcaggggcuacacacggagugaggaugucugaaggucugccaaugacuggagcagagccucaaagacaaccgcaagcuuggaaggacaaauacauuagagcauuugucucacuuggggcgcccugggguggaguagccaaaacccugagaguucuugcuucuggagacaauaaucguaucccggugauugguccacugaaaauucgcgagcagcaaagaucugcagucuccacuuccuggcugcuuccauacaauuauaccugguccccugaaaagguuuucguacagacuccgaccaucaauuauacccugagagauuacagaaaguuuuuccaagacaucggauucgaagacgguugguuaaugcggcaggacacugaggguuugguugaagcaacuaugccaccuggagugcagcuacauugccuguacgguacagggguaccuacgccugauucuuucuacuacgaaucuuucccagaccgggacccuaagaucugcuucggggauggggacggcaccgugaaucugaagagcgcacuccaaugccaggccuggcaaucacgacaagagcaccaagucuuacuccaggaauuacccggaagcgagcacaucgagaugcucgccaaugcuacuacacuugcuuaucuuaaacgugugcuccucgggccuuag

SEQ ID NO: 14445 - RNA, 1575 nt, Artificial Sequence
  Description of Artificial Sequence: Synthetic coding sequence
uacgcccucagagacaggcagggaaaugcuauuggaguuaccgcuugcgacauagauggagacggcagggaagaaaucuauuucuuaaauacaaacaaugcauucaguggaguugcuacauacacagauaagcuguuuaaguuccguaauaaccggugggaagauauucugucagacgaagucaacguugcgaggggggucgccagccuguuugcaggucggucugucgccugcgucgacaggaaaggcucagggcgguacagcauauacaucgcuaauuacgcuuacggaaaugugggaccugacgcucucauugagauggacccugaagcaucagacuuaucuagaggcauccuggcccucagggaugucgccgcggaggccggcgucagcaaauauacaggcgggaggggaguaucuguuggacccauccucaguucaucugccagcgacauuuuuugcgauaacgaaaaugggccaaacuuuuuguuccacaacagaggugauggaacauuuguugacgcugcugcaagugcaggagucgaugacccucaucagcacgguagaggaguggcuuuggcugacuucaauagagacggcaaagucgauaucguuuacggaaauuggaauggcccacaccgguuauaccugcaaaugucuacccacgggaagguucgcuucagagauauugccucuccaaaguucucgaugccuuccccuguacggaccguaauuaccgccgauuucgauaacgaucaggaacuggaaaucuucuuuaacaacauugcuuacagauccucuagugccaacagacuguuuagagugauuagaagggaacacggcgauccacuuaucgaagagcuaaacccuggcgaugcacuggaaccagaaggacguggcacaggaggaguggugacugacuuugacggagauggcaugcucgaucuuauccugagucacggcgagagcauggcacagccuuuaaguguuuuuagagguaaucaaggcuucaacaauaacuggcuuagggucgucccaagaacucgcuuuggagcguuugcccgcggcgcaaaggugguucuauauaccaagaaauccggagcacaucuucguaucauugacggcggcucagguuaccugugugagauggaaccaguggcacacuucggccucggcaaagaugaagcuuccucuguggaggucaccuggccugaugguaagaugguaagccgaaaugucgccuccggggagaugaauucagugcuggaaauccuauaucccagagacgaagacacgcugcaggaccccgccccacuggagacuccaaugaacgcgucuucuagucacucaugcgcacuggagacuaguccuuacguguccacaccaauggaagcuacuggagccggaccaacgcguagugcugugggagcuaccuccccuacccgcauggcucaacccgccuggggccuguccgcaucucacagagccccugccccuccgccaccuccucuccuguuaccacuccccuuacugcugccacuucuugaacuuccucuccuacauagaucuaguuag

SEQ ID NO: 14446 - RNA, 636 nt, Artificial Sequence
  Description of Artificial Sequence: Synthetic coding sequence
auggugaguagaauggugucuacaaugcuguccgggcugcuguucugguuagcguccggcuggacuccagccuucgccuacuccccuaggacccccgaucgggugagcgaggccgauauccaacgucuguuacacggagugauggaacaacuugggauugcgcgaccuagaguggaauaccccgcccaccaagccaugaaccugguaggaccacagaguauagaaggaggcgcucacgaaggauugcagcaucugggcccauuugggaacauuccgaacauaguugccgagcugacuggggacaauauuccuaaagacuucucugaagaccaggguuaucccgauccacccaacccuuguccaguagggaaaaccgacgacggcuguuuagagaacacaccugauacggcugaguucucccgggaguuccagcuccaccagcaccuuuuugauccggaacaugacuacccagggcucggcaaguggaauaaaaaguuacuguacgaaaagaugaaaggcggcgagaggaggaaacgcagauccgugaauccguaccugcagggccaacgcuuggauaacguagucgcaaaaaaauccguuccacauuuuagcgacgaagauaaggaucccgaauag

SEQ ID NO: 14447 - RNA, 465 nt, Artificial Sequence
  Description of Artificial Sequence: Synthetic coding sequence
auggcacuggggguacccauuuccguguaccugcuuuucaacgccaugacagcucugacugaggaggccgcggucaccgucacucccccgaucacugcucagcagggaaacuggacgguuaacaaaacagaggcggacaacaucgaagguccaaucgccuuaaaauuuucccaucuuugccuggaggaucauaacucauauuguauuaauggcgcuugugcauuucaccaugaacucgaaaaggcgauuugcagauguuucaccggcuacacaggagaaagaugugagcaccuuacccuaacaucuuacgcaguugacuccuacgagaaauacauugcuaucgguauaggugugggcuuguuguuaucuggauuccuugucauauuuuacugcuauaucaggaaacgcugccuaaaacugaaauccccuuacaaugucugcucuggagaacgccgcccucuuuag

SEQ ID NO: 14448 - RNA, 1446 nt, Artificial Sequence
  Description of Artificial Sequence: Synthetic coding sequence
augggaaaacuccguccuggcagaguggagugguuagccucaggacauaccgagagaccucaccucuuccagaauuuguuacuuuuccuuugggcauuacucaacuguggacuaggcgucuccgcacagggcccuggagaguggaccccauggguaaguuggacacggugcagcagcuccuguggaagggguguuagugugcgaucaagacgcugcuugcggcucccuggugaggaaccauguuggggagacucccaugaguacaggcugugccaacugccggauuguccucccggagcugugcccuuccgagaucuucagugcgcccuguacaacggaagaccaguucucggaacgcaaaaaacuuaucaguggguaccuuuccacggcgccccuaaccagugugaucucaacugcuuagccgagggucaugccuucuaccacucauuuggcagagugcuugacggcaccgcauguucaccaggcgcucagggcgugugcguagccggaagaugccuuucugcagguugcgacggcuugcuugggucaggagcccuugaagaccguugcgguaggugcggcggugcaaaugauagcuguuuguuuguucaacggguauuucgagaugcaggggcuuucgcuggauacuggaaugugacccucaucccagagggagccagacacauuagagucgaacacaggucaagaaaucaccuggcucucauggguggagacgggcguuaugugcugaauggccacugggugguuagucccccaggcacauacgaagccgcaggcacucauguuguguacacaagagauacaggcccccaggagacucuucaagcugccggcccuacgagccacgaccuucuccugcaaguacugcuccaggaacccaacccugggaucgaguuugaauucugguugccucgggaaagguauucacccuuccaagcuagaguccaggcuuugggauggccauuaaggcaaccucagccccguggcguggagccccagccuccugcagcaccagccgugacgcccgcccaaacuccaacacuggcacccgaucccugcccccccugcccagauacacggggucgcgcccacagacuccuccacuauugcggcucagacuucguuuuucaagcucgcgugcucggacaucaccaccaggcacaggaaacucguuaugaaguuagaauccagcuugucuacaagaauagguccccacuucgcgcgagggaguacgugugggcucccggccauugccccugcccuaugcuggcaccucacagagacuaccuaauggcuguucagagguuagugucacccgauggaacacaggaucagcuguugcuuccacacgcuggcuaugcucgaccguggagcccugccgaggacucucguauccgacucacagccagaagaugcccuggauag

SEQ ID NO: 14449 - RNA, 627 nt, Artificial Sequence
  Description of Artificial Sequence: Synthetic coding sequence
auggccgauaugcagaaucucgucgaaagguuggaacgagccgugggacgucucgaagccgugucacacacguccgauaugcaucguggguaugccgauucaccaaguaaggcaggagcugcucccuauguccaggcguuugauagccuucucgcuggucccguggcggaauacuugaagaucagcaaggagaucgguggggauguucagaaacaugcagagaugguucacaccggacugaaauuagagcgagcacugcucgucacugcuagccagugucaacagccugccgaaaacaaacuguccgacuuauuagcaccaauaucugagcagauuaaggaagucaucacauuccgcgaaaaaaauagggggucaaaacuguucaaucaucuguccgcuguguccgaguccauccaagcucugggcugggucgccauggccccgaaaccugggccuuacguuaaggaaaugaaugacgcugcaauguucuauacaaaccgaguguugaaggaguacaaggaugucgauaagaagcacguugacuggguuaaagcauaucugucuaucuggacugaauugcaggcguacaucaaagaguuucacacgaccgguuuagcauggaguuag

SEQ ID NO: 14450 - RNA, 1482 nt, Artificial Sequence
  Description of Artificial Sequence: Synthetic coding sequence
ucugaggcaguuuauuuaaacgauucuacguacgacggacacacaguugggggucuccaguauggugggcugggacagcuggccgauggugucguuggacuggaugacuucaggaagagccaggaguugcgcgucuggccuggauaugacuacgugggcuggucaaaccauaguuucuccuccggguauguugagauggaguucgaguucgacagauuaagagcuuuucaggccaugcagguucauugcaauaacaugcauacccuaggggcuagauuaccaggaggaguugaguguagauuccgcagaggacccgcuauggccugggaaggcgagccaaugagacauaaccuuggcggaaauuugggggauccgagagcccgcgcaguguccguuccucucggggguaggguggcucgguuucuucaaugccguuuccuguucgcugguccuugguuauuguucucugaaaucagcuuuauuagugacguugugaauaauucauccccugcauugggugggaccuucccgccugccccaugguggccccccggcccuccccccacuaauuuuucaagccuggaauuggagcccagaggacaacagccuguugccaaagccgaaggguccccuaccgccauacuuauuggaugccucguugcuaucauucuucuucuccugcugauuaucgcccuuaugcucuggaggcugcacuggcgccgccugcugucgaagguguuagagagccacccccgcacgagauccccggggcugguuggcauacgcccgacaccccugcccguuuccccaauggcccugagaugcugcaguccuauccagcccaccgcaaguuuuuggccccugacccccgugccacuugaggcccgugcucccccccauccuccaggaccgaauccccccaccccgcgaggugugacaggcggcaauacuuacgcaguccccgcucuccccccaggugccguuggcgacggaccuccaaggguagacuuuccuagguccagauuaagguuuaaagaaaagcucggugaaggccaauucggagaggugcaccuaugcgaaguggacagcccccaggaccuggucucacuggacuuccccuugaaugugagaaaggggcacccgcuccugguugcugucaaaauacugcgacccgaugcaacuaagaaugcaagaaaugacuuucucaaagaagucaaaauuaugucucgucugaaagacccaaauaucauuaggcugcucggcguuugcguucaggacgauccccucuguaugauuaccgacuauauggagaauggggaccucaaucaguuucucucagcccaucagcucgaagacaaagccgccgaaggugcaccaggggacggacaggcagcccaagggccgacaaucucauauccuauguugcugcauguggccgcccagaucgccucagggaugcgguaucuggccacuuuaaacuag

SEQ ID NO: 14451 - RNA, 2319 nt, Artificial Sequence
  Description of Artificial Sequence: Synthetic coding sequence
augcaguuucagcugacccucuuucugcaccucggguggcuuucauacucuaaagcgcaagacgacugcaauagaggcgccugccacccuacuacuggcgaccugcucgugggaagaaacacccagcuuauggccuccucaacauguggauuaucucgggcucagaaguauuguauccuuucguaucuggaaggcgaacagaaguguuuuauuugcgacucccgauuuccuuacgacccauaugaccagccaaacagucacacuauagagaaugucaucguaucauucgagccagaucgcgaaaaaaaaugguggcaaagugagaacggucuggaccauguuagcauccgcuuggaucuggaagcccuguuuagguuuagucaccucauccugaccuucaaaaccuuuagaccggccgcuaugcuuguggagagaagcacagauuacggacacaacuggaagguauuuaaauacuuugcaaaagacugcgcaaccuccuuuccaaauaucacaucagggcaggcucagggaguuggagacauugugugcgacucuaaauauucugacaucgaaccaagcacagguggagagguuguacugaaggugcuugauccaucauuugagaucgaaaacccauacagcccuuauauucaggaccucgugacccucaccaaccuacgaauaaacuucacaaaauuacacacucuuggagacgcacugcuaggcagacgucagaacgacucccuugacaaauacuacuaugcccuguaugaaaugauaguacgagguuccugcuucuguaacggucaugcauccgagugccgcccuaugcaaaaaaugaggggcgacgucuucuccccacccggaaugguucauggccaaugugucugucaacauaauacagacggcccaaauugcgagcgcuguaaggacuucuuccaggacgccccauggcggcccgccgccgaucuucaggacaacgcaugccguucuuguucuuguaauucucauucuucgaggugccauuucgacaugacaacauaucuugccaguggcggucugucuggggggguaugcgaggacugccagcauaacacagaaggacaacacugcgacagauguaggccucuguuuuaccgagacccauugaaaacaaucucugauccauaugcaugcauucccugugaaugugauccagacggaacgauaucaggaggcauaugcguuucccauucugacccugcccucggcuccgucgcaggacagugccucuguaaagaaaacguugagggggccaaaugcgaucagugcaagccaaaccauuacgggcuuucggcuacagauccucugggcugccagccaugcgauuguaauccacucggaagucuuccauuccugacaugcgacguugauaccggacagugccugugccucaguuacgugacuggcgcucacugugaagagugcaccgugggauacuggggacucgggaaccaccuacacggaugcucccccugugauugugacaucggcggagccuauuccaacguuuguucacccaagaauggccagugugaguguaggccccauguuacaggccgauccugcucggagccagcaccgggcuacuuuuucgcgcccuuaaauuuuuaccuuuaugaagcugaagaagcaacuaccuugcagggauuggccccucugggaagugaaacauucggccagucccccgccguccacguugucuugggagaaccaguccccgggaauccgguaacuuggacagguccagguuuugcacgcgugcuuccgggcgcugggcugcgcuucgccgucaauaauauucccuucccuguggacuuuaccaucgcuauucauuacgaaacccagagugcagcagacuggacagugcagaucguuguuaacccccccggcgguuccgagcauuguaucccaaaaacccugcagucuaaaccccaguccuuugccuuaccugccgccacccguaucauguuacugccuacuccuaucugccucgaacccgacguucaauacagcaucgacguguauuucagccaaccccugcaaggugagucacacgcgcacucucauguucuugucgauucugcagcugugcaauggcacaaccugggaucucuucagccccccccucccgaguguaaacaguucucuugcuucucauuuccuuccaguugggauuacagacaccccccaccccaccucgcaaauuucugcauuuucagccgggacgguguguccccucauuggccuggauggucacaaacuccagaucuccgcuag

SEQ ID NO: 14452 - RNA, 1371 nt, Artificial Sequence
  Description of Artificial Sequence: Synthetic coding sequence
augggcagagcgggagccgcggcagugauaccgggucucgcacucuugugggccguaggauuagggucagccgcaccuucuccccaccuccggcuauccuuucaagaacugcaagcuuggcacgggcuccagacuuucuccuuggagcgaacuugcuguuaucaggcccugcugguggaugaagaacggggcaggcuguucgugggggccgaaaaccaugucgcuucucucaaccuugacaauauuuccaagagagccaaaaaacuugccuggccagccccuguagaguggcgugaggaaugcaauugggcaggaaaagacauuggaacagaguguaugaacuucgucaaauuacugcacgccuacaaucguacucaccuacuggcuuguggcaccggcgcauuccacccaacaugcgccuuuguggagguuggccacagagccgaggagcccguccuccgucuggacccagggcgaauugaggauggcaaagguaagucuccguaugaccccaggcaucgggccgcuagcguucuugugggggaagagcuguacaguggagucgccgccgaucugaugggcagagauuucaccauuuuucguagcuuagggcagagacccucucuaagaacagagccacacgacucccgcuggcuuaacgagccaaaauuuguuaaaguuuucuggauaccugaaagcgagaaccccgaugacgacaaaaucuacuuuuuuuuucgagaaacagccgucgaggccgccccugcucucggaagacucucugugucuagaguagggcaaaucugucgcaaugauguaggagggcagcgaagucuagucaauaaauggacgaccuuuuuaaaggcucgauuggucuguucuguccccggcguggaaggcgauacacacuucgaucagcugcaggauguauuccuucucucaucaagggaucauagaacuccacuccucuacgccguauuuagcaccucuagcagcaucuuccagggcagcgccguaugcgucuacuccaugaacgauguacgucgggcuuuccuggggccguucgcacacaaagaaggccccaugcaccaguggguauccuaucagggccguguacccuauccccgucaagccugcgcacccgcccguccucuugccccuucuguaccaccucgaacuagucagacuaugaguagcucacugcgcgguaccacuccaaguugcacuacccuuucuugucccuuaggcggggcccuauuuagcuacaaacuggaacccauaaccccuucccugaaacugccacguacuggucuccagcccuuaacugauacaaugacgagcuccuccuuggcccagacacuggcucgguguuag

SEQ ID NO: 14453 - RNA, 333 nt, Artificial Sequence
  Description of Artificial Sequence: Synthetic coding sequence
cucuuuaugcugcacaagaucguacaggucuauaacucagaugugaucgacaagcagagcgccaguaugacaagcgauaaugcugaugauaaagcuguaauaauucuagugcccgugcgucucgggggagaaaggacuaauaccgacuaccuagaauucgugaagggaauuuugagucuugaguacugcguaggaauuauuggggggaaaccuaagcaaaguuacuauuucgcuggcuuucaggaugauuccuugaucuacauggacccccauuauugccaguccuucgucgacgucucuaucaaagacuuuccccuugaagugauacuguag

SEQ ID NO: 14454 - RNA, 420 nt, Artificial Sequence
  Description of Artificial Sequence: Synthetic coding sequence
augggcccagaggcuuuaaguucacuacuauuacugcuccugguagccagcggugaugcugacaugaaagggcauuuugacccugccaaguguagguaugcucucgggaugcaagaccggacuauccccgauucagauauauccgccaguucuuccuggagugacuccacagccgcgcgccacucacgccuugaaucaagugauggugauggcgcauggugcccagccggcuccguguuccccaaagaagaagaguaccugcaggucgaccuccagaggcugcaccuggucgcccuugucgggacucagggacgacaugcagguggccuggguaaggaauucaguagaucuuauagacugcgguacagucgggacggaagaagauggaugggauggaaagauagaugggggcaggaauag

SEQ ID NO: 14455 - RNA, 570 nt, Artificial Sequence
  Description of Artificial Sequence: Synthetic coding sequence
auguuagguaucaccucauguuccgaccagcaggcgaaagaaggcgaaggauuagaaggcuccucuaccgguucgucauccgggaaccauggcggguccggcggcggcaaugggcauaaaccgggcugugagaaaccggggaaugaggccaggggaucaggagaaaguggcauucagaacucggaaacuagcccuggcauguucaacuucgacaccuucuggaaaaauuuuaagucaaagcugggguucaucaauugggaugcuaucaauaaaaaccaagucccaccucccuccacuagagcacuucuguacuuuagccgccucugggaggacuucaagcaaaauacccccuuccugaacuggaaagccaucauugaaggcgcagacgcaaguucgcugcagaagagagcaggacgggacgaccagaauuauaauuacaaccaacacgcauacccuaccgcauauggcggcaaauauucagugaagacuccagcuaagggcgggguaucccccucauccuccgccagcagaguacaacccggucucuugcagugggugaaauucugguag

SEQ ID NO: 14456 - RNA, 438 nt, Artificial Sequence
  Description of Artificial Sequence: Synthetic coding sequence
auggccgacaugcaaaaccuggucgaacgccuggagcgugcaguugguagacucgaagcuguuucgcacacaucagauaugcacagaggauacgcugauucaccaucaaaggcgggagcagcuccauacguccaagccuauauuaaagaauuucauaccaccgggcuagcuuggucuaaaacaggcccaguagccaaggaacugagcggacuccccagcggaccauccgcaggaaguuguccuccgccgcccccgccaugcccuccgccucccccugugucuacaauuagcugcucuuaugaauccgcaucccgcagcucccuguuugcccagauuaaucaaggugagaguauaacacaugcguugaagcacguguccgaugacaugaaaacacacaaaaaucccgcauugaaggcacagucaggaccggugagauag

SEQ ID NO: 14457 - RNA, 264 nt, Artificial Sequence; identical to SEQ ID NO: 12818
  Description of Artificial Sequence: Synthetic coding sequence

SEQ ID NO: 14458 - RNA, 2535 nt, Artificial Sequence
  Description of Artificial Sequence: Synthetic coding sequence
augggacccggagcuccuuucgccagggugggauggccgcuuccucuuuuaguugugauggcugccggaguagcucccgucugggcaucacauucgccccauuugccccgaccccacagcagaguuccuccccauccgucuucugaacgccgagcaguguacaucggggccuuguuuccaauguccgggggcuggcccgggggacaagcgugccagccugcuguagagauggcgcucgaggacgucaacucccgccgagauauucugccagacuaugagcugaaacuaauucaucacgauaguaagugcgacccaggccaggccacgaaauaucuguaugaacuguuguauaacgacccuauuaaaauuauucugaugcccggaugcucuagcgucucuaccuugguugcagaggccgccagaauguggaaucugauugugcucaguuacgguucuaguuccccggcucuauccaacagacaacguuucccgacauuuuuuagaacacauccgucugccacccugcauaacccaacacgugucaagcucuucgagaaauggggguggaagaagauagccaccauccaacagaccaccgaaguguuuacuaguacacucgacgaucuggaagaaagaguuaaagaagcggguaucgagauaaccuuccgucaauccuucuuuucagauccugcugugcccgugaaaaaucugaaacgccaggacgcccgaauuaucgugggccuguucuacgagacagaagccagaaaaguguuuugcgaaguauacaaggagcggcucuucgggaaaaaauauguaugguuuuuaaucgggugguacgccgacaacugguuuaaaauauaugacccuucuauuaacuguacuguggaugaaaugaccgaggcuguugaaggacauaucacuacagagauugugaugcugaacccagcuaauaccaggagcauaucaaacaugacuucacaggaauucguagagaaacuuaccaaacgguugaaaagacacccggaagaaacugguggcuuccaggaagcaccccucgcguacgaugcaaucugggcuuuggcccuagcucuuaacaagacuagcggagggggcggcagaucaggaguucggcuggaagauuuuaauuauaacaaucaaaccaucacugaccagauuuacagggccaugaauagcuccagcuucgaaggcguguccggccacgugguauucgacgccucaggaaguaggauggccuggaccuugauugagcagcuacagggagggucuuacaaaaaaauugguuacuacgacagcacuaaggacgaucuaucauggagcaaaacugacaaauggaucgguggaagcccgcccgccgaccagacucuggugaucaaaacuuuucgguuuuugucucagaaauuauucaucuccguuuccguguugaguaguuuaggaauaguauuggcuguugucugucucagcuucaacaucuauaacagucacgucagauauauccaaaacucacagccuaaccuaaacaaccugacugcaguggggugcagccuggcacuagcagcuguguuccccuugggccuugacggauaccauaucggaagaaaccaguuccccuuuguaugccaggcccgucucuggcugcugggauuaggauuuucccugggcuacggcucaauguuuacuaaaauuugguggguccacacugucuuuacuaaaaaagaggaaaagaaggaauggcggaagacccuggaaccauggaaacuguaugcaacaguagggcuuuugguggguauggacguguugaccuuggcaauuuggcagaucguugauccccuucaccguacuauugaaacuuuugccaaagaagagccaaaagaagauauugacgugagcauucugccacagcuggaacauuguaguucucgcaaaaugaacacauggcuggguauuuucuacgguuacaaaggacucuugcuuuuacuagggaucuuucuggcauacgaaaccaaaagugugaguacagaaaaaauaaacgaucaucgcgcuguaggcauggcuauauacaacguggcaguucugugucuaauuacugcccccgucaccaugauucuuucuagccaacaggaugccgccuucgcuuuugccucacuggcaaucguguuuucauccuauaucacacuugucgugcuguucguacccaaaaugcgcaggcugaucacccggggugaauggcagucagaggcccaggauacuaugaagaccgggagcucaaccaacaauaacgaggaagaaaaaucacggcugcuggaaaaagagaauagagaacuggaaaagaucaucgccgagaaagaagagaggguuucagaauuaaggcaccaacuccagucacggcagcaacuaagguccagacgccaccccccaacuccuccagagccgagcggaggcuugcccagagguccuccggaaccuccugauagacuguccugcgacggaucucgcgugcacuugcucuauaaguag

SEQ ID NO: 14459 - RNA, 2631 nt, Artificial Sequence
  Description of Artificial Sequence: Synthetic coding sequence
augggucccgaagcccuguccucgcuacugcugcugcuacuugucgccagcggagacgccgauaugaaggggcauuuugaccccgcaaagugucguuaugcacucggaaugcaggaccggacgauccccgauagcgacauaucagccuccucaucguggagcgacucaaccgccgccaggcacucgcgacucgaaaguucugauggagacggcgcaugguguccagccggcucggucuuucccaaagaagaggaauaucuccaaguggaccuccagcgcuuacaucucguugcacucgucgguacucagggaagacacgcagguggguuggggaaggaauuuucacgguccuacagacugagguauucucgggauggaagaagguggaugggcuggaaagaucgauggggccaggagguaaucagcggcaaugaggaccccgaagggguggugcuuaaggaucugggucccccaaugguggcuaggcucguaagauuuuacccucgggcugaccguguuaugagugucugccugcgagucgagcuuuacggaugucuauggagggacgggcuguuaagcuauacugcuccgguuggccagacaauguaucuuagugaggcaguguaccuaaaugauucaacauaugacgggcacacggucggaggauuacaauaugguggacugggucagcuggccgacgguguuguugggcucgacgauuuuaggaagagccaagaacuaaggguguggccuggcuacgauuacgugggguggagcaaucauucuuucaguaguggcuacguggagauggaauuugaguucgauagguuaagggcauuccaagcgaugcagguacauugcaacaacaugcacacccugggugcacgacugccugggggcgucgagugucgcuuucggcguggaccagcaauggcaugggaaggagaaccaaugagacauaaccuuggcgguaacuuaggugacccaagagcucgugcaguuucaguuccucugggggggcggguggcucguuuccuacaaugucgauuuuuguuugccggcccaugguugcuuuuuucugagauuucuuuuaucucugacgucgugaauaacucuuccccagcucuggggggaaccuucccuccugcccccugguggccaccgggccccccaccaaccaauuuuaguagucuggaguuagagccccgaggccaacagccuguagccaaggcggaggggagcccuacggccauucugauuggaugucuugucgcaauuaucuuguuacuccugcuuauaauugcucugaugcucuggagacugcacuggcggcggcuuuugucgaaggcagagaggagagugcucgaagaggaacuuaccgugcacuuaucagucccuggagauacgauucucaucaacaacaggccaggaccacgagaaccaccaccuuaucaagaaccccgcccucgcgguaaucccccacacucagcgccuuguguccccaaugguagcgccuauucaggagacuacauggaacccgaaaaaccaggcgcgccccugcucccacccccuccucagaacuccgucccacacuacgcugaggcugacaucgucacacuucagggcgugacaggaggcaacacauacgcagucccagcccucccuccgggcgccgucggggacggacccccuagagucgacuucccgcgcaguagacucagauuuaaagaaaaacucggagaaggccaguucggcgagguccacuuaugugaagucgauagcccacaagaccuggugucccuugacuucccacuuaacgucaggaaggggcauccucugcucguagccgugaaaauacugaggccagaugccaccaaaaacgcacguaacgauuuucugaaagaaguuaagauaaugucccgacuaaaggauccuaacaucauccgacugcugggggugugcguucaggacgauccucuuugcaugaucacugacuauauggaaaauggugacuugaaucaguucuugucugcccaccaacuggaggauaaagcugccgaaggggcaccuggagaugggcaagcagcacagggaccgacaauuaguuauccuaugcugcuucacguugccgcgcagaucgccucaggcaugcgcuacuuggcaacacucaauuuugugcaccgggaucuggcuacccggaauugucuagugggggaaaauuuuaccauuaagaucgcggacuucgguaugucaaggaaucuguacgccggagacuacuacagaguucagggacgagccguucuuccuauaagauggauggccugggaauguauacugaugggaaaguucacuacagccagcgacguaugggcauuugguguuacacugugggaaguucuaaugcuauguagagcucagccuuucgggcaguugaccgacgaacaagugaucgagaacgccggggaguucuuccgcgaccagggaagacagguguaccucucucguccacccgccugcccccagggucucuaugagcucaugcuacgcugcuggucaagagaauccgagcaacgaccccccuuuucccaguuacauagauuucucgccgaagacgcuuugaauacuguguag

SEQ ID NO: 14460 - RNA, 942 nt, Artificial Sequence
  Description of Artificial Sequence: Synthetic coding sequence
auguccgaccugcuauuauugggccucauuggcggccugacccuucuucucuugcugaccuugcucgccuuugccggcuacuccggacugcucgcuggaguugaaguaucagcagguaguccuccaauucggaaugucacaguugccuacaaauuucacaugggcuuguacggcgagaccggccggcuauucacugaaucuuguucaauaagucccaaacucagaucgauagcugucuacuacgacaauccucauauggugccccccgacaagugucgcugcgcagugggcaguauccucucagagggagaggagucacccagucccgaguugaucgaccuguaucaaaaauucggauuuaaggucuuuucuuuuccggcaccaucccaugucgugacugcaacauucccauacacaacuauccugagcauuugguuggccacuagaagaguucauccagcacuggacacuuauaucaaggaaagaaagcugugcgcauacccccgccuagagauuuaucaggaggaccagauucauuuuaugugcccucuggcgaggcaaggcgauuuuuacguuccagagaugaaagagacagaguggaaauggagaggccugguugaagcgaucgacacccagguagauggcacuggcgcugauacaaugagugauacaagcucuguaucucuggaagugagccccggcagucgugaaacaagugcagcaacacuuucuccuggugcgaguagucgcggcugggaugauggcgacacacggagcgaacauucuuacucugaaucgggggcaagcgggucaaguuucgaagaacuggaccuugaaggcgaggggccccuuggcgaaucuaggcucgauccaggcacggaaccgcuggguaccacaaagugguuaugggaaccgacagcuccggagaagggaaaagaguag

SEQ ID NO: 14461 - RNA, 843 nt, Artificial Sequence
  Description of Artificial Sequence: Synthetic coding sequence
augaaaacauucacuuggaccuugggugugcuguucuuuuuguugguggauacuggacauugcagaggcgggcaauuuaagauaaaaaagauuaaucagaggcgcuauccucggaccauuaaggauaugauaacacggauggaucuggaaaauuugaaggaugucuugagcaggcagaagagggagaucgaugugcuucagcucgugguggacguggauggcaauaucguaaacgaagugaaacuccuccgaaaagaaucccggaauaugaauucgcgcgugacucagcucuauaugcaauuacugcacgaaauuauaaggaaaagagacaacagucuggaacucagccagcuagagaacaaaauauuaaacgucacuacagaaauguugaaaauggcuacccgcuacagggaacuagaggucaaauacgcaucuuuaaccgauuuggugaacaaucaaucugucaugauuaccuuauuggaggaacagugccugagaauauuuagucgccaggauacccauguaagucccccacucguacaggugguaccacaacacaucccaaauucccagcaguauacgcccggacuccuggggggaaaugagauacagcgagaccccggcuacccccgugacuugaugcccccccccgaccucgcaaccucuccuaccaagagccccuucaagauuccaccagugaccuuuauuaaugaaggaccguucaaggacugucagcaggcuaaagaagcaggccauaguguaaaugggauauuuugggcagaguaucgaggaggcagcuauucacugcgggcugugcagaugaugaucaagccuaucgacuag

SEQ ID NO: 14462 - RNA, 522 nt, Artificial Sequence
  Description of Artificial Sequence: Synthetic coding sequence
augcacuggaaaaugcuccugcugcuguuguuguacuacaaugcugaagcaucuaugugucacagguggagccgcgccguucuuuuccccgccgcacaccgaccuaaacguuccaguucccucccccucaauccgguccuacagacgucacucgaagagguagagcuucuuuaugaauuccugcuugccgagcuugagaucucuccugaccugcaaauuagcauuaaggaugaggagcucgccucccugcgaaaggccucagauuuuagaaccguuuguaacaaugugauuccuaaaaguauaccugacauccgaaggcuuuccgcgucccuuaguucucaccccggcauucugaaaaaagaggauuuugagcgaacaguuuugacucuggcguauacagcauaccgcacagcccucagccacgggcaucaaaaggauauaugggcacaaucccuggucagucucuuucaggcccuucgccacgacuuaaugcguuccucgcaaccaggcguuccgcccuag

SEQ ID NO: 14463 - RNA, 309 nt, Artificial Sequence
  Description of Artificial Sequence: Synthetic coding sequence
auggagcgaggugcuggcgccaaacugcugccacuccugcuacuauugcgagccaccggauuuaccugcgcccagaccgacggccguaauggauacacagcaguuauugaggugaccucaggaggccccuggggcgauugggccuggccugagauguguccagacggguucuucgcuuccggauucucacucaaaguugagccaccacagggaaucccgggagacgauacugcacucaauggcauaagacuccacugugcccgugguaauguucuuggaaauacucauguucugggcagaauggaauag

SEQ ID NO: 14464 - RNA, 351 nt, Artificial Sequence; identical to SEQ ID NO: 12825
  Description of Artificial Sequence: Synthetic coding sequence

SEQ ID NO: 14465 - RNA, 1137 nt, Artificial Sequence
  Description of Artificial Sequence: Synthetic coding sequence
uaauauucaggcgauuacauggaacccgagaagccaggcgcuccccugcucccacccccgccacaaaauucuguuccacauuacgcugaagcagacauagugacacuucaaggugugaccggaggcaacacuuacgcagucccugcucuucccccaggcgccgugggggacggaccaccuaggguugacuuccccagaagccgcuuaagauuuaaagagaagcugggggaaggacaguuuggcgagguccaucuuugcgagguggauaguccucaggaucuggugucuuuagacuucccucugaacguuagaaagggccacccacuucuuguggcugugaagauucugagaccugacgcuacgaaaaaugccagcuucagcuuauucucaaggaacgacuuucugaaggaaguuaagauaaugucucgauuaaaggauccuaauauaaucagacucuugggugucugugugcaggacgacccuuuguguaugaucacugacuauauggagaacggagauuugaaccaauuccugucugcucaucagcuggaagauaaggccgcggaaggagcacccggggacggacaagcugcucaggggccuacgaucagcuauccaaugcuucuucacguugccgcgcagauugccagcggaaugagauaucuggccacccuaaauuucgugcaccgagauuuagcaacccgaaauugucuggugggcgaaaauuuuacaaucaagauugcugacuuuggcaugucccgaaaucuguaugccggugauuacuaucgugugcaagggagggcaguccugcccauacgguggauggcaugggaaugcaucuuaauggggaaguucacaaccgccucugacgucugggcuuuuggaguaacgcuuugggaagugcuaauguuauguagagcgcaaccuuuuggccaguuaacagaugagcagguuauugaaaacgcuggggaauuuuuucgagaucagggacgccagguguaccugucucgcccucccgccuguccacagggucuguacgaacugauguugagaugcuggucaagagaaagcgaacaacgcccucccuucucacagcuucacagguuucuugcugaggacgccuugaauacgguuuag

SEQ ID NO: 14466 - RNA, 942 nt, Artificial Sequence
  Description of Artificial Sequence: Synthetic coding sequence
augagcgaccuacugcuucugggguugaucggcggccuuacccuccucuuguugcuuacacuccuggccuuugcuggguauuccggauuguuagcaggcguugagguaucugcaggguccccuccaaucagaaacguaacaguggcuuauaaauuccacaugggucuauauggcgaaaccggcaggcuguuuaccgaauccugcucaauaagcccaaaacugcguuccauugccguuuauuacgacaacccacacauggucccgcccgacaaaugccgaugugcuguaggauccaucuugagugaaggugaggagucucccagcccagaacucaucgaccuguaccagaaauucggauucaaagucuuuagcuucccagcccccucucauguggugacagccaccuuucccuauacuacuauccuuuccaucuggcucgccacgcgacgcguacacccagcccuagacacguacauaaaggaacggaagcucugugcuuacccucgacuggagaucuaucaagaagaucagauacacuucauguguccacuagccaggcaaggagauuucuacguccccgaaaugaaagagaccgaauggaaguggagagggcuuguggaagcuaucgauacgcaaguggacggaaccggcgccgauaccaugucugacacaagcagcgugucucuggaggugucaccaggcagucgcgaaacauccgcagccacccucaguccaggggccagcagcagggggugggacgacggugacacacgcucugaacacagcuacagcgaaagcggggcaucaggaucaucguuugaagaauuagaucuagagggggagggaccauugggagagagcagacuagacccgggcacugaaccuuuagguaccaccaaaugguuaugggagccaacagcaccagaaaaagggaaggaguag

SEQ ID NO: 14467 - RNA, 420 nt, Artificial Sequence
  Description of Artificial Sequence: Synthetic coding sequence
augggaccugaggcucuuucuucucuucuccuccugcuacugguggccucaggcgaugcugauaugaaaggccacuucgaccccgcuaagugcagguacgcccuggguaugcaggacagaacaauucccgacuccgacauuagcgcaagcucuuccuggucugauuccacagcagcccgccacucacgucuugagagcagugauggcgauggggcuuggugcccugccggauccguguucccuaaagaggaagaauaucuccaaguggaucuucagagacugcaucuggucgcucuugugggaacccaggguagacacgcaggcggguuaggaaaggaauucagucgcagcuacagacuaagauauucucgggacgggagaagauggaugggcuggaaggaccgguggggccaggaauag

SEQ ID NO: 14468 - RNA, 342 nt, Artificial Sequence
  Description of Artificial Sequence: Synthetic coding sequence
auggauaauguccaaccuaaaauuaaacaucgccccuucuguuucagugugaaaggucacgugaagaugcugcgacucgccuuaaccguaacuagcaugacauuuuuuaucauugcacaagcccccgagccauacauuguaaucacuggguucgaaguuacagugauccucuucuuuauccugcuguacguucucagacuggacagacucaugaaguggcuguucuggccucuacucgacauuauuaacagucuugugaccaccguauucaugcuaauaguuagcgugcuagccuuaaucccagaaacaacaacucuuacagucggcggcggacuauuuuag

SEQ ID NO: 14469 - RNA, 465 nt, Artificial Sequence
  Description of Artificial Sequence: Synthetic coding sequence
auguucgguuggggagauuuucacagcaauaucaagacugucaaacucaauuuacugaucacaggaaagauaguugaccauggcaauggcacuuucagugucuauuuucggcacaauucaacugggcaaggcaaugucuccguauccuuggucccaccaacuaaaaucgucgaauucgaucucgcacagcagacaguuaucgaugcaaaagauuccaagaguuucaauugccgaauagaauacgagaaggucgacaaggcaaccaagaacacucuuugcaauuacgaucccucaaaaacuuguuaccaggaacagacacagucacacgugucauggcucugcucgaagcccuuuaaagucauaugcauuuacaucucuuucuauuccaccgacuacaaacugguccagaaggucugccccgauuauaacuaccauucugacacccccuacuuucccucagguuag

SEQ ID NO: 14470 - RNA, 531 nt, Artificial Sequence
  Description of Artificial Sequence: Synthetic coding sequence
auggcagauaugcagaaccugguagagagacuggagcgagccguugggcggcuugaggcagugucgcacacgucagacaugcacagagguuacgcggauucacccagcaaagccggcgcugcccccuauguucaggcauucgauagucugcuagccggcccuguugccgaauaucugaaaaucagcaaggaaauuggcggggauguccagaaacaugcagaaauggugcacaccgggcugaagcuggaaagagcccuucuugugaccgccucucaaugccagcagccagcggagaacaagcuguccgaccuacuggcccccauuagcgaacagaucaaagagguuauaacauucagagaaaaaaaccgcggaucuaaacuuuuuaaucacuuauccgccgucagugagucaauccaggcuuuaggguggguugcuauggcaccgaagccugggcccuacguaaaggaaaugaaugacgcagccauguucuauacuaaccgugugcuuaaggaauacaaggauguggauuag

SEQ ID NO: 14471 - RNA, 2535 nt, Artificial Sequence
  Description of Artificial Sequence: Synthetic coding sequence
augggccccggcgcaccauucgcucgagugggcuggccucuuccccuccuuguggucauggcagcuggggucgcucccguaugggcaucucacucuccgcaccuuccuaggccucacucuagagugccaccccaccccucgucugaacgcagggcuguauacauaggcgcccucuucccuaugaguggaggauggcccggcggacaagcuugccaaccagcgguugagauggcucucgaagacgugaauucacggcgugacauucuaccugauuacgaacucaagcucauccaccacgacagcaaaugugacccagggcaggcuacgaaauauuuauacgaguuauuauacaacgacccuaucaagauaauuuugaugccuggcuguuccucuguguccacguuaguggccgaagcagcuagaauguggaaccuuaucgugcuuuccuacggcuccucaucaccggcccuuaguaaccgccagagauuuccuacuuuuuucagaacgcacccaucagcuacccuacauaaucccacgcgggugaaguuauuugaaaaauggggauggaaaaagaucgccacaauacaacagaccaccgagguuuuuacuuccacguuagacgaucuugaagagagagucaaggaagccggcauugagauuacauucaggcaaagcuuuuuuagcgaccccgcaguucccguuaagaaucuaaagagacaggacgccagaaucauagugggucuguucuacgaaaccgaggcacguaagguguuuugcgaaguguacaaggagcgguuguucggaaaaaaauaugugugguuucugauaggaugguacgcagauaacugguuuaagauuuaugaccccuccaucaacugcacagucgaugaaaugaccgaggcagucgagggacacaucaccacggaaauugugauguugaacccugcaaauacccggucuaucagcaacaugacuucacaggaauucguugagaagcugacuaagcgauuaaagagacacccagaagaaacagguggguuccaggaggcuccacuggcauaugaugcgauuugggcccucgcauuagcccugaacaaaacuucuggaggcggaggcagaagcggggugcgccuggaggacuuuaacuacaacaaucaaacaaucacagaucagaucuaucgcgccaugaauucuagcucauuugaaggcgucucugggcauguuguguuugaugccucugguagcaggauggcuuggaccuuaauagaacaacugcagggugguagcuacaagaagauuggcuacuaugauucaacaaaagaugaucuauccuggaguaagacggauaaauggauuggaggcucuccaccugccgaucaaacacuaguuauuaaaacauuccgauuucugagccaaaagcucuucaucuccguuucagugcucagcuccuuaggcaucguguuagcggugguuugccugaguuuuaauaucuacaauucacaugugagauacauucaaaauucucaacccaaucuuaauaaccugacugcuguugguugcucucucgcauuagccgcuguguuuccacucgggcuagauggauaccauauagguaggaaccaguucccguucgugugucaggcucgcuuauggcuacuuggacucggauucuccuugggguauggauccauguucacaaagaucugguggguucauacuguguuuaccaaaaaagaagaaaagaaagaauggcgaaagacacuggagcccuggaagcuguaugccaccgugggccuccuaguagggauggauguccucacucuugcaaucuggcaaauaguggacccccugcaccggaccauugagaccuuugcaaaagaagaaccaaaagaagauauugacguguccauucugccccaauuggaacacuguagcagcagaaagaugaacaccuggcugggaauauuuuauggauauaagggguugcugcuguuacugggaauauuuuuagcauacgagaccaagagcgucaguacagaaaagauuaacgaccauagggcugugggaauggcaaucuauaacguggccgucuuaugccugauaacagcucccgugaccaugauucucuccucacagcaggacgcagccuuugccuucgcuucccuggccauugucuuuuccucauacaucacacuugucguguuguucguccccaagaugcggaggcuuauuacccguggcgaauggcagagugaggcccaggauaccaugaagacaggaucuaguacuaacaacaacgaagaagaaaaaagcagacuuuuggaaaaagagaaccgcgaauuggagaaaaucauugcagagaaagaggaacgcguauccgagcuucgccaucaguugcagagccgccagcagcugcguucucgcaggcacccucccaccccucccgaaccauccggcggacuccccaggggcccuccagaaccuccagauaggcucucuugcgacggaucuagaguacaccuccuguauaaguag

SEQ ID NO: 14472 - RNA, 2055 nt, Artificial Sequence
  Description of Artificial Sequence: Synthetic coding sequence
uaaccaagaagcucaacccaugugccacugguccugccauuauugguccuguugcugcuugccccagcucgccaagccgcagcacaacgcugcccacaagcguguauuugugauaacucuaggcggcacguagcuuguagauaucaaaaccugacugaaguaccugaugcaauuccagaguuaacccagcgcuuagauuugcaaggcaaucugcuuaaggucaucccggccgcugcuuuucaaggcgucccccaccugacacaccuagaucuccgccacugcgagguggaacugguggcagagggcgcuuucaggggccuuggaagacuguuacuguugaaccuggccucuaaucaccuaagggaguugccacaggaggccuuagauggacugggauccuugaggagacuggaacuagagggaaaugcuuuggaggagcuuagaccggguacuuucggcgcgcucggggcccuagcuacccugaaccucgcacacaacgcguugguguaucugccugcgauggcguuccaaggacugcugagggugagauggcugagacugucccauaaugcacucagcgugcuggcacccgaagccuuagcaggucuccccgcacugcgccggcucucacugcaucacaacgaauuacaggcacucccagguccugugcugagucaggcacggggacucgcuagguuagaacugggccauaauccccuuacuuacgccggggaggaagacggacuggcacuaccuggucuuagagaacuacugcuggaugggggcgcacugcaggcucugggcccucgcgcauucgcccacugcccccgccuucacacacuggaccuuagggggaaucaacuggauacacugccgccacuucagggcccuggacaacugcggcgccugagauuacaaggaaauccccucuggugcgggugucaggcacgcccucuccuagagugguuggcaagagcgagaguccgguccgacggcgccugucagggcccuagacgccuccguggagaagcucuggaugcacuuagaccaugggaccuaagauguccaggggacgcagcccaagaagaagaagagcuugaagagagggccguugccggcccacgagccccaccuagaggcccacccaggggacccggcgaggaaagagccguggcucccugccccagggccuguguuugcguuccugaaagcagacauagcagcugugaagguuguggauuacaggcagugccccggggauucccaucggauacacagcuccuggaccuucggcgaaaucauuucccaucagucccucgcgcagcauucccuggccugggucauuuggugucccuccaucuucagcacuguggcaucgcugagcucgaagccggcgccuuggccggacugggucgccugauuuaccucuaccuuuccgacaaucaacuggcuggcuugucugccgccgcacucgaaggagcuccaagacucggguacuuauaccuggaacgaaauagauuucugcaagugccuggagcggcccuuagagcguuacccucucuguuuaguuuacauuuacaagauaaugccguggaucgucuugcuccgggggaucugggacgcacucgggcucuaagauggguguacuuauccgggaacaggauaaccgaaguuucucuaggggcauugggccccgccagagaacuggagaagcuacaucuugacagaaaucagcugcgagaagugccaacuggcgcccuugagggcuugccugccuuauuggaauugcaacugaguggaaacccacugcgcgcauugagagacggcgcauuccaaccuguaggacggucuuuacagcaccuguuucucaacuccagcggacucgagcagauuuguccuggcgcauuuuccggacugggacccgggcugcagagcuugcacuugcagaagaaccaguuacgcgccuuaccugcccuuccaucagcccgccggacccccaucaaaggaagacagugcggagccgacaaggucgguaaagaaaagggacgccucuag

SEQ ID NO: 14473 - RNA, 2259 nt, Artificial Sequence
  Description of Artificial Sequence: Synthetic coding sequence
auggcccgucacuugcugcucccgcugguuaugcugguuaucucgccgauucccggggcuuuucaggacuccgcuuugucuccaacucaagaagaaccagaggacuuggauugcggcaggccugagccuucugcuagaauagucggcgggucaaaugcccaacccggaaccuggcccuggcagguuaguuuacaucacggggguggccauauuuguggugggucccuaauugccccuucguggguucuauccgcagcccauuguuuuaugaccaauggcacccuggaaccagccgcugaguggucuguauuacugggcguccacucucaggauggcccucuggacggggcacauacaagggcuguugcggcuaucguuguacccgccaacuauagccaggucgaauuaggcgccgauuuggcucugcuuagacuggccuccccggcaucucucggacccgcugucuggccugugugccuuccacgcgccucucaccgcuuuguucacggaaccgcuuguugggcaacuggauggggcgaugugcaggaagcagaucccuuaccacuuccuuggguucuucaagaggucgagcugcgacuguugggagaagcuacaugucagugccucuacagccagcccgguccuuucaaucuuacacuucaaauccuaccuggaauguuaugcgcuggauaucccgagggacggcgagacacuugucagggugauucaggcggaccccuuguuugcgaggaaggggggcggugguuucaagccggcauaacauccuuuggauuuggcugcggacggaggaaccggccagguguguuuacugcugucgcuaccuaugaagccuggauuagggaacaggucaugggcuccgagccagguccugcuuucccuacccagccccagaaaacccagucagauccacaggaaccuagggaagagaacuguacgaucgcccugcccgaguguggcaaagcaccccggccaggggccuggccuugggaggcccaggugaugguuccaggcagccgaccaugccauggcgcacucgucuccgaaagcuggguccuggcccccgcaucaugcuuuuuagaccccaauagcuccgacagcccaccccgggauuuagacgcuuggcguguccugcuccccucccgaccucgcgcugagagagucgcuagacucgugcaacaugagaacgcuucaugggauaacgcaagcgaucuggcccuguugcaacuccggacgcccguaaaucugagcgccgcuagccggcccgugugucuuccacaccccgaacauuauuuuuugcccggauccagauguagacucgcccgauggggucggggggagccagccuugggaccuggagcccucuuggaagccgaacuguugggggguugguggugucacugucuauaugggaggcaaggugccgccguaccucugccuggcgacccuccucacgcacuuugucccgccuaccaagagaaggaggaagucggauccugcuggaacgacucacgcuggucguugcugugccaagaggaagggacaugguuucucgccggcauucgagauuuuccauccgguugucuuaggccaagggcauuuuuuccccuucagacccauggaccauggauuagucaugucacuagaggcgcauacuuggaagaccaguuagcaugggacugggggccagacggagaagagaccgagacccagaccugccccccccacaccgaacauggggcuugcggccuacggcuugaagcagccccuguuggaguccucuggccuugguuagccgaggugcacguugcuggggaccgugugugcacuggaauuuuguuggccccaggcuggguacuggccgccacccauugcgucuugagaccaggaaguacaacagugccuuacauugagguuuaucuaggaagagccggcgcuagcaguuugccucaagggcaccagaugacaagugcacccccucucuugugccagaugaccgaaggaucuuggauucuugucgguauggcaguccaaggaagccgagagcuguuugccgccauuggucccgaggaggcauggaucucccaaacuguuggcgaagcuaacuuucugccccccucgggaucaccccacuggcccacuggcgguucaaaccuuugcccaccggaauuagccaaggcauccggcagcccccaugcagucuauuucuugcugcuacugacucuucuuauucaaagcuag

SEQ ID NO: 14474 - RNA, 453 nt, Artificial Sequence
  Description of Artificial Sequence: Synthetic coding sequence
augcgauucauggcaggccccgccgguagccagagucuuggcccacuuugcuuccauucaagcccucaagcuuuauacacuguacuccucaucgugcuuguuaugaugucccuaguguucgggaaguuugugcccguuaacugggaaccuccacagccuuugcccuucccuaaauauuuacgaugcuacagaugccugcucgaaacuaaggaacugggaugcuuacuggggagcgacauaugucugacgcccgcagguagcuccuguauaacucugcacaaaaaaaauagcucaggcagugacgugauggucuccgauuguagaaguaaggagcagaugucagauuguagcaacacccgcaccucucccguuagcggcuuuuggaucuuuucccaguacuguuuucuggauuucuguaaugacccucagaaccgcggccuuuacaccccuuag

SEQ ID NO: 14475 - RNA, 1161 nt, Artificial Sequence
  Description of Artificial Sequence: Synthetic coding sequence
augaaguuucaaggaccacuggcaugcuuacuguuagcucugugucugggcucaggugaagcuggaccucuacagagcggcgaggagaguacaggaacuaauauuggggaagccuugggacacggucugggcgacgcccuuuccgaggggguggggaaagccaucgggaaggaagcagggggggccgcuggcagcaaagugucugaagcccuugggcaaggaaccagagaagcugugggcaccggagugagacaggugcccggauuuggcguggccgaugcacugggaaaucgggugggcgaagccgcacaugcuuuagggaacaccggccacgagauuggucggcaagccgaagacgucauaagacauggggcugacgcggugagagguuccuggcagggggucccuggacacaacggggcuugggaaacuucaggaggacacggcauuuuuggcucccagggaggauuagguggucagggacaagggaacccaggcgggcucggaacaccgugggugcacggauacccagguaauucagccgggucuuuuggaaugaacccucagggggcgccauggggccaggggggaaauggcgggccccccaacuucgggacgaacacccaaggagcgguagcacagcccggcuaugggagugugcgugcaucuaaucagaacgaaggauguacaaaucccccaccaucugggucugggggcgguucuagcaauucaggcggcggcagugggagucaaaguggcucaucaggaucaggguccaauggcgauaacaacaaugguaguucaucaggcgggucauccucuggcucuaguagcggcgggagcagcgggggaucaucugguggcagcaguggcaacucgggaggauccaggggagacuccggauccgaaaguuccuggggcuccucuacuggcucauccagcggaaaucacggaggaagcggcggcggcaauggacacaagccuggcugugagaaaccuggcaaugaagcacgcggaaguggcgagucuggcauacaaaacucugaaacaucuccagggauguuuaacuuugauaccuuuuggaagaauuuuaagucuaaacugggguucauuaacugggaugcaaucaauaaggaccagcguaguucccgaaucccguag

SEQ ID NO: 14476 - RNA, 1995 nt, Artificial Sequence
  Description of Artificial Sequence: Synthetic coding sequence
augaagacaggacuguucuuccuuugccugcuaggcaccgcugcagcuaucccaaccaacgcgagacucuuauccgaucacucuaaaccuaccgccgaaacuguggcccccgacaacacagccaucccaagucugcgcgccgaagccgaagagaaugaaaaagaaaccgccgugagcacagaggaugacucccaccacaaagcugaaaaauccaguguccugaagucuaaagaagagucacacgaacaaagcgcugagcagggcaaguccuccagucaggaacuggggcucaaggaucaagaggauuccgauggucaccuguccgugaaucuggaauaugccccaacagagggaacacucgauaucaaggaagacauguccgagccccaggaaaaaaaacuuagcgaaaauacugacuuucucgcccccggcgucaguuccuuuacggacucgaaccagcaagaaucuauaacaaagagagaggaaaaucaagagcagccuagaaauuauucccaccaucaguuaaauagaucaucuaaacauagccagggguugagagaccaggggaaccaggagcaggaccccaauaucagcaacggagaggaggaagaagaaaaggagccgggagagguaggaacacacaacgauaaccaggaaagaaagacggaacugcccagagaacacgcaaacaguaagcaggaagaggauaauacgcagagugacgacauauuggaggaaagcgaucaacccacacaggugaguaaaaugcaggaggaugaguuugaucaggguaaucaagagcaggaggauaauucuaacgcggagauggaggaggaaaacgcuucuaaugucaauaaacacauccaggaaacagaguggcaaagccaggaaggaaagacaggucuggaggcaauaucaaaccacaaagaaacagaagagaaaaccguuucugaagcacuguuaauggagccgaccgacgacgggaauacaaccccccggaaccaugggguggaugacgauggggaugacgacggcgaugacggggguacagauggcccaaggcauagcgcuagcgaugauuacuuuauuccuucucaggcuuuucuagaagcugaacgcgcacagaguaucgcauaucaucuuaagaucgaggaacaacgggagaaaguacaugaaaacgaaaauaucgggaccacggaaccaggugaacaucaagaagcuaagaaagcugagaauaguagcaacgaggaagagacaucuucagagggaaauaugcgaguccaugcgguggacaguugcaugagcuuccaguguaaacgcggccacauuuguaaagccgaccagcaggggaagccgcacugcguuugccaggacccaguuacaugccccccaacaaagccccuggaccaaguaugcggcacagacaaucaaacuuaugcaaguagcugccaucuauucgccacaaagugcaggcuggaagggacuaagaaaggccaucaguuacagcuggauuacuucggagccuguaaaucgauaccaacauguacugauuuugaaguuauucaauucccccugagaaugcgagacuggcucaagaauauccugaugcaguuguacgaagcuaauagcgagcacgccggcuaucuuaacgaaaaacagcgcaacaaagugaagaaaauuuaucuugaugagaaacguuuguuggcaggcgaccaccccaucgaucuucugcugcgagauuucaaaaagaauuaucacauguacguauaccccgugcauuggcaauuuuccgagcuugaucagcaccccauggauagggugcucacccacucugaacuugccccacuccgcgccucuuuaguuccgauggaacauugcaucacccguuuuuuugaagaaugcgauccaaacaaagauaaacacauuacccucaaggaauggggccauuguuucggcaucaaggaggaagacauugaugaaaaccugcuuuucuag

SEQ ID NO: 14477 - RNA, 420 nt, Artificial Sequence
  Description of Artificial Sequence: Synthetic coding sequence
augggucccgaggcacuaagcucacucuuacuccuauuacuaguugcuucuggcgacgcugauaugaaaggccacuuugaccccgcgaaaugcagauaugcgcuuggcaugcaagauaggacaauuccugauuccgauaucuccgccagcucuaguuggagugacuccacugcugccaggcauucaaggcuggagaguagcgauggcgacggcgccuggugcccugcgggaagcguguucccuaaggaggaagaguacuugcaaguugaucugcagaggcugcaccuuguggcucuugugggcacacaggguagacaugcgggagggcugggcaaagaguuuucuagguccuauaggcuucgguauagcagagauggccggcgguggaugggcuggaaggauagaugggggcaggaguag

SEQ ID NO: 14478 - RNA, 285 nt, Artificial Sequence; identical to SEQ ID NO: 12839
  Description of Artificial Sequence: Synthetic coding sequence

SEQ ID NO: 14479 - RNA, 699 nt, Artificial Sequence
  Description of Artificial Sequence: Synthetic coding sequence
auguugccgaaaagucgcagagcauugacaauucaggagaucgcagcacucgcccguuccucucugcacgguauuucucaaguggucaaggaccacgugacuaaaccaaccgccauggcccaagggagaguggcccaucuuauagaguggaaaggauggagcaagcccagugauagcccagcagcacuugagagcgcuuuuucaagcuauuccgaucuaucugagggugagcaggaagcuagguuugccgcgggcguggccgaacaauucgcaaucgcugaagccaagcugagggcuugguccuccguggauggggaagauuccacugaugacucuuacgacgaagacuucgcuggcggaauggauaccgacauggccggacagcuaccccugggaccacaccugcaggaccuguucaccgggcaucgauuuucacggccuguacggcagggcagugucgaaccagaaagcgacugcucacaaacuguuucucccgacacuuuauguucuucccuuuguucucuggaggauggucuucugggcagcccggcccgcuuggcuucucaacugcucggagaugaacugcugcucgccaagcugccucccucucgagaaagcgcuuuucgcucccuuggucccuuagaggcccaagacucucuuuacaauaguccgcucaccgaguccugucucuccccauag

SEQ ID NO: 14480 - RNA, 2631 nt, Artificial Sequence
  Description of Artificial Sequence: Synthetic coding sequence
augggacccgaggcacugucuuccuuacugcucuuauugcuuguagccucaggcgaugcggacaugaaaggacacuuugacccggccaagugccgguaugcgcuaggaaugcaagaucggaccauccccgauucagacaucucagcaagcucuucauggucagauaguacugcagcuaggcacucucguuuggagagcucugacggagacggcgcauggugcccggcaggaagcguguucccuaaggaggaggaauauuuacaaguggacuuacaaaggcugcaucuggucgcccugguuggaacucaggguagacacgcagggggcuuaggaaaagaguuuucucggucauauagacugcgcuauagcagagacggcagaagguggaugggcuggaaagaccgcugggggcaggaagugauuagcgguaaugaggaucccgaggguguggugcugaaggaccugggaccucccaugguggcaaggcugguucgguuuuauccaagggcugauagaguaaugagcgucugucuucguguagaguuguauggaugucuuuggcgcgacggacuguuaagcuauaccgcaccagugggucagacaauguaucuuuccgaggcgguauaccucaacgauucaaccuacgacggccauaccgugggaggcuuacaauacggcggacuggggcagcuggccgaugggguggugggauuggacgacuuuagaaaaagccaagaacuccgagucuggccuggcuacgauuauguugguuggagcaaucauucuuucucaaguggguauguugagauggaauucgaguucgacagauuaagggccuuccaggcuaugcaggugcacuguaauaauaugcauacucugggcgcccgccugccuggcggaguugagugcagguuuagacgaggcccagcaauggcuugggaaggcgagcccaugagacacaauuuaggggggaacuuaggggaucccagggcccgggccgugucagucccacuaggcgggcguguggccagauuccugcaguguagguuucuauuugccggaccauggcuucucuuuuccgaaaucucuuuuauuagugacguagugaacaauaguucuccggcccucgguggcacuuucccaccugccccgugguggccucccggcccaccaccaacgaacuuuuccucauuggaacuggagccccggggacagcagccuguggccaaggcugagggcaguccuaccgcuauccucaucgggugucuuguugccaucauauugcuuuuguugcugaucaucgcacuuaugcuguggagauugcacuggcgaagacuucugucuaaggccgaaagacguguucuggaagaagagcugacuguacaccuguccguacccggcgacaccauacugaucaacaaccguccuggaccuagagaaccaccccccuaccaggaaccaagaccuagagggaauccaccacacagcgcgccuuguguccccaaugguuccgccuauagcggcgauuauauggagccagagaagccaggcgccccucugcugcccccgcccccacagaacuccgucccucacuacgcugaggcagacauugugacacugcagggagugaccgggggaaacacauacgccgugccagcacucccccccggugcgguuggcgacggacccccucgcgucgauuuuccacgcucuaggcugagauuuaaagagaagcugggcgaaggccaauucggugaagugcaccucugugaaguugauucgccucaggauuuggucagucuggacuucccccuaaacgugcguaaaggucacccucuuuuagucgccgugaaaauucugaggcccgacgcaacgaaaaaugcuaggaaugauuuucuaaaagaggugaagaucaugucucgccuuaaagauccgaauauuaucagacugcugggggucugcguucaagaugauccguuguguaugauuacugacuauauggaaaauggggauuuaaaccaauuucugucugcccaccagcuggaggacaaagcugcagagggcgcuccgggagauggucaagcagcccagggaccgacuauaaguuacccaaugcuccuccauguugccgcacaaauugcuucggggaugagguaucuggcuacacuaaauuucguccaucgugaucuugccacacgcaauugccuagucggagaaaauuucacuauuaaaaucgcugauuucggcaugucuaggaaucuguaugccggggacuacuaucgagugcaaggccgagcgguccugccaauccguuggauggcgugggagugcauucucauggggaaguucacuaccgcaagcgaugugugggcuuucggcgucacccuuugggaagugcucauguugugucgcgcucaaccauuuggccaguugacugaugagcaagugaucgaaaacgccggagaguuuuuucgcgaucagggucggcaaguguaccucagucggccuccggccugcccucagggucucuacgaacugaugcucagauguuggucccgugagucagagcagagaccuccguucucccagcugcacagauuucucgcagaggaugcauuaaacaccguguag

SEQ ID NO: 14481 - RNA, 165 nt, Artificial Sequence; identical to SEQ ID NO: 12842
  Description of Artificial Sequence: Synthetic coding sequence

SEQ ID NO: 14482 - RNA, 2256 nt, Artificial Sequence
  Description of Artificial Sequence: Synthetic coding sequence
auggccuucagaaccaucugcguccucguggguguauucauuugcagcaucugcgugaaaggaaguucucagccccaagccagagucuaccucacauucgaugaauugagagaaacuaaaacuucggaauauuucucccugucccaucauccgcuggauuacaggauauugcucauggacgaagaccaggacagaauauacguuggaagcaaggaucauauucugaguuuaaacauuaauaauauuagucaagaagccuugucaguuuuuuggcccgcauccaccaucaagguagaggaauguaagauggcagggaaagauccaacucaugguugugguaauuuuguaagaguaauucaaacauuuaacagaacucaccuauacgucugcgguuccggugcauucagcccaguuugcacguaucugaacagagggcggcgcagcgaggaucaaguuuuuaugaucgacucuaagugugaguccggaaaaggaagguguucauuuaaccccaacguuaacaccgugaguguaaugaucaacgaggaacucuuuagcggcauguacauugacuuuauggguacugaugcagcuauauuucggaguuuaacuaaacgcaacgccgugagaaccgaucaacauaacagcaaaugguuauccgaaccgauguucgucgaugcccauguuaucccagauggcaccgacccgaaugaugcaaagguauacuuuuuuuuuaaggagaaguuaacagacaacaaccgguccaccaaacagauccacaguaugauagcccgaaucugcccaaaugauacagggggccugcgcucuuuggugaacaaauggacaacauuccugaaggcccggcucgucugcagcguaacggacgaagacggaccugaaacgcauuuugaugaacucgaagacguguuccuguuagaaaccgacaaucccagaacuacucucguuuauggcauauucaccacaucgucuucugucuuuaagggaucagccgucuguguuuaccaccuuagcgauauccagacagucuuuaacgggccuuuugcccauaaagaagguccuaaccaucaacuuauuucuuaucaggggcgcauuccauacccacguccugggacuuguccaggcggagcguuuacucccaauaugaggacaacaaaagaguuccccgacgauguuguaacauucaucaggaaucacccucucauguacaauucaauauauccaauacacaaaaggccacugaucguuagaauuggaacugauuacaaguacacuaagauugcugucgaccgagugaaugcugccgauggcagauaccacguccucuuccucgguacagaucgaggaaccgugcaaaaaguugucguguugccaaccaauaauagcguuuccggcgaauuaauacuggaagagcucgagguauucaaaaaccaugccccaaucaccacaaugaagauaagcucgaagaagcagcagcuauacgucaguagcaaugaaggagugucccaggugagucugcaccggugccauauuuacggaaccgccugcgccgauuguuguuuggcuagagacccuuacugugccugggacggucacagcugcaguagauuuuacccaacugguaagcggagauccaggcgccaggacgugcggcauggcaacccccucacccagugucguggcuuuaauuugaaggcuuacagaaaugcagcagaaaucguucaguauggcgugaagaacaauacaaccuuucucgagugcgcacccaaaucaccucaggcaagcauuaaauggcugcuucagaaagauaaggaucggcguaaggagguuaaauuaaacgagaggauuaucgccacaucccagggguuacuuauacguucuguacaagggagcgaucaaggacuuuaccauuguaucgccacggagaacagcuucaagcaaacaaucgcgaaaauuaacuucaaaguccuagacucggagaugguggccgucguaacagacaaguggucccccuggacaugggcuuccucuguucgugcucugccguuucauccaaaagauauaaugggcgccuuuucucacucagagaugcagaugaucaaccaguauuguaaagauacuagacaacagcaccaacagggggaugaaagucaaaagaugagaggagauuacggaaagcugaaagcacugauaaauagccggaaaagucgaaacaggaggaaccagcugccggagagcuag

SEQ ID NO: 14483 - RNA, 630 nt, Artificial Sequence
  Description of Artificial Sequence: Synthetic coding sequence
augggaccugaagcccugucuagccuguugcuuuuacugcucguggccaguggagacgccgacaugaaggggcacuuugauccugccaaaugcagauaugcacucgggaugcaggacaggaccauuccugacagcgacaucuccgccuccucuuccuggagcgauucaacagcagcuaggcacucaaggcucgaaaguucugauggggacggugccuggugccccgccggaucagucuuuccaaaggaagaagaguaucugcaaguugaucuucagaggcuccaccucguagcccucguggguacacaggguagacaugccggaggccucggcaaagaauuuucccgaagcuacaggcuucgguacucaagggauggacgccgauggauggguuggaaagauagauggggucaggaagugauuuccgggaaugaagauccagaagguguuguguugaaggacuuaggaccacccauggucgcccgacucgugcgcuuuuacccaagagcugauagggucaugaguguuugccugcguguggagcucuaugggugcuuauggcgagaugguuuauugaguuacaccgccccaguaggacagacaauguacuuauccgaagcuguuuacuag

SEQ ID NO: 14484 - RNA, 315 nt, Artificial Sequence
  Description of Artificial Sequence: Synthetic coding sequence
augucugaucuacucuugcugggacugauuggaggucucacacuuuugcugcuucuuacacuccuggccuucgccggcuacucaggucuccuggcuggaguugagguguccgcagguuccccucccauccgcaaugugacaguggcuuacaaauuucacaugggccuauauggcgaaaccggccggcucuucacggaaaguuguucaaucucacccaaacuccgcaguauugccguauacuaugauaacccgcacauggugccuccggauaagugucggugcgccgucgggucaauccucagcgaaggagaguag

SEQ ID NO: 14485 - RNA, 2631 nt, Artificial Sequence
  Description of Artificial Sequence: Synthetic coding sequence
augggcccggaggccuuaagcucucugcuucuccuuuuacucguugcgucuggggaugcugacaugaaaggccauuuugaccccgcuaaaugcagauaugcucugggcaugcaggaccggaccauucccgacucugacauaagcgcuucaaguucuuggucugauuccaccgcugcucggcauuccagacuggagagcucggacggagauggcgccuggugcccggcugguagcguguuuccaaaggaagaagaguaccuucaggucgaccuucagcgacugcacuuaguggcacucguagggacucaggggagacacgccgggggguugggcaaagaguucagucgcaguuacaggcugagauauucucgcgacgguagaagauggaugggauggaaggacagauggggccaggaggucauuucaggaaacgaagacccagagggaguggugcuuaaggauuugggcccaccaaugguggcuagauuggugagauucuacccaagggcagaccgcgugaugagugugugccucagaguggaacucuacgguugccuuuggagggacgggcuguuaagcuacacagccccggugggacagaccauguaccuaucagaagccguguaccucaacgacuccacauaugaugggcacaccguuggaggucugcaauauggagguuugggacaguuggcugacggagucguaggacuggaugacuucagaaagucucaggaguuacguguuuggccaggcuacgacuacguuggguggagcaaccacucauucucuaguggauaugucgaaauggaguuugaguucgaccgacucagggcguuucaggcuaugcagguucauuguaacaauaugcacacgcuaggcgcccgccuaccuggagggguugagugccgguuccgacgagggcccgcuauggcuugggagggggaaccuaugaggcacaauuuggguggcaaccucggcgaucccagagcgagggcaguuagcgugccucuaggaggcagaguggcuagguuccuacagugucguuuccuguuugcugguccaugguugcuuuuuuccgaaaucucuuuuauuuccgacgucguaaacaauucuucaccagcucuaggagggacuuuuccuccagccccuugguggcccccaggcccgcccccuaccaacuucaguucacucgagcuggagccacgcggucagcagcccguggcuaaggcugaagguucacccacugccauucuuaucggaugccucgucgccaucauucugcugcuguuauugauuaucgccuuaaugcucuggaggcuccauuggcgccgauuauuauccaaggcugaacgccggguucuggaagaggaauuaacuguccaccuauccguuccuggcgacacgauucuaauaaauaaucgacccgguccccgagaaccacccccuuaucaggagccacguccgcgcggcaaccccccgcacuccgcucccuguguuccaaacgguagcgcguacagcggagacuacauggaaccggagaagcccggcgcaccuuugcucccgccccccccccaaaauucuguaccccacuaugcugaagccgacauuguaacacugcaaggggugacuggcgguaacacguacgccgucccggcgcuaccgccuggcgcagugggagacggucccccucgcguggacuuuccccgcucccggcuucgcuuuaaggaaaaacuuggugaaggccaguucggagaaguucauuuaugugaagucgauucgccacaagaccugguaucgcucgacuuuccacucaaugugaggaaaggccacccccuccucgucgcagugaagauucuucgacccgaugcuacuaaaaaugcacggaacgauuuucuuaaagaagucaagaucaugucgagauugaaggauccuaacauuauccgccugcugggaguguguguccaggaugauccucuguguaugauuacugacuauauggaaaacggugacuugaaccaguuuuugucugcccaccaacuggaagauaaggcugccgagggagcuccaggcgauggacaggccgcucaggggccaacaauuaguuaccccaugcuucuucacguggcggcccaaaucgcuaguggaaugagauacuuagccacccucaauuucguccauagggaccuggcuacucgcaacugccucgugggagagaauuucacaauuaagaucgcugauuucggaaugagucggaaccuguaugcgggagauuacuauagggugcaaggcagagcagugcugccgauuagguggauggcaugggaguguaucuugaugggcaaguuuacaacagcgucugaugucugggccuucggcgugacacucugggagguacugaugcuuugccgcgcccagccuuucggucaacugacggacgagcaggucauugagaacgccggugaauuuuuuagagaccaagguagacaaguguaucucucgaggcccccagccugcccucagggucuguacgaacugaugcuccgaugcuggucgagagagagugaacagaggccuccguuuucucagcugcauagguucuuagccgaggacgcacuuaauacuguguag

SEQ ID NO: 14486 - RNA, 1053 nt, Artificial Sequence
  Description of Artificial Sequence: Synthetic coding sequence
auggaggccuuugccuugggaccagcaagacgagggaggagaagaacaagagccgccgggucauuacugaguagagcugcaauccugcucuucaucucugccuucuuagugcgagugccauccuccgucgggcauuuagugcgccuaccuagagcauuuagacugaccaaagacagcgugaaaaucgugggaagcaccagcuucccuguuaaagccuacgugaugcugcaucagaaguccccccacguccuguguguuacgcagcagcugagaaacgcugaauugauugauccauccuuccagugguauggcccuaaagggaaaguggugucugagaacagaacagcucaaaucacaucuacagguucgcucguguuucaaaauuuugaggagucaauguccggaauuuauaccuguuucuuagaauauaaacccacugucgaagagaucguaaagcggcuucagcugaaauaugccauuuacgcguaccgagaaccccacuauuacuaccaauuuacagcccgcuaccacgccgccccuuguaacagcauuuacaauauuucuuuugaaaaaaaacugcuccagauucugucgaaacuucugcucgauuuauccugugaaauuagucugcuaaaaagugagugccauaggguuaaaaugcagagagcgggacuacaaaaugagcuguuuuuugcauuuagcguaagcucucucgauacagaaaaaggaccuaaaagguguaccgaucauaauugugagccauauaagaggcuguuuaaggcaaagaauuugauagagcgguucuuuaaucagcagguggaaaucuuaggaaggagagcagaacaguugccacagauauacuacaucgaaggcacccuccagaugguuuggauuaacagauguuucccuggcuacgguaugaaugugcaacagcaccccaaaugcccugagugcugugucaucuguucuccaggcucguauaacccccgugaugguauucacugucuccaaugcaacucuucccucguuuacggagcaaaaacgugcuuauag

SEQ ID NO: 14487 - RNA, 1392 nt, Artificial Sequence
  Description of Artificial Sequence: Synthetic coding sequence
uagcuugcuuuggugcugugcaccguugauucaagaccccccgcucaauuagcucugucccacgcuggccgccugcucgccagcucaacugccgccucagucccuaauacacuuagacuagaacuccgcggcccacaacccagagacgagggcuuuuauucuugcucugccaggucaccucugggucaagcaaacacuucucuagaacugcgucucgagggcgucagagugaucuuggccccggaagccgcagucccggaaggagccccgauuacagugacuugcgcugaccccgccgcacacgcaccuacuuuguauacuugguaccauaacggccgcugguugcaggaaggccccgccgccucucuaaguuuucuggucgcgacucgggcacacgccggagcuuauuccugucaggcucaggacgcucaagguacacgcucgagcagacccgcugcccuucaggugcucuaugccccccaagacgcuguacuuuccucauucagggauucccgggcucgcuccauggcagucauccaauguacgguugauucagaacccccugccgaguuagcacucagccaugacggaaaagugcuggcuaccuccucgggcguucacucauuagcuuccggaacuggccacguacaaguagcucggaaugcacuccgguugcagguccaggacguacccgccggagacgauacuuaugucuguacagcucagaaucuucucggcuccauuucgacgauuggcagauuacagguagaaggcgcgagagucguugccgagccgggccucgauguccccgaaggggccgcgcuaaaucuuucuugccgucuguuaggcgggccggguccagucggcaacuccacauucgcaugguuuuggaacgaucgccgccuccaugcggaacccguaccuacacuugcuuucacacacguggcuagagcccaggcuggaauguaccacugucucgcagagcuucccacaggcgcugcugcuucugcucccgucaugcucagggugcuuuauccucccaaaacgccuacgaugaugguguucguggagccugaaggcggacuucgcgguaucuuagauugucggguugacuccgagccccucgcaagcuuaacucuccacuuaggcagucgccugguggccagcucacaaccacaaggugcccccgcagagccucauauacacguacucgccucccccaacgcacuccgaguagacaucgaagcacuuagacccagcgaucagggggaauacauuugcucagccaguaacgugcucgggagugcuaguaccucaacuuacuucggcguucggggagagggcagagggcugcaccuuccagggcacuccgcacagaaaccaucuuccuag

SEQ ID NO: 14488 - RNA, 1398 nt, Artificial Sequence
  Description of Artificial Sequence: Synthetic coding sequence
augaaguuucagggaccucuggccugccuuuugcuggcucuuugccucggcucuggcgaagccgguccccuccaguccggggaggagaguaccggcacuaauauuggugaagcuuuaggucaugggcugggcgacgcuuuaucagagggcgugggaaaagccaucgggaaagaagcugggggugccgcaggaucgaaagugagcgaagcccuaggccaaggaacucgugaggcagugggaaccggagugcggcaagucccagguuucgguguggcagacgcuuugggcaauagagugggcgaggcggcucacgcucuugggaacaccgggcacgaaaucgggcggcaggcagaggaugucaucaggcacggggcggaugcggugagagggaguuggcagggagugccagggcacaauggagccugggaaaccucgggggggcacggaauuuuuggaagucaagggggccuagguggacagggacagggcaacccgggaggacuugguacacccuggguacaugguuaccccggcaacagugccggaucauucgguaugaauccacagggugccccuuggggucagggaggcaaugguggcccuccaaauuuuggcaccaacacccagggcgcaguggcacaaccgggauauggcuccguccgcgccuccaaucaaaaugagggguguacuaauccccccccauccggcucuggcggcggcucuuccaacucaggcgguucaaguaccggcaguagcucuggaaaccacgguggcagcgguggaggaaacggucacaagccgggcugcgaaaagccaggaaaugaggccagggggucuggagagucuggaauccaaggcuuccgcggacaaggcguuucuucaaacaugagggaaauuaguaaagaggguaacagacugcugggcgguuccggagauaauuaccgcggacaaggcaguucuuggggguccggagggggugaugcuguagggggagugaauacggugaacagugaaacaagcccugggauguuuaauuuugauacuuuuuggaaaaauuuuaagucuaaacucggauucauuaacugggacgcgauuaacaagaaucagguccccccuccaagcacaagggcacugcuguauuucuccaggcuaugggaagacuuuaagcaaaacacacccuuucugaauuggaaagcuauuauugagggcgccgaugcuaguucucugcagaaacgggcaggccgcgacgaucagaacuacaacuacaaccagcacgcauacccuacagccuacgggggaaaauacaguguaaagacuccagcuaagggaggaguguccccaucgucgagugcuucucggguccaaccgggauuauugcaaugggugaaguuuugguag

SEQ ID NO: 14489 - RNA, 2700 nt, Artificial Sequence
  Description of Artificial Sequence: Synthetic coding sequence
augcuguuacuacugcuccuugcaccucucuuucugagaccuccgggcgccggcggugcccagaccccuaacgcuacuucagaaggaugccaaauuauucacccaccuugggagggcgggauuagauauaggggccugaccagagaccagguuaaggcaaucaacuucuugcccguggauuacgagaucgaguauguuugucgaggggaacgugaaguugugggaccgaaagugagaaagugccuugcuaauggaaguuggacugacauggacacaccaucccggugugugaauaggacgccucacucagagagacgcgcgguguauauaggcgcucuguucccaaugagcggugguuggcccggaggucaggccugucagcccgcuguugaaauggcucuagaagacguuaauaguaggagagauauauuaccggacuaugaacuuaaacugauucaucacgauaguaagugcgacccgggccaagccacuaaauaccucuacgaauuauuguacaacgauccuaucaagauuauacuuaugccuggcugcucaaguguaucaacucucguggcagaggcugcacgcauguggaacuuaauagugcugaguuacggcaguucauccccagcuuuaagcaacaggcagagauucccgacguucuuccguacucaccccagugcuacccuccacaacccuacuagaguaaagcuauuugagaaauggggcuggaagaagaucgcuaccauacaacagaccaccgaaguuuucacauccacucuagacgaccucgaggagagagugaaggaagcuggaauagaaauuaccuucagacaguccuucuucagcgacccagcugugccagucaagaauuugaagcggcaggacgcccgcaucaucgugggacuguucuacgagacggaggcuagaaaaguguucugugaaguguacaaggaaagacuguuuggaaaaaaauaugugugguuccugauuggcugguaugccgauaauugguuuaagauauacgauccuucuaucaauuguaccguagaugagaugacugaggcuguggaaggccauaucaccaccgagaucguuaugcugaauccugcgaacaccagaagcauuucaaacaugacgucacaagaauucguagagaagcugaccaaaagacucaaacggcacccagaagagacagggggguuucaggaagccccucucgcguaugaugcaauaugggcacuugcauuggcucucaacaagacaagcggcggcggaggcaggagcggugugcgacucgaagacuucaauuacaauaaccagacaauuaccgaccaaaucuaccgggccaugaacagcucauccuuugagggcguuucaggccacgucguauucgaugcuagcggcucuagaauggcguggacccucauugaacagcuccagggagggagcuacaaaaaaaucggauauuaugacucuacaaaagaugaucuuagcugguccaaaacagauaaguggauugggggcucaccucccgcagaccagacucucguuauuaaaaccuuccgguuccucucccaaaaguuauuuaucagugucuccguguuaucuucgcugggcaucgugcuagcgguagucugcuuaucauuuaauaucuacaacagucacguucguuacauucagaacucgcaaccuaacuugaauaacuuaacagcggugggcuguagccuagccuuggcggcgguguuucccuuaggacucgacgguuaccauaucgggagaaaccaauuuccguucgucugccaggcccgguuguggcugcuuggccuagguuucucccucggcuauggcucaauguucacgaaaaucuggugggugcauacuguauuuacuaagaaagaagagaagaaggaauggcggaagacacuggaaccauggaagcuguacgcuacagugggacucuuaguugggauggacguauugacacuugcuauauggcagaucguugauccgcugcacaggacuaucgagacauucgcuaaagaggaacccaaagaggauaucgacguaaguauucugccacaguuagagcacuguuccucccgcaagaugaauaccuggcuggguauuuuuuaugguuacaagggucuucugcuuuuauuggguaucuuucuggcuuacgaaacuaaaaguguaagcaccgagaaaaucaaugaccaucgcgccguaggaauggcgauuuacaacgucgcgguccucugucuuauaacagcuccaguuacaaugauccucuccagccagcaagaugcugcauuugccuucgcuucucucgcuauuguguucuccagcuauauaacucugguugugcuauucguucccaaaaugagaaggcucauuacgagaggcgaauggcagagcgaggcccaggauacaaugaaaaccggaaguaguaccaacaauaaugaggaggagaaaucccggcuacuggaaaaggaaaaccgggaacuggagaagauaauugccgaaaaagaagaacggguguccgagcugaggcaccaacuccagucccgucaacaguuaagguccagaaggcaucccccgacacccccagaaccaucaggaggauuaccgcgaggcccacccgaacccccagaucgacugaguugugacggaucccgcguccaccuacuuuacaaguag

SEQ ID NO: 14490 - RNA, 381 nt, Artificial Sequence
  Description of Artificial Sequence: Synthetic coding sequence
augugguauguaagcacccgcggcguggcuccacgaguuaauuucgaaggcgcccuguucucuggcuacgcgccugauggaggcuuauuuaugccugaagaacuuccucagcuggacagagggacacugugccaauggucaacccugucuuaccccggccuugugaaggaacucugcgcgcuuuuuaucgggagcgaacuauugccaaaggacgagcugaacgaccuaaucgaccgggccuucucccgauuuagacacagggaagucgugcaccuuuccagauugcgaaacggucuuaauguucuugagcuuuggcacggcguuacguacgccuuuaaagaccucucccucucauguacaacacaauuucugcaauacuag

SEQ ID NO: 14491 - RNA, 147 nt, Artificial Sequence; identical to SEQ ID NO: 12852
  Description of Artificial Sequence: Synthetic coding sequence

SEQ ID NO: 14492 - RNA, 390 nt, Artificial Sequence
  Description of Artificial Sequence: Synthetic coding sequence
auggcagccggaucugccccuaugcaacugcaccuuagagccacaaucaggaugaaagacggauuaugcgucccccgaaaauggaucuaucaccucaccgaaggaagcaccgaccuuagaacugaggggagacccgacaugaagacggaacuguuuucaaguucaugucccgguggcauuauguuaaacgagacugggcaggguuaccagcgauuucuacuguacaaucgauccccacacccccccgagaaaugcguggaagaguucaagagccuuacaagcugcuuagauagcaaggccuuccucuugacaccacgcaaccaaggcaagggacuaaaaagccauaagacggggcucggacugacaaaaagcagcggcgugaccggcuag

SEQ ID NO: 14493 - RNA, 462 nt, Artificial Sequence
  Description of Artificial Sequence: Synthetic coding sequence
augaccauccauauccugauacuuuuauuauuacucgccuuuuccgcucagggagacuuagacacagccgccagacgcggucagcaccagguaccccaacacagggggcacguauguuaccugggagugugccggacucaccgacuggccgagauaaucuacuggaucagaugccugcaccagggcgcuuugggggagggacagccaagggcgccgggaccauugcaguugugggcuccaccaguggcuaggggcgggagcccugccagguuucccggguuccgcccagcagcaagaggguuggcucagugccccgcccguugggugacguccggaacagcucgcccucuucucggcuucagccucccuauuugcaugcuagagcuucuucugcacaucucaucaccuuuaaccccugccccagaaacuguguuucccucucccucgccugguugugacuag

SEQ ID NO: 14494 - RNA, 450 nt, Artificial Sequence
  Description of Artificial Sequence: Synthetic coding sequence
augggguggcugacccggauaguaugucucuuuuggggagugcuccugacagcucgggcaaacuaccagaacgguaaaaauaaugugccccgacuaaaguuaucauauaaggaaaugcuugagucgaauaacgugaucaccuucaaugggcuugcuaauucuuccuccuaccacacauuccugcuggaugaggaacgaucucgccucuacgugggcgcaaaagaccacauauucaguuuugaccuugucaauaucaaagauuuucaaaagaucguuuggccagugucuuauacgagaagggacgaaugcaagugggcagggaaagacauccuuaaagagugcgcuaacuuuaucaaaguacugaaagccuauaaucagacccaucuuuacgcgugcggcaccggcgccuuccauccuaucuguacauacauagaaauuggacaucauuag

SEQ ID NO: 14495 - RNA, 543 nt, Artificial Sequence
  Description of Artificial Sequence: Synthetic coding sequence
auggcagauaugcagaaccuggucgagcgucuggagagagccguggggaggcuggaagcugugucccacacaucagauaugcauagaggcuacgccgauaguccaaguaaagccggcgccgcaccuuacguucaagcuuuugacagccugcuugccgggcccguggcugaauaccugaagauuucaaaggagauugguggagacgugcaaaaacacgcugagaugguucauaccggccugaaguuagaacgcgcccuuuuaguuacagcuagucaaugucaacagccugcugaaaacaaacuaucugaucuuuuggccccaaucuccgaacagaucaaagaggugauuacuuucagagaaaagaauagagguuccaaauuauuuaaucaucugagugcagugagcgaaucuauacaggccuuggguugggucgccauggcccccaaaccuggaccguacgugaaggaaaugaacgacgcagccauguucuacacuaaccggguuuuaaaagaguauaaggacgucgacaagaagcauguauag

SEQ ID NO: 14496 - RNA, 630 nt, Artificial Sequence
  Description of Artificial Sequence: Synthetic coding sequence
augggaccugaagcgcuuuccucacugcugcugcuguuauuaguugcauccggcgaugcagacaugaagggacacuuugacccagccaagugccgguaugcucugggcaugcaggacagaacgaucccugacagcgauauuucagccaguaguucuuggagugauucuacagcugcccgucauucacggcuugaaucuagcgauggugauggugcuugguguccggcaggcuccguguucccuaaagaggaagaauaccugcagguggaccuucagcgccuucaccugguugcucuagucgggacacaggggagacacgccggaggacuuggcaaggaguuuucacguagcuauaggcuuagauauucuagagauggcaggagauggaugggauggaaggaccggugggggcaggaggugaucucagguaaugaagauccugaagggguggugcucaaggaucuugggcccccuaugguggcaagauugguaagauuuuacccccgcgcagaccgugugaugucagugugucuacggguugaguuguacggaugccuuuggagagacgguuuacugucauacaccgcaccgguuggccagacuauguaccucucagaagccguuuauuag

SEQ ID NO: 14497 - RNA, 630 nt, Artificial Sequence
  Description of Artificial Sequence: Synthetic coding sequence
augggacccgaagcucuuagcagccuucuguuacuucuguuaguugccucaggggacgcugacaugaaaggacacuuugauccagcaaagugcagguaugcuuuggguaugcaagaccggacuauccccgauagugacauuucagccucuucuucauggagugauaguacagcagcgagacauucaaggcuagagagcucagacggagacggugcguggugucccgccggcagcguauuuccgaaggaggaagaauaccuccaagucgacuuacagagacuacaucuuguggcuuuagucgggacucagggaagacacgcaggagggcuugggaaggaguuuagccggucauauaggcuucguuauucucgcgauggucguagguggauggguuggaaggauagauggggucaggaggugaucaguggcaacgaagaccccgagggcgucguuuugaaggaccugggaccuccuauggucgccagauuaguccgauucuacccuagggcugauagagugaugaguguuuguuugcguguggaacuguaugguugucuguggcgggauggccugcugucauacacagcaccagucggccagaccauguacuuguccgaagcuguuuauuag

SEQ ID NO: 14498 - RNA, 2631 nt, Artificial Sequence
  Description of Artificial Sequence: Synthetic coding sequence
augggacccgaggcucugucuucacuccugcuguugcuccucguugccuccggggacgcugauaugaaaggacacuucgauccagcuaaaugccguuaugcccuggggaugcaagaccggacuaucccugauucugauauaagcgccuccucuagcuggucugacucuaccgcagcuaggcauucucgacuugaauccagcgauggggauggcgcauggugccccgcagguucuguauuccccaaagaagaagaauaucuccaagucgacuuacagaggcugcaccugguagcucucguagggacacaaggccggcaugcgggagggcugggaaaggaauuuaguagaagcuaccgccugcgcuauagucgcgauggccgcagauggaugggcuggaaggauagauggggacaggaagugaucagcgguaaugaagaucccgaaggaguaguauugaaggaucuggguccccccaugguggcuaggcuaguccguuuuuauccucgggccgaucggguuaugaguguuugcuuacgcguugagcuauauggcugccuuuggcgagacgggcuguugagcuacacugcgcccgugggucagaccauguauuugucugaggcuguauaccugaacgauagcacauaugacgggcacacuguuggaggacuucaguauggcggacuggggcagcucgcugacggcguugugggucuggaugauuuucggaagucccaggagcuucgggucuggccuggauaugacuacguuggcuggucuaaccacucauucuccucaggauacguggaaauggaauuugaguucgaucgcuugagggcauuucaggcuaugcaggugcauuguaauaauaugcauacacuuggagcccgcuuaccagguggggucgagugucgauuucggcgcggacccgccauggccugggagggggaaccuaugagacacaaucugggcgguaaccugggcgacccuagagcucgagccguauccgugccccugggcggccgcgucgccagauuccugcagugccgcuucuuauucgcugggccguggcugcuuuuuucugagaucucguucaucagugacguaguuaauaacagcucacccgcguugggcggaaccuucccccccgcuccaugguggccuccaggcccaccaccaacuaacuucucuagccuugaacucgagcccagaggccagcagcccguugcaaaggccgaagggucuccuacagccauccugauagguugucucgucgccauuauccugcugcugcuguugaucauagcucugauguuguggagauugcauuggcggagacucuuguccaaggcggagcgaagaguccuggaggaggaacuuacaguacaccugucaguccccggcgauacuauucuuaucaacaauagaccugguccccgagagccccccccauaucaagagccccgcccacgcggcaaccccccccauucggccccuugcguccccaauggcagugccuacucaggagacuauauggaaccugaaaaacccggagccccacuccugccuccaccaccacagaacagcgugccgcauuaugcugaagcagauauugugacccuccaaggagugaccggcggaaacacuuaugcuguaccagcgcugcccccaggagcggugggugacgggccccccaggguugacuuuccaagguccaggcuacgguucaaggaaaaauugggagaagggcaguucggugaagugcaucuaugcgagguggacucgccccaagaccuugugucccucgauuucccgcuuaacguccgaaaaggccacccucuuuugguugcagugaagauccuccgcccugaugccacuaagaacgcacgcaacgacuuccugaaagaagugaaaaucaugagccgacuuaaagaccccaauauuauaagacugcuuggcguuugugugcaggacgauccacugugcaugauuacugauuacauggagaauggagaccuaaaccaguuccugucugcacaucaacuggaagacaaagccgccgaaggagcgccuggggauggacaagccgcgcagggccccacuauaaguuacccaauguugcuccauguugccgcacagaucgcauccggaaugcgguaucucgcuacgcucaacuucgugcaccgagaucuugccacacguaacugucucguuggcgaaaauuucacgaucaagauugccgacuuugggaugucacggaaccucuaugccggugacuauuacaggguacagggacgagccguauuaccaaucagauggauggcuugggagugcauccucaugggcaaguucaccaccgccucugacguuugggccuuuggcgugaccuuaugggagguguugauguuguguagagcccaacccuucggccaacuuacagacgaacaagugauugagaaugccggagaguuuuuucgggaucaaggucgacagguguauuugagucggccaccagccugcccgcaggggcuguaugaacuuaugcuccgguguuggucccgugagucagagcagagaccaccauucagccaauuacacagauuccucgccgaggacgcuuuaaauaccguguag

SEQ ID NO: 14499 - RNA, 2103 nt, Artificial Sequence
  Description of Artificial Sequence: Synthetic coding sequence
augcucgccccuuuccuucuccuuuugacucacagcagauccccgcuuagcuucagaccuuguucacaugugccuggggcacucaucgcacagaagccaaugggcucuucucgacuugcugcauuacuccugccccugcuccugaucgucaucgaccucuccgacucugcaggcauuggcuuuagacacuuaccacauuggaauacucgguguccccucgccagccauaccgaugauagcuuuacaggaucguccgcauacaucccuugcagaacuuggugggcauuguucucaacuaagccuuggugugugcgugucuggcacuguagucggugcuuaugucagcaucuauugucgggaggcucagggcugcagcguggauuauuucaccucuuagugcaaaagucgaaaaaaucuucuacguucaaauuuuaucggcgccauaagaugccugcuccugcucaacgaaagcuccuuccuagaagacauuuauccgaaaagagucaccauauuaguauccccagcccggacauuagucauaagggcuugagauccaaacggacucagccuagcgauccagagaccugggaaucccugccccggcucgacucucagcgccauggaggcccagaguuuucauucgaucucuuaccugaggccagagccauccguguuacuauauccagcggucccgaagucaguguacgccugugccaccagugggccuuagaaugcgaggagcuuucaucacccuacgacguccagaaaauagucagugguggacacaccguggagcuaccauacgaauuccugcuuccaugccuuuguaucgaagcauccuaucuucaggaagauacugucagaagaaagaagugucccuuccagucuuggccugaagccuauggcagugacuucuggaagagcguacacuucaccgacuacucccagcacacacaaauggugauggcccuuacacugagaugcccauugaaauuggaagcagcacuuugucagcggcacgacuggcacacuuuauguaaagaccugccuaaugcgaccgcgagggaaucugauggcugguacguccucgagaagguggaucugcauccccagcugugcuuuaaguuuucuuucgguaacucgucucacguugaguguccacaucagacaggcucacuuacgagcuggaauguuucuauggauacccaggcccaacagcugauacuucauuucuccuccaggaugcaugccaccuuuagugcugcuuggucccuucccggccucggucaggacacucuugucccacccgucuacaccgugucccaggcccgugguagcaguccugugucucuggaucuaaucauaccuuuucugcggcccggaugcugcguacuuguuuggcgaagugacgugcaauucgcguggaaacaccuacugugccccgaugucuccuaucggcaccuugguuuacugauucuugcucugcuggcgcuguugacccuucuuggggugguccuggcuuugaccugucgcagaccucagagcggaccuggcccagcgagacccgugcucuuacugcacgccgcugacucagaagcacagaggagacuugugggagcccucgcugagcuguugagagccgcucuaggcgguggacgcgacgucaucguugaccuuugggaaggcaggcacgucgcuaggguugguccacuuccauggcuuugggcagcgaggacucguguagcccgggaacaggggaccguguuacuccuuuggagcggagccgaccuuagacccguaagcgggccugauccgcgugcugccccacugcucgcacuccuccacgccgcaccaagaccccuucuucugcuggcauacuuuucucgacuaugcgccaaaggcgacauccccccuccacuccgcgcgcucccaagauaccgccugcuccgcgaucuuccuagacugcucagggcucuggacgcucggccuuuugcggaggccacaagcuggggucgccugggcgccagacaaagacgccaaagcagguuagaacuuugcuccagacucgagcgugaagccgcacggcucgcugaucugggcuag

SEQ ID NO: 14500 - RNA, 1194 nt, Artificial Sequence
  Description of Artificial Sequence: Synthetic coding sequence
augagaucauuauuguugcuuucagcuuucugccugcuugaggcugccuuagccgcggaagucaagaaacccgccgccgcagcugcuccaggaacugccgaaaaguuaaguccuaaggccgccacauuggccgagcguucagcuggccucgccuuuuccuuauaucaggcaauggccaaagaccaggccguagaaaauauucugguaucacccguagugguugcuucuucauugggcuuggucucacugggagguaaagcuacuacugcuucccaggcaaaggcugugcuguccgcagagcagcuccguaauguuacauggaaauuaggaucaaggcucuacggcccuuccucugugucauucgcggaugacuucguucgaagcuccaagcaacacuacaacugcgaacacagcaaaaucaacuucagagauaagcgauccgcucuucagaguauaaacgaaugggccgcucagacuacugacgggaaacucccugaaguaacuaaggaugucgagcggacagacggcgcgcugcugguaaacgccauguuuuucaagccccacugggaugagaaguuucaccacaagauggucgauaaucggggauuuauggugacaagaaguuacaccgugggcguaaugaugaugcaucgcacaggcuuauacaauuacuacgacgaugaaaaagaaaaacugcaaauugucgaaaugccguuagcccacaagcuuagcucacuuaucauucugaugccucaccacguagaaccccuggaaagguuggaaaaacuauuaacaaaggagcagcugaaaauauggauggguaaaaugcagaagaaggccguggcuaucucacugccuaaaggcguaguggaggugacacaugacuuacagaagcaccucgccggguuaggacucacugaagcaaucgauaagaauaaggcugaccugagcagaaugucugggaagaaggaucuguaucuggcuagcguguuucaugcaaccgccuucgagcuugauacugacgguaauccuuucgaccaggauaucuauggccgggaagaacugcgaucacccaaauuguucuaugcugaccacccuuucauuuuucuuguuagagauacccagagcggcaguuugcucuucaucggacggcuggugcgcccaaaaggagauaagaugcgcgaugaacuguag

SEQ ID NO: 14501 - RNA, 612 nt, Artificial Sequence
  Description of Artificial Sequence: Synthetic coding sequence
auggcagauaugcagaaucucguagagcgacuugagagggccgucggcagacucgaagcugucucccacacaagcgacaugcaccgaggauacgccgauucccccagcaaagcuggagccgccccuuauguccaggcauuugacucccuacucgccggcccggucgcagaauaccucaagauauccaaagaaauugguggugacguccagaaacaugccgaaaugguucacacgggccucaaauuagagcgggcgcugcuggucaccgcgucucaaugucagcaacccgcagagaauaaguugagugaccuccuggcucccaucuccgagcaaauaaaagaagugaucacuuuuagggagaaaaauagaggcuccaaacucuucaaccaucuuuccgccguuucagagagcauccaggccuuaggauggguagcuauggccccuaaaccuggcccuuauguaaaagaaaugaacgaugcggccauguucuacaccaaccgggugcugaaagaauauaaggauguggacaagaaacacgucgacuggguaaaagcauaccuuucaauuuggaccgaauuacaagcauacaucaaggaauuucacacuaccuag

SEQ ID NO: 14502 - RNA, 1293 nt, Artificial Sequence
  Description of Artificial Sequence: Synthetic coding sequence
augagaaagcugaugaaacaagugcaagagcagugcccgaauauaacucgcaucuauucuaucggaaaguccuaucagggacugaagcuauacgugauggaaaugagugauaagccuggagaacaugaacucggagaaccugaaguuagguauguugcaggaaugcacggaaacgaagcccuaggaagggagcuccuucugcuucugaugcaguuuuuaugccaugaguuccuccguggaaauccgcgcgucaccagacuccucucugagaugcguauucaccuguuaccuucaaugaacccagauggcuaugaaauugcuuaccaucgcgggagcgaguuaguugggugggcagagggccgcuggaauaaccaaucgauagaucuuaaccauaauuuugccgacuuaaauaccccucugugggaagcucaagacgacggaaaggucccucacaucgugccaaaucaucauuuaccuuuaccgaccuacuacaccuugccaaacgccacaguugcccccgagacacgagccguaaucaaauggaugaagcguauacccuuuguguuaagugccaaucuacauggaggcgagcugguugucuccuaccccuuugacaugacuagaacaccaugggcugcgcgggaacugaccccuaccccagacgaugcggucuuucgcugguuguccacgguguacgcuggcuccaaccuggcuaugcaagacacaagccgacggccuugucauucucaagacuuuucaguccacggcaauauuauuaacggagcagacuggcacaccguccccggcucaaugaacgacuuuucuuacuuacauaccaacugcuuugaagucaccguugaacucucuugugauaaguucccucaugaaaacgagcuuccccaggaaugggagaauaacaaggacgcccugcugacauauuuagaacaaguucgaaugggcauagccggcgugguccgugacaaagacacggagcucgguauugcggaugcaguuauugccguggacggaaucaaucacgacgugaccacugccuggggaggcgacuacuggagacuucuuacucccggcgacuacaugguuaccgcaagcgccgagggguaccacucagugacccguaacuguagagugacguuugaagaggguccguuuccuugcaacuucgugcugaccaaaacgccaaaacagagauugagggaacugcuggcugccggggcuaaggucccuccagacuugcggaggagguuagaaagacucaggggacagaaggacuag

SEQ ID NO: 14503 - RNA, 1680 nt, Artificial Sequence
  Description of Artificial Sequence: Synthetic coding sequence
auguggacaaacuucuuuaagcucaggcucuucugcugucuucuggcuguacuuauggucguaguccuugucaucaacgucacccagguugaguaccuggaucaugagacagucuccgccacuuucaucgacuccucuggccaauucgugucuagccaaguuacagguauuuccaggaaucccuauuguggguacgaccaacaaacccucuccucucaggaacgcauggaagaagacucccuucuggccgcccugcacaggcaggugcccgacgucggaccaguacccuucguuaaaucuacagauccgagcucauccuauuucgugauucugaacucugcagccuucuucaagguuggaucacaauuggagguguugguucacgugcaagacuuucagcgcaaaccaaagaaguacgguggugauuaccuucaggcacggauucauucacugaagcuacaagcaggcgcgguaggccgcgucguggacuaucagaauggauucuauaagguuuucuuuacacuccucuggcccggcaaaguuaaaguuagcgugucucuuguucauccaucugagggcauacggguguuacaaaggcuccaagaggauaagcccgacagagucuauuuuaaaucccucuuccgaagcggacggauuucggagacaacagaguguaacguguguuuaccaggcaaucucccccuuugcaauuucaccgacuuguauaccggggaaccaugguuuuguuucaaaccuaaaaagcucccuugcuccucccggaucacccauuucaaaggagguuaucucaagggucucuuaacagcagcugagagugcuuuuuuccaaucggggguaaauauuaaaaugccggucaauucuucuggccccgacuggguuaccguuaucccgcgccgaauuaaagaaacgaacucucuugagcugucccaagguagcggaaccuuucccucaggauacuauuauaaagaccaguggagaccucgcaaauuuaagaugcgacaguucaaugacccugauaacauaacagagugccuacaacggaaaguggugcauuuauuuggcgacuccaccauacgacagugguucgaauaccugacaacuuuugucccggaucuggucgaguucaaucucgggucaccuaaaaauguaggccccuuccuugcaguugaccagaagcacaacauacuucucaaguaccgaugucacggcccgccaauucgguuuacuaccguuuucagcaaugaacugcacuauguggccaacgaacucaacggaaucguugggggcaagaauacugucgucgccauagcuguguggucccauuucaguaccuuuccccuggaaguguacauuagacgccugcggaauauaagaagggccguugugcgccuguuagaucguaguccaaagacgguggugguuaucagaacagcaaaugcccaggagcuagguccagaagucucacuguuuaacucugacugguacaauuuucaauuggacaccauccuucgccgcauguuuuccgguguugggguauacuugguugacgcuugggaaaugacucuugcccacuaucuuccgcacaaauuacauccagaugagguaauuguaaagaaucagcuggacauguuccugucguuugucuguccacuggaaacauag

SEQ ID NO: 14504 - RNA, 8199 nt, Artificial Sequence
  Description of Artificial Sequence: Synthetic coding sequence
auggagcagaccgauugcaaaccuuaccagccccuccccaagguuaagcaugaaauggacuuggcuuacacaucuuccagugaugagagugaagacggacggaaaccacgccaaucauacaauagccgugagacccugcacgaguacaaucaagaacugaggaugaacuacaacucacagaguagaaagcgcaaggaagucgaaaaaagcacucaggagauggaauuuugugaaaccucucauacacuauguagcggcuaccagacggauaugcacaguguuaguaggcauggcuaccagcuggagaugggaucugacguggauaccgagaccgaaggcgccgccucaccagaucaugcccuccgcauguggaucagaggaaugaaguccgaacauaguucaugucucucaucacgcgcaaauuccgcccugucccucaccgacaccgaucaugaaagaaaaagcgauggagaaaacggauucaaguuuaguccgguuugcugcgauauggaagcccaagcggggagcacgcaggaugugcagaguucuccccauaaucaauucacuuuucggccccucccgcccccccccccaccaccccacgccuguacaugcgcacgcaagccgccaccagccgcagacucucuccaacggcgaucuaugacgacucgcagucagcccuccccugcagcgccagccccucccacaucaacacaagacucuguacaucugcacaauuccugggugcuaaacuccaauauaccucuggagacacgacauuuccuuuucaagcacggaagcggcucuuccgccauuuucucugcagcuagucagaacuacccccuaacaaguaacacugucuacuccccaccucccaggccccuuccucguuccaccuuuagcaggccagcuuuuacuuucaauaaaccuuacagaugcugcaauuggaaguguacugcgcugucagcgaccgccauuaccgucacacucgcccucuuguuggccuauguaauugcuguacaucucuuuggacugacuuggcaguugcagccaguugaaggugaacuuuacgcuaacggagucaguaaaggaaauagaggcacugaaagcauggauaccacguauagccccauuggcggaaagguuuccgacaaaucugaaaagaagguguuccagaaaggacgggcaauagauacaggagagguggacauaggagcucaggucaugcagaccauuccgccagggcuuuuuuggagauuucagauuacaauccaucaccccaucuauuuaaaauucaacaucucccuggcgaaggacucccuacuuggaaucuacggaagacggaacaucccacccacacacacacaauucgauuucgugaaacugauggaugguaagcagcuggugaaacaagauagcaaagguucagacgauacacaacauagcccccgcaauuugauacugacuagucuacaggaaacaggguuuauugaauauauggaucaggggccaugguauuuggcauucuacaaugauggcaagaaaauggaacagguguuuguuuuaacgacagccauugaaaucauggacgacugcucgaccaacuguaacggaaauggugaguguaucucaggccacugccacuguuuuccuggauuccucgggccugauugcgcaagagacaguuguccaguucucugcggagguaacggggaauacgaaaagggacauugugugugcagacaugguuggaaaggcccagagugugacguuccugaagagcaauguauugauccgaccuguuucggacacgggacuuguauaaugggggucuguauauguguucccggcuacaaaggagaaauuugugaggaggaagacugucucgauccgauguguuccaaucauggcaucugugucaaaggcgaaugccauugcagcaccggguggggcggagugaacugugaaacgccgcuuccagucugccaggagcagugcucaggccacggaaccuuuuugcucgaugcaggcguuuguucuugugaucccaaauggacuggcucagauuguucaacagaacugugcaccauggagugugguucccacgguguuuguuccagagggauaugucaaugcgaggagggaugggucgggccgacaugcgaggaaaggaguugucacagucacugcaccgagcauggccagugcaaggauggaaagugugaaugcagcccaggcugggaaggggaccacuguaccauugcucacuaccuggaugcuguucgcgauggaugccccggucucugcuuugggaacgggaggugcacuuuggaccaaaacggauggcacuguguuugucaagugggcuggucagguaccgguuguaauguugucauggaaaugcugugcggggauaaucuugauaaugauggggacggccucacagauugcguggacccagauuguugucagcaauccaauuguuauaucuccccccuuugccaagggucuccugauccccuagaucuuauacagcagucucaaacacuguucagucagcauacuucccggcuguuuuaugaccgaauuaaguuccugauagggaaagauagcacacacgucaucccgccugaggucucuuucgacaguagacgagccugcgugauccguggccaggucguggcaaucgauggcaccccacuagugggagucaacgucucauuucuucaucauuccgacuacggauucaccauuucccgacaggauggaucuuucgaucuaguagcaaucggcgggaucucagucaucuugaucuuugaccgauccccuuuucugccagagaagcgcacacugugguugccuuggaaccaguucauuguuguagagaaggucaccaugcagagagucgucucugaucccccuucuugcgauaucaguaacuucauuagucccaacccuaucguucucccaucccccuuaacuucguuuggcggcagcugccccgagagaggcacaaucguuccagaauugcaaguggugcaggaggagauucccaucccuagcuccuuuguacgccuguccuaccuuucgucucgaaccccaggauacaaaacacuucuuaggauucuccuuacacauucuacaauuccagucggcaugauuaaaguccaccuuacaguugcgguugaaggucggcucacucaaaagugguucccagccgccauaaaccugguguauaccuuugccuggaacaagaccgacauuuauggucagaaaguguggggccuggccgaagcuuuggugucagucgguuaugaguacgagaccugcccagacuucauauugugggaacaaagaaccguggugcuccagggcuucgaaauggaugccaguaaucuggguggauggagucucaauaagcaucauauuuuaaauccacagucagguauaauucauaagggcaacggagagaacauguucauuucucagcagccaccggucauuaguacuaucaugggaaacggacaccagagauccguagccuguacaaauugcaacgguccagcgcauaauaauaaacuguuugccccggucgcccucgccucagguccagauggaucaguguacgugggagacuuuaauuuuguuagaagaaucuuucccucaggcaacucggucucaauacuggagcuuagaaaccgcgauaccagacauucaacguccccagcucacaaguauuaccuugcaauggacccaguaucagagucauuguaucuuagcgacaccaauacccggaagguguauaagcuuaaaucccuuguggaaaccaaagaccuuuccaaaaauuuugaggugguggcaggcacaggugaccagugcuuaccauuugaccagucacauugcggggauggaggaagagcuucagaagcgaguuugaacagcccccgggggauuaccguggaucggcacggcuuuaucuacuucgucgacgguacuaugauacgaaaaauugaugaaaacgcaguaaucacaaccgugauugggucuaauggguugacuagcacccaaccucucucuugcgauucuggaauggacauaacccaggucaggcucgaguggccaacugaucuagcugugaacccuauggacaauagccuguauguucucgacaacaacaucguacuucaaauaucugagaacagacgaguacggauuauagcuggcaggcccauacacugucaggucccgggaauugaccacuuuuuagucaguaaaguugccauccauagcacccucgagagugcaagagccauuaguguuagccauuccggucuucucuuuaucgcggagaccgacgaacggaaggugaauagaauccagcaggugacgacgaacggggagauuuauauuauugcaggcgcacccacugacugugacuguaagaucgaucccaacugcgauuguuucucaggagaugggggcuaugcgaaagaugccaaaaugaaggcaccauccucauuggcuguuucccccgacggaacucuuuacguggccgaccugggcaaugugcguauuaggacuauuagcagaaaucaagcucaucugaaugacaugaauaucuaugaaauagcuagcccagccgaccaggaacuguaccaauuuacugugaacggcacgcaccugcauacucuuaaucucaucacuagggauuacguguauaauuucacuuauaauagcgaaggcgaccucggagcaauuacuuccaguaacgguaauucgguccacauuaggcgagaugcuggcgguaugccccuguggcuggucguuccugguggacaggucuacugguugaccauaagcuccaauggagugcugaaacgcgugucagcucaaggauacaacuuagcuuuaaugacguacccugguaauacuggccugcucgcaacgaaaaguaaugaaaacggguggacgacuguguacgaauacgauccugagggccaccugaccaaugcaacguucccaacaggugaggucagcucuuuucacuccgacuuagaaaagcugacuaaagucgaauuggauaccucuaacagagagaauguacugaugucaacuaaccugacagccacuuccacaaucuauauucuuaaacaagaaaacacacaaucuacguaccgcgucaaucccgauggcucucugcgggugacuuucgcuucgggaauggaaauuggccuuucauccgagccccauauccuugcgggggcgguuaacccaacccuagguaagugcaacaucuccuugcccggugagcacaacgccaaccuaaucgaauggagacagagaaaggagcagaacaagggaaacgugagcgcuuuugagagaagacuucgagcccacaacaggaaucugcugagcauugauuucgaccacauaacccgcacuggaaaaauuuacgacgaccaucgcaaguuuacucugagaauucuuuaugaucaaaccggacguccuauucuuuggucccccgugucacgcuacaaugaaguaaacauaacuuacucaccgucaggccucguaacuuuuauccagagaggcaccuggaacgaaaagauggaguaugaccagagugggaagauaauaagccgcaccugggcugacggaaagaucugguccuacacauaccucgaaaaaagcgugauguugcugcugcauagucagagaagauauauuuucgaguacgaccaaccagauugccugcucucugugacuaugccuucuauggugagacacucgcuccaaacuaugcugucaguggguuauuaccgcaacaucuacacgccuccagacucauccacuucauucauucaggauuacucgcgcgauggucgccucuuacagacucuacacuuagguaccggccgaaggguucucuacaaguacaccaaacaagccaggcuguccgaaguacuguacgauaccacccaggucacccuuacuuaugaagaauccagcggcgugauaaagaccauccauuugaugcacgacggguucaucugcacaauaagauauagacagacaggaccucucauaggccggcagauuuucagauucagcgaagaaggacuagugaaugcgcgauucgauuauagcuacaacaauuuucggguaaccuccaugcaggccgugaucaacgagaccccgcugccuauagacuuguaucgcuacguggaugugucugggaggaccgagcaguuuggcaaauuuuccgugauuaauuaugacuugaaccaaguaaucacaacaacaguuaugaaacacacuaaaaucuucuccgcgaacggucagguaaucgaggugcaguacgagauccugaaagcuaucgcuuauuggaugaccauucaguaugauaacgucgggaggaugguuauuugugacaucagaguugggguggacgcuaacaucaccagauauuuuuacgaguacgaugccgauggccaauugcagaccguaagcgugaacgacaagacacaguggcguuauucauaugaucuaaauggaaauauuaaccuacuuucccacgguaagagugccaggcucacaccccuuagauaugaccugcgagaucggaucacucggcuuggcgaaauccaguauaaaauggaugaagacggguuccucagacagcggggaaacgauauauuugaguauaauucgaacgggcuacugcagaaagcauauaacaaggcuuccggcuggacgguacaguauuauuaugacgggcucggucgucgcguugcuaguaagucuucacucgggcaacaccugcaauucuucuacgcagacuugacaaauccgauacgcguuacccaccucuacaaucacacuagcucugaaauaacaucucucuauuacgaccugcagggacaccucauugccauggagcuuagcaguggggaagaauacuauguagcaugcgauaacacagggaccccuuuggcaguauuuucauccagaggacaggucaucaaggaaauucuguacacccccuauggcgauauauaccaugacaccuauccagacuuccaaguaaucauaggguuccauggaggccuauacgauuuucugacuaaacuggugcacuugggacagagagacuaugauguagucgcaggccgguggacuacccccaaccaucacauuuggaagcagcuaaaccuacuaccuaagccauuuaacuuguacucuuucgaaaacaacuauccgguggguaagauacaggauguagccaaauacacaacagacauucguagcuggcuggaauuguucggcuuucaacuucacaacguccucccuggguuuccuaagcccgagcuggaaaaucuugaacucaccuaugaauuguugcgguugcagaccaagacgcaagaaugggaucccggaaagacaauauuggguauccagugugaacuucagaagcaguuaagaaauuuuauuucccuggaucaguugcccaugacuccuagauacaaugacggcagguguuuggaagggggaaagcaaccgagauucgccgcuguucccucgguguuugguaaagggauuaaauucgccauuaaggacggcauagugacagcagauauuauaggcguggcaaaugaagacucgcgacgcuuagcagccauucucaauaaugcacacuauuuggagaaccugcauuuuaccaucgaaggaagagauacucacuauuucauuaaacugggcucccuggaagaagacuuggugcugauaggaaauacagggggcaggcgcauucuagaaaacggcgugaaugugacggugucacagaugacuucagucuugaacggaagaacuaggagauuugcagacauucaacuacagcacggcgcucugugcuuuaacauccgguauggcacgacuguugaggaagagaaaaaucacguucucgaaaucgcuagacaacgugcuguugcccaggcauggacaaaggagcaaaggagauuacaggagggagaggagggcaucagggccuggacagagggcgaaaaacagcagcugcucucuacgggaagggugcaaggguaugauggauacuuuguucugagcguggaacaauaccuggaauuauccgauagugccaacaacauccauuuuaugcgccagagugagauugguaggagauag

SEQ ID NO: 14505 - RNA, 264 nt, Artificial Sequence; identical to SEQ ID NO: 12866
  Description of Artificial Sequence: Synthetic coding sequence

SEQ ID NO: 14506 - RNA, 1233 nt, Artificial Sequence
  Description of Artificial Sequence: Synthetic coding sequence
augagagccugcauuagucugguucuugccguguuguguggccuggcaugggcagggaaaaucgagucaugugccucuagauguaaugagaaguucaaccgggacgccgccugucaaugugaucgcagauguuuauggcacgggaauuguugcgaggauuaugaacauuuaugcacugaggaccauaaagagagugagccucugccacaacuugaggaggagacagaagaagcguuagccuccaaucuuuacagcgccccgacgucgugccaaggucggugcuacgaggcuuuugacaaacaucaccagugucacugcaacgccaggugucaagaauucggcaacugcuguaaagacuuugaaucccuguguagugaccacgaaguaucucacagcuccgacgcuauaaccaaagaagagauccagaguauaucagagaagaucuaucgagcagacacgaacaaggcccagaaggaggacaucgugcuaaacucccaaaauugcaucucgccauccgaaacuagaaaucaagucgaucgcuguccuaaaccacucuuuaccuaugugaacgaaaaacuguuuuccaagcccaccuaugcggccuuuauuaaccuccuuaacaauuaucagagggcuacaggucacggagaacauuucagugcgcaggaacuggcagagcaagacgccuuucuuagggaaauaaugaaaacagcugugaugaaagagcucuacaguuuucugcaucaccagaacagguauggaucggagcaagaguuuguggaugacuuaaaaaauaugugguuugguuuauacucuagaggcaacgaggagggagacucauccgguuuugagcaugucuuuucaggcgagguaaagaaggguaaggugaccggauuucauaauuggauaagguuuuacuuggaagaaaaggagggacuggucgacuauuacucccacauauacgacggccccugggauucauacccugacgugcuggcuaugcaguuuaauugggaugguuacuacaaggaaguuggcuccgcauucauagguucuagcccugaguucgaguucgcauuauacucacuuugcuuuaucgcaagaccggggaaagugugucaguuaucacugggcggcuacccccuggccgugagaacguacaccugggacaagagcaccuaugggaauggaaaaaaauacauugccaccgcuuacaucgucaguucaacauag

SEQ ID NO: 14507 - RNA, 351 nt, Artificial Sequence
  Description of Artificial Sequence: Synthetic coding sequence
auggcagcgggaagugcaccuaugcagcugcaucugcgagcuacaauccgaaugaaagauggucucuguguuccccggaaauggauuuaucaucucacagaagguucaacugaccuacgaaccgagggucgaccagauaugaaaacagaacuguucucauccaguuguccuggcgggauuaugcucaacgagaccggacagggguaccaaagguuccucuuguauaacagauccccacauccaccagaaaaaugcguugaggaguucaaaucgcuaacuagcugucucgauuccaaagccuuucuccuuacaccaagaaaccaggaagcaugcgaacugucaaauaacuag

SEQ ID NO: 14508 - RNA, 1200 nt, Artificial Sequence
  Description of Artificial Sequence: Synthetic coding sequence
augucugcccguggucggugggaaggcgggggccggcgggcuugccgcggcagucugggacuggcaagggcccagggcgcugaacgagucacuaguucagaacagcgacccgccauggcgucuuuaggucuccuucuccuguuacuccucacagcacugccuccucuguggucauccucccuaccaggucuggauacugcugaaucuaaggccacaaucgcugaucucauccugucugcccuggagagagcaacaguauuccuugagcagagguugcccgagaucaaccuagacggcauggugggcguuaggguccuggaggaacagcuuaagagugucagggagaaaugggcucaggaacccuuacuucaaccccuaucccugcggguuggaaugcuaggggagaagcuagaggccgccauccaacgcucacugcacuaucucaaauugucagaucccaaauaccugcgcgaguuucagcuuacucuucaacccggcuucuggaaguugccccaugcauggauacacacugaugcuagccuaguguacccgaccuucgguccccaggauuccuuuucagaagagaggagcgauguaugcuugguacaguuacugggaacgggcacagacagcucagaacccugugggcucucugaucuguguaggagccuuaugacuaaacccggcuguuccggcuacugucugagccaccaguuguuauuuuuucucugggcucgaaugagaggauguacucagggaccacugcaacagagccaagacuacauuaauuuauucugugcgaauaugauggacuugaaccgccgugcagaggcaaucgguuaugcuuauccuacacgggacaucuucauggaaaauauuauguuuugugguauggguggguucucugacuuuuauaaauugcgcuggcuggaagccauccuuucauggcaaaagcagcaagagggcuguuucggugaacccgaugcugaggaugaagaacuuuccaaagcaauacaauaccaacaacacuucucaagacgggucaagagaagggaaaaacaauuucccgacggcugcucaucucacaauaccgcgacugccgucgccgcccugggaggcuuccucuacauccuugcugaauaccccccggccaaccgcgaaccucaccccucgacuccgcccccuccaucuaguagguag

SEQ ID NO: 14509 - RNA, 510 nt, Artificial Sequence
  Description of Artificial Sequence: Synthetic coding sequence
augcucuccucagugguuuuuuggggccugauagcauuaauagggacauccagaggcagcuauccuuucagucacagcaugaaaccacaucugcacccaagacuuuaccaugguuguuacggagauauuaugacaaugaagacuaguggcgccaccugugaugcuaauaguguaaugaacuguggcauuagagguuccgaaauguuugcagaaauggauuuacgggccauaaagcccuaucagacauugaucaaggaaguaggacagagacacuguguggauccggcggugauugccgcuauuauuucuagggagagucacggggggagugugcuucaggacggaugggaucauagaggccugaaguuuggguugaugcaacuggauaagcaaaccuaccacccuguuggugcaugggauuccaaagagcaucuaucacaggccacggggauacuuacggaaagaaucaaggcaauucagaagaaauuuccuaccuggaguguggcuuag

SEQ ID NO: 14510 - RNA, 468 nt, Artificial Sequence
  Description of Artificial Sequence: Synthetic coding sequence
augacuagucucaaauguggugagaaccuguacaugucauccgcuuccaguucauggucacaagcaauucaguccugguucgaugaauauaacgacuuugacuucggugucgguccuaagacucccaacgccguugugggccacuauacacaggucgugugguauagcaguuaccuuguaggcugcggcaacgccuauuguccaaaucaaaaggugcugaaguauuauuauguaugucaauauugucccgcggggaauugggccaacaggcuguacgucccauaugagcagggagcuccuugugccuccugccccgauaacugugaugauggucuuuguacaaacgggugcaaauaugaagaucuguacuccaauuguaagucacuaaaguugaccuugacauguaagcaccagcuagugagggacagcugcaaagcaucaugcaacugcucuaacuccaucuacuag

SEQ ID NO: 14511 - RNA, 2886 nt, Artificial Sequence
  Description of Artificial Sequence: Synthetic coding sequence
auguuguuacuccuccuguuggcaccacuguuucugcguccaccuggagcaggcggagcccagacccccaacgcuacuagugagggaugccagauuauucaccccccaugggaaggcggaauuagauaccgcggccugacgagagaccaggugaaagcuauuaauuuccuccccguggauuacgaaaucgaauacgucugucgaggcgaacgggagguugucggacccaagguuagaaagugccuggcuaauggaucauggacugauauggauacccccucuagaugugugaggaucugcagcaaaagcuacuugacacuggagaauggcaaaguguuucugacgggaggagaucugccggcacuagacggggcgcgcgucgauuuuaggugugacccugacuuucacuuagugggcagcagccgcucaauuugcucacagggccagugguccacacccaagccccauugccaggugaacaggaccccucacuccgaacgucgugcugucuauaucggugccuuauuccccaugagugguggcuggcccggcggacaggcaugccaaccggccguagaaauggcucuggaggauguuaauucuagaagagauauacuuccugacuaugaacuuaaauugauccaccacgauagcaaaugcgauccaggccaagcuacaaaauaucuguacgagcugcuuuacaacgacccuauuaagauuauucucaugcccggauguaguucuguaucuacucugguagcagaagccgcucgcauguggaaucucaucguccuuucuuaugguucaagcucacccgcucugaguaacaggcaacgcuucccaacuuuuuuccgcacccauccuagcgccacacugcauaacccuacccgggucaagcucuucgaaaaguggggauggaaaaaaauugcaaccauucagcagacaacugaaguuuucacuagcacacuugacgauuuggaggaacggguuaaagaagcuggaaucgaaaucacguuuagacagucguuuuuuucugacccagcggugccugugaagaaucuaaaacggcaggacgcaaggauuauaguuggguuauuuuaugaaacagaagcccggaaaguguuuugugagguuuacaaagagagacucuucggaaagaaauacgugugguuccugaucggcugguacgcggauaacugguuuaaaauuuaugacccuaguauuaacugcacaguggacgaaaugacugaggcuguagaaggucauauuacgacagagaucguuaugcucaacccugcaaauacccgauccauuuccaacaugaccucccaagaauuuguagaaaagcugacgaaacgccucaaacggcauccagaagaaaccggcggauuccaggaggccccucucgcguacgacgcuaucugggccuuggcuuuggcacugaauaaaaccagcggugguggcggaagaucuggcgugagguuggaggacuuuaauuacaauaaccaaacuauuacugaucagauuuaucgcgcaaugaauuccagcuccuucgagggcguuaguggccacguagucuucgacgcuuccgggucucgcauggcuuggacgcucauugagcaguugcagggagguucauacaaaaaaauaggauacuacgacaguacuaaagacgaucuuaguugguccaagacggacaaauggauaggcggauccccacccgccgaucagacccuggucauaaaaaccuuuagauuuuuaucacagaaauuguuuauuagugucagugugcucucuucucugggaauuguccuagccguuguuugucuguccuuuaauauauauaacucccacgugcgguauauccagaauagucagcccaacuugaacaaucuuacggccguagguuguagucuggccuuagcggcaguuuuuccccucggacuugauggcuaucauauugggcggaaucaguucccauucgucugccaagcuaggcucuggcugcugggauuggguuuuucguuaggcuacggaucgauguuuaccaaaauuuggugggugcauacagucuuuacaaaaaaagaagaaaagaaagaguggagaaaaacgcuggaaccuuggaaguuguacgcgacaguuggccuucucguuggcauggauguacugacccuugcaauuuggcaaauaguggacccucugcaccgcacuaucgaaacuuucgccaaggaggaaccuaaggaagauaucgacgugucaauccucccacaacucgagcacugcucuagccgcaaaaugaauaccuggcuggggaucuuuuacggauauaaaggacugcugcugcugcucggaauauucuuggcauacgaaacgaaaucagugaguacagagaaaauuaacgaucaucgggccgugggaauggcuauuuacaauguugccguuuuaugcuugaucacugcuccugugacuaugauccuaagcucccagcaggaugcugcguuugcuuuugccucccuugcuauugucuucuccucauacaucacgcuggucguucuauucgugcccaagaugagacgacuaauuacuaggggcgaauggcagagcgaggcucaggacacaaugaaaacaggcucaucgacuaauaauaacgaggaagaaaaauccagacuguuagaaaaagagaaucgcgaacucgaaaagaucauugccgagaaggaagagaggguaucagaacugaggcaccagcuacaaucccgacaacaguuacgcucaaggcgccaucccccuaccccgcccgaaccgucagguggccugccccgaggaccucccgagcccccagaccgccuuuccugugauggcucccgcguccacuugcuguacaaguag

SEQ ID NO: 14512 - RNA, 444 nt, Artificial Sequence
  Description of Artificial Sequence: Synthetic coding sequence
auggccgguccauggacuuuuacacugcuguguggccuucuagcggccacucugauccaggccacccuaucgccuaccgccguucugauccugggaccuaaggugaucaaggaaaaacuaacgcaagagcugaaagaccacaacgccacuucaauucuucaacaguuaccacuucuaucugccaugcgcgaaaaacccgccgggggaauacccguccugggaucgcucguuaacaccguuuugaagcauaucauaugguugaaagugaucacugcaaauauucuucaacuacagguaaagccuuccgcuaacgaccaagagcuucuuguuaaaauuccccuugacaugguggcuggauucaauacaccccuggugaagaccauuguagaguuucauaugacuacugaggcccaggcaacgauccggauggauacuuccgcuuag

SEQ ID NO: 14513 - RNA, 948 nt, Artificial Sequence
  Description of Artificial Sequence: Synthetic coding sequence
augaagguccugcuccugacaggccugggcgcucuauucuucgcuuauuacugggacgacaacuuugaccccgcaucgcugcagggagcucgcgugcugcugacuggggcgaacgccggcguuggagaagaacuggcuuaccauuacgcacgacucggcucacaucucguucugacagcucacacagaggccuugcuccaaaaaguggugggaaacugcagaaagcuuggagccccuaaaguguucuauauugccgcagacauggccagccccgaggcacccgaaagcgugguacaguucgcacuugacaaauugggcggccuggauuaccuggugcugaaccauauuggaggcgcucccgcagguacacgcgcccggucaccccaagcuacgagauggcugaugcaggugaacuuugugucuuaugugcaguuaacuagucgcgcucuaccuucauuaacugauucuaagggaagccuugugguggugagcucccugcucgguagaguucccacaucuuuuuccacucccuauucugcugccaaauucgcuuuagacggauuuuucggaagucuccgacgagaacuggacgugcaggacgucaacgucgccauuacaaugugugugcuggggcuccgagauagggcaucugcugcagaggccguccgcuccucuacauccagaccaagacagccagaacacaggggggugccuuuacagagucagaccgcaauguuuuugccaccaacagucccuggcgcccgaacccugaccgaaacgcccuugcgcggguggccacagccaaaaaugaagagcucuagacagaaaucuaagaccgagaagaacgacggucaucucgaaccuguaacugcaugggaggugcaggugccacgggugcgacgccuuugccguggauuagcucgcccacaccuguuuggucaugauuag

SEQ ID NO: 14514 - RNA, 285 nt, Artificial Sequence; identical to SEQ ID NO: 12875
  Description of Artificial Sequence: Synthetic coding sequence

SEQ ID NO: 14515 - RNA, 783 nt, Artificial Sequence
  Description of Artificial Sequence: Synthetic coding sequence
auggagaaauuuaacacgauaucagugaguaagugcaauaaggaaaccguugcgaugaaggaaaaauguaaauucggcaugacaucuacuauaccgagcggccaugucuggaggaacacauggaacccugucucuuguucuuuagccacagugaagaugaaggagugccugagaggaaaacuuauauaucugaugggagacucuacuauucgccaauggauggaauacuuuaaggccucaauuaacacccugaagucugucgaucugcaugaguccgggaaacugcagcaucaguuagccguggaccuggaucgaaacauuaacauacaguggcagaaauacuguuauccccuuauuggaagcaugacuuauagcgugaaagagauggaguaucugaccagagcaauugaucgaacaggaggggaaaagaauaccgucauagugaucagccucggccagcacuuucgccccuuccccaucgacguguuuauaaggcgcgcccugaauguacauaaagcaauucagcaccugcuauuaagaagucccgacacgaugguuaucaucaagaccgagaauauucgcgaaauguauaacgaugcagaaagauuuucggauuuucauggcuauauacaguacuuaauuauuaaagacauuuuccaggaucuuagcguguccaucauugaugcaugggauauuacuaucgcuuauggaacaaauaauguucauccaccucaacacguagucgggaaccaaauuaacauuuuauugaauuauaucugcuag

SEQ ID NO: 14516 - RNA, 1644 nt, Artificial Sequence
  Description of Artificial Sequence: Synthetic coding sequence
augaguuccaauaccaugcuucagaagacacuucuuauucugauuaguuuuuccgugguaacauggaugaucuuuauuauuucccaaaauuuuacaaaacuauggagugcccugaaccuuucuaucucuguucauuauuggaauaauagcgcaaaaucccuuuuccccaagacauccuugauccccuuaaagccucugaccgagacggagcugagaauuaaagagauuaucgagaaauuggaccagcaaauaccuccccgccccuuuacucacguuaacacaacaaccagugccacccauuccaccgcuacaaucuugaacccuagagacacauauugucguggggaccagcuggauauccuccucgaggugcgagaccaccugggacaacgaaaacaguauggcggagauuuuuuaagggcaaggaugucaucucccgcauugacagccggggcuucuggcaaagugauggacuucaauaacggaacuuaccugguauccuucacucuuuuuugggaaggacaggucucccuuucacuacugcugauucacccuuccgagggagccagcgcacucuggcgggcccgaaaucaaggguacgauaagauuaucuucaaaggcaaauuugugaacgguaccagccacguguuuacugaguguggacuaacucuuaauucaaaugcugaauuaugcgaauaucuggaugauagagaccaagaggccuuuuauuguaugaaaccccagcauaugccaugcgaggcauugacauauaugacgaccagaaaucgcgaagucucauaucuuaccgacaaagaaaacucauuauuccauaggucaaagguaggagucgaaaugaugaaggaccgcaagcauaucgauguaacaaauugcaauaagagagaaaagauugaagagaccugccaggugggaaugaagccacccguccccggaggguauacacugcaggguaaauggauaacuaccuucuguaaccagguccaacuggauaccauuaaaaucaacggcugccucaaaggaaaacucauuuaccugcuaggugacucuacgcuccgucaauggaucuacuauuucccaaaaguuguuaagacucugaaauuuuuugaccuucaugaaaccggcauuuuuaagaaacaucugcuccucgacgcagaacgacacacacagauucaguggaaaaaacacucauacccauucguuacuuuccagcuguauucacucauugaucacgacuacauucccagagaaauagaucgacucuccggagauaaaaauaccgccauuguaauaaccuucggccagcacuucagaccguuuccuauugacaucuuuauccgccgcgccaucggcguccagaaggccauugaacggcuguucuuacgcagucccgccacuaaggugaucaucaaaaccgagaacauuagggaaaugcacauagaaacagaacgauuuggggacuuccacggcuauauucauuaccugauuaugaaagacauuuucaaagaccugaacguggggauaauugacgcaugggacaugacaaucgcauacgggacugauacuauccauccaccagaucacgucaucgggaaucagauuaacauguuucuaaacuacauuugcuag

SEQ ID NO: 14517 - RNA, 399 nt, Artificial Sequence
  Description of Artificial Sequence: Synthetic coding sequence
augcugaugcuuuucguguuugggguccuucuccacgagguuucacucuccggacagaacgaagcccccccgaauacucacagcaucccuggcgagccccuguauaauuacgcuuccauaagauuacccgaggagcauaucccauucuuccuacauaauaaccggcauaucgcuaccgucugucgcaaggauucccucuguccauauaaaaaacaccucgaaaagcuuaaauacuguugggguuaugaaaagucuugcaagcccgaguuucguuuuggauacccagucuguucauacguggacauggguuggacagauacucuagaaucugcagaggauauauuuuggaaacaggcugauuuuggcuaugcacgagaaagacuggaagagaugcauuag

SEQ ID NO: 14518 - RNA, 861 nt, Artificial Sequence
  Description of Artificial Sequence: Synthetic coding sequence
auggguuccgccuuauuuguaaaaaaggagcugcaacugcaagccaacuuccugggaaauguuaagcggcuuuacgaagcggaggucuuuagcacagauuuuagcaacccuaguauagcccaggcacgcauaaauucucaugucaagaaaaagacccaaggaaaggucguggacauaauucagggacuggaucuacugacugccauggugcucgucaaccauauauuuuucaaggccaaaugggagaaacccuuucaucccgaauacacucggaaaaauuuccccuuucucguuggagagcagguuaccguacacguaccaaugaugcaccagaaagaacaguucgcauuugggguagauaccgaguuaaauugcuucgugcugcaaauggacuacaaaggcgaugcaguugccuuuuuuguucuaccuagcaaaggcaaaaugaggcagcuugaacaggcauugucagcaagaaccuugaggaaauggucccacagccuacagaagagauggauugaaguguucaucccaagauucucuaucucugcaagcuacaaccuggaaaccauucuaccaaaaauggggauucaaaaugucuuugauaaaaacgcugacuucuccggcauugccaaacgcgauuccuuacaagugucaaaggcgacucauaaagcuguucucgacguaagcgaggaggggacagaggcuaccgcagccacuacuacuaaguuuaucguucgcucaaaggacggcccuucguauuuuaccgugucauuuaacagaacguuccuuaugaugauaaccaauaaagcuacugacggcauucuguuucuggggaaaguugagaacccuaccaaaaguuag

SEQ ID NO: 14519 - RNA, 60 nt, Artificial Sequence; identical to SEQ ID NO: 12880
  Description of Artificial Sequence: Synthetic coding sequence

SEQ ID NO: 14520 - RNA, 1197 nt, Artificial Sequence
  Description of Artificial Sequence: Synthetic coding sequence
augaaguuucaggggccccuggcaugucuccugcucgcucuuugucugggaucaggagaggcggggccacugcagagcggugaggagagcacaggaacaaacaucggugaggcacuggggcacggucuuggagacgcauuguccgagggggugggaaaggcuauugguaaagaggccggaggagcugccggaagcaaagugucagaagcguuggggcaggggacuagggaagcagucgggacaggcgugagacaagucccuggcuuugggguggccgacgcacuggggaauagggugggcgaggcugcccaugcccuagggaacaccggacacgagauuggacggcaagcagaagacgucaucagacacggagcagacgcuguaagggguagcuggcaagggguuccaggacacaauggggcaugggagacaucugggggacacgggauuuucgguucccagggaggacugggcgggcaaggacaagguaacccagggggccuuggaacaccuuggguucacggguacccagguaauucagcuggaaguuucggaaugaacccgcagggagcuccuuggggccagggaggaaacgggggaccaccaaauuucggaaccaauacccaaggggccguugcgcagcccggguacgguagugugcgcgcaaguaaucaaaacgaaggaugcaccaauccuccccccagcggauccggugguggaucuagcaauucaggcggugguagugggagccagagcggauccucgggaucuggcaguaacggggacaauaacaauggaucuagcuccgggggguccucaaguggcucgagcucagggggaucauccggcgggucaucuggugguucuuccggcaacuccggcgggucaaggggagacaguggcuccgagaguagcugggguagcuccacgggcucuagcucugguaaccacggggggagugguggaggaaacggccauaagccugggugcgagaagccuggcaaugaagccagagguagcggagagaguggcauacagggauuuagaggacaggggguaagcaguaauaugcguaauucagagaccucacccgggauguuuaauuuugacacuuuuuggaaaaacuucaaaucuaagcuugguuucauuaacugggaugcaauuaacaaagaucagcgaucaucuagaauccccuag

SEQ ID NO: 14521 - RNA, 81 nt, Artificial Sequence; identical to SEQ ID NO: 12882
  Description of Artificial Sequence: Synthetic coding sequence

SEQ ID NO: 14522 - RNA, 696 nt, Artificial Sequence
  Description of Artificial Sequence: Synthetic coding sequence
auggcacagcuguuccugcccuugcuggccgcccucguguuggcucaggcccccgccgcacuugcggacguccuggaaggcgacaguucagggaucuauagaugcgagguacaacauggcauugacgacucaucugacgccguggaaguuaaagugaagggaguuguguuccucuacagagaaggguccgcacgcuacgcuuuuaguuucagcggagcucaggaagccugugcuagaauuggugcucacaucgccacaccagaacaacuuuacgccgcuuaucuuggaggcuaugagcagugugaugcuggcuggcugucggaucagacggugcgauauccaauccagaccccgagagaagccuguuauggcgauauggaugguuucccuggcgugaggaauuacgguguaguagauccagacgauuuauacgacguguacuguuaugcugaagaucugaacggugaacuguuucugggcgacccccccgagaaacuuacucuggaagaggcccgagccuauugucaagaacgaggggcugagauugcaacuacgggacagcuuuacgccgccugggauggaggacuagaccauuguagccccggauggcucgcagacggcuccguaagauaccccauugucacccccagccaaagaugcgguggaggauugccaggcguaaaaacgcuguuuuag

SEQ ID NO: 14523 - RNA, 600 nt, Artificial Sequence
  Description of Artificial Sequence: Synthetic coding sequence
auggacgagcuccugccacucauaccuguguuggaacaauacaagacugacgccaagcuuaucacacaauuuaaggaagagauuagaaaucugucagcugugcugaccgggauucaggaagagaucggcgcuuacgacuaugaggaacuccaccagaggguucugucacuagagacuagacugcgggacugcaugaaaaaacugaccugugguaagcuuaugaagauaaccgggccagugaccguuaagacaucuggcacaagauucggcgccuggaugaccgauccccuugccuccgagaaaaauaaucguguaugguacauggacucguauacuaauaauaaaauuguccgggaauacaaaucaauagcggauuucgugagcggagcagaaagcaggacauauaauuugccuuuuaaaugggccggcacuaaucacgucguuuacaauggcagccuguauuucaacaaauaccaauccaacauuauuauuaaauacagcuucgauaugggacgggucuuggcccaacguucgcuggaguaugccggcuuccacaacgugacuccaacgcauggaguagacucuuugacuuccacauag

SEQ ID NO: 14524 - RNA, 609 nt, Artificial Sequence
  Description of Artificial Sequence: Synthetic coding sequence
auggccgacaugcagaaccucguggaacguuuggaaagagcggucgggcggcuggaagccgugucucacacaucugacaugcaucguggcuaugccgauucccccaguaaggcaggugccgcacccuacgugcaggccuucgauucacucuuggcgggcccuguugccgaauauuuaaaaauaaguaaggaaauaggaggggauguccaaaagcacgccgaaaugguacauaccgggcuuaaauuggagagggcauugcuuguaaccgccucccaaugucaacagcccgcugaaaacaagcugagugaucuccuggcaccaauuucugagcaaaucaaggaggugauuacauuuagggaaaaaaaccgcggaucaaaacuuuucaaccaucuuucagcugucucugaaucuauacaggcacugggcuggguggccauggcaccgaaaccaggacccuacgucaaggagaugaacgaugcggcaauguucuauacuaacagaguacuuaaagaguacaaagauguggacaaaaagcauguugauuggguuaaagcauaucuaucuaucuggaccgagcugcaagcauacauaaaagaguuccacaccuag

SEQ ID NO: 14525 - RNA, 2886 nt, Artificial Sequence
  Description of Artificial Sequence: Synthetic coding sequence
auguuguuacugcuucugcuagcuccauuauuccugagaccacccggggcagggggugcccagacucccaacgcuacaucugaagguugccagauuauucauccuccaugggaaggcgguauucgauacagagggcucacccgcgaccaggugaaagcuaucaacuucuuaccuguugauuaugagauagaauauguuugccggggagagcgagaaguggucggccccaaagucaggaagugucucgcuaauggcuccuggaccgacauggacaccccuagccggugugugaggauauguaguaaaucauaccugacucuagagaacgguaagguguucuugacugguggggaucuaccagcccuggauggcgcuagagucgauuucagaugcgaccccgauuuucaccucgugggauccagucguucuauuugcucucagggacaguggucuacuccaaagccgcacugucagguuaaucgcaccccacauuccgagagacgagcgguuuauaucggggcccuuuuccccauguccggaggauggccgggaggccaggcuugccaaccagcaguagaaauggcccuggaggaugugaacucgaggcgagacauucucccagauuacgaacugaaauugauccaccacgacucuaaaugugaucccgggcaggccaccaaauaucucuaugaacuccuguacaaugacccgaucaaaauaauacucaugccugggugcagcagcguaaguacacuuguugccgaggcagccagaauguggaaucucauuguccucucguauggcucaucuucgcccgcgcucucuaauaggcaaagauuuccaacuuuuuuuaggacucaccccucagcuacccugcacaaucccacacgggugaaacucuucgaaaaauggggcuggaaaaaaaucgccacgauacagcagacuacggaaguuuucacauccacucuagaugaccuggaggaacgugucaaagaagccggcaucgagauuacauucagacaaucauucuucucugacccagcagucccaguuaagaaucucaagcggcaagaugcgcgaaucauuguagguuuauucuacgagacggaggcaagaaaaguuuuuugugagguguauaaagagagguuguucgguaaaaaguacgugugguuccugauuggcugguaugcugauaacugguuuaaaaucuaugauccgucaaucaauugcaccguugacgagaugaccgaggcuguagagggccauauaacgacagaaaucgucaugcugaaccccgcaaacacacguaguauuucuaauaugacuagucaagaauucguggaaaaacugacaaagcgacuuaagagacauccugaagagaccggaggauuucaagaggcaccccucgcauaugacgcuauuugggcgcuggcccucgcucuuaacaagacguccggcggcggaggccguucaggagugagacucgaggacuucaauuauaauaaucaaaccauuaccgaucagauuuacagggcuaugaacaguucaaguuucgagggaguuuccggccaugugguuuucgaugccagugggucacggauggcauggacccuuaucgagcagcugcagggcggcucuuacaagaaaaucggcuacuacgacucuaccaaagaugaccuguccuggucaaaaacagacaaauggaucggagggagcccaccagcagaucagacccuuguuaucaaaacauucagguuccucucacagaagcucuucaucucagucaguguccucagcagccugggcaucguucuggcgguggugugucugucauucaacaucuauaacucacacguucgguacauucagaacucccagcccaaucuuaauaaucucaccgcaguuggaugcucucucgcguuggccgcaguuuucccucucggacuggacggauaucauauaggaagaaaucaauuucccuucgugugucaagcucgacuuuggcuccucgggcugggcuucucuuugggcuacgguaguauguucacuaagauuugguggguccacaccguguuuacuaaaaaggaggagaaaaaagaauggcggaaaacucuagaacccuggaagcuguacgcaacuguuggauuacuuguagguauggacguguuaacccuugcuauauggcagauagucgacccauuacaccggaccauugagaccuucgcaaaagaagaacccaaagaagauauugaugugaguaucuuaccacagcuagagcacugcaguucccguaaaaugaauacaugguuagggaucuuuuaugguuacaaaggacugcuacucuugcucggaauauuccuugccuacgaaacuaagucagugagcacugagaagaucaaugaccacagggcggucggaauggcaaucuauaaugucgccgugcucugucuuaucacagcuccugucacaaugauccucuccagucaacaggacgcugcauucgcauuugccagucuggcgaucguuuucucuagcuauauuacacucguagugcuuuucguuccaaaaaugagacgcuuaauuacccguggggaguggcaguccgaagcucaagauacuaugaaaaccggcucuucuacuaauaauaaugaggaggaaaagaguagacuguuggaaaaggaaaaccgggaacuugaaaagaucauugcagagaaagaagaaagagugagcgaacuaagacaccaacuccagaguaggcagcagcuaagaagcaggcggcaccccccgaccccccccgaaccgagcggcggccugccacggggcccccccgaacccccagaccgacucucaugcgacggcuccagggugcaucuauuauauaaguag

SEQ ID NO: 14526 - RNA, 351 nt, Artificial Sequence
  Description of Artificial Sequence: Synthetic coding sequence
auggccgccggcucugcgcccaugcagcuucaccucagggccacaauuagaaugaaagauggcuuaugcgugcccagaaaauggaucuaccaucuuacugaagguaguaccgaccucagaacggaaggcagacccgauaugaagaccgaacuauucuccagcucuugcccugguggcauuaugcugaacgagacagggcaaggcuaccagagguuucuauuguacaacaggucaccccacccacccgagaaguguguugaggaauuuaagucucugacaucaugucuugauucaaaagcauuuuugcucaccccacgcaaccaagaagccugugaacucucuaacaacuag

SEQ ID NO: 14527 - RNA, 2334 nt, Artificial Sequence
  Description of Artificial Sequence: Synthetic coding sequence
auggcugcugccggacugguggcuguagccgccgcggccgaguacucuggcacgguagcgagcggaggaaaccuccccgggguucauugcgggccuagcaguggagcgggaccuggcuuuggcccaggauccuggucaagaucccuagaucgagcccuugaagaagcugccgucacaggcguauuaaguuuaaguggcagaaaacuuagagaauuccccagaggcgcugccaaucacgaucuuacagacaccacccgggcugacuugagcaggaaccgucucucagagaucccaaucgaggccugucacuucguuucccuugaaaacuugaaccucuaucagaacugcauccgauauauuccugaagcaauccucaaucuccaagcgcugacuuuccugaacaucucccguaaucagcuaucuacccugcccgugcaccuuugcaaccugccccugaaagucuuaauagccuccaacaauaaacuggucucccugcccgaagaaaucggacacuugcggcaccuaauggagcuugaugucucgugcaaugaaauacagacuauuccaucucagauuggaaaccucgaagcacuuagggaccucaauguucgucggaaccaccuuguccaccugccggaggaacuggcugagcuaccauuaauccgccucgauuucuccugcaacaagauuacaaccauccccgugugcuauagaaaccugcgacaccuucaaaccauuaccuuggacaauaauccucugcaguccccacccgcccaaauuuguauaaaggggaaagugcauaucuuuaaauaccugaauauccaagcaugcaagaucgcuccagaccuuccagacuaugacagacgcccucucggauucggcuccugccaugaagaacucuauuccucccggccguacggcgcacuggacagcggauuuaacucgguugauucaggagacaagagaugguccgguaacgagcccacagaugaguuuagcgaccugccacugaggguggcugaaauaacuaaagaacaaagacuccgcagagagucacaauaucaggagaauagggguagucuagucgugacuaaugguggaguggaacacgaccuggaccagauagauuacauugauagcuguaccgcagaagaagaagaggcugaagugcggcaaccaaagggccccgaccccgacucccuuucaucccaguucauggcuuacaucgagcaacgucguaucagucacgaagggucaccaguuaaaccuguugcgauccgcgaguuccagaaaacagaagauaugagaagauaccuccaucagaacagggugccagcugaaccuucaucccugcucucacugagcgcgagucauaaccaacucucacacacugaucuugagcugcaucaaagaagggagcaguugguagaacgaaccaggcgggaggcccaguuggcugcccuacaguacgaagaagagaagauccgaacgaagcagauucagcgggaugccgugcuggauuucgucaagcagaaagcuagucaguccccacagaaacaacauccauuacucgacggaguggacggcgaguguccuuuuccaucccgucgcagccagcacacugacgauucagcccuaugcaugucccucucaggauugaaccaggucggaugcgccgcuacccugccccacuccagugcuuucacuccucuuaaguccgaugaucgcccaaaugcuuuacugaguucaccugcuacagagacaguacaucauucgcccgcuuacuccuucccugcagcuauccaacgcaaccagccacagagacccgagucuuuccuguucagagccggaguaagggccgaaacaaauaaaggucacgccucgccacucccacccuccgcagcaccgaccaccgauucaaccgauuccauaaccggccaaaauucaagacaacgagaggaggagcuggaacucaucgaucagcuaaggaaacacaucgaguaucgccugaaaguaagccuuccgugugaccuuggcgcagcucucaccgacgggguggugcuaugucauuuagccaaucaugugaggccaaggagugugcccuccauccacguaccaagccccgcagugccuaaacucaccauggccaaaugucgaagaaacguugagaauuuucuagaagccugccguaaaaucgguguaccccaagagcagcucugucuuccauugcacauccuugaagaaaaaggccugucacagguggcugucacuguucaggcccuacuggagcuggccccccccaaacaacagcagcaucaguugagugccgucuag

SEQ ID NO: 14528 - RNA, 834 nt, Artificial Sequence
  Description of Artificial Sequence: Synthetic coding sequence
augcuucacccugagaccucgcccggcaggggucauuugcucgccgugcugcuggcccuccuugggacaaccugggcugagguauggcccccacaacuacaggagcaggcucccauggcaggagcacucaauaggaaagaguccuuucuucuucugaguuuacauaaccguuuaagguccuggguccagcccccggcugccgauaugcgaagacuuuuaguuugggcuaccucuucccagcucggguguggccgccacuuguguagcgccggacaaacagccaucgaggccuucguuugugccuauucacccggaggaaacugggagguuaacgguaaaacaaucauaccuuacaaaaaaggagcaugguguucuuuguguacugcgucagugucuggguguuuuaaggccugggaccacgcgggcgggcuaugugaggucccaagaaauccaugucguauguccugucagaaucauggccgucugaauauuucaacaugccauugucauugcccucccgguuacacagggcgauauugucagggucacuugccaaacagcaauaugccucauuccgccauggggacuaagccaaaaacuccgggcgucccugcuauugguagucuugugagguguucccugcagugcguccacggucgauuuagggaagaagaguguucuuguguuugcgauaucggauacggcggggcacagugugcuagcgaaucuugucccagagcccccaaagagcccgccccccugaaaacuccucuacagugggguaucucuucacaggagcccgcaguuugccuguccuuucaacugauacaguag

SEQ ID NO: 14529 - RNA, 456 nt, Artificial Sequence
  Description of Artificial Sequence: Synthetic coding sequence
auguccgaccuguuacuucucgguuugauaggaggccuuacacugcuccugcuacuaacacuucucgcauuugcaggauacuccgggcuauuggcgggcguggaggugucugcaggguccccaccuauucggaaugugacggucgccuauaaauuccauauggggcuguacggugagacugguagguuguucacagagucaugcucaauuuccccuaagcugagaucuauugccguguacuaugacaacccacacaugguccccccugacaaaugccgcugugcaguuggaaguauucugucugaaggugaagaaucucccucaccugaacuuaucgaucuguaucaaaaauucggauucaaaguuuuuaguuuuccagcucccucacauguggugacagcuacguuucccuauacaacuauucucucgaucugguuggcaacccggcggguuuag

SEQ ID NO: 14530 - RNA, 390 nt, Artificial Sequence
  Description of Artificial Sequence: Synthetic coding sequence
auggcugccggaagcgccccuaugcagcuccaccugagagcuaccauaagaaugaaagauggcuuauguguccccagaaaguggauauaccacuugacagagggcuccacugaccugagaacugaaggacggccagacaugaagaccgaacuauucaguagcucauguccaggcgguaucaugcuaaacgaaaccggccagggguaccagagauuucugcuuuacaaucgaagcccccacccuccagagaagugcguugaagaguuuaagagccucaccuccugucuagauuccaaggcuuuuuuauugacgccacgaaaccaagguaaaggacucaagucacacaagacuggacuggggcuaacaaagucaagcgggguuacgggauag

SEQ ID NO: 14531 - RNA, 390 nt, Artificial Sequence
  Description of Artificial Sequence: Synthetic coding sequence
auggccgcggggagcgcaccuaugcagcuacaucugagagcaacaauccgcaugaaagaugggcucugugucccaaggaaauggauuuaucaccugaccgaggguaguacugaucuccguacagagggacguccugauaugaaaaccgaauuauuuucuagcucaugcccuggcggcauuaugcuuaacgagacaggccagggcuaucaaagguucuuauuguauaaccgcagcccccaccccccagaaaagugugucgaagaauuuaagucgcuuacguccugucucgauucuaaggcuuucuuauugacaccaaggaaccaagguaaagggcugaaaagucauaagaccggccucggacugacaaaaucaagcggcgugacuggauag

SEQ ID NO: 14532 - RNA, 891 nt, Artificial Sequence
  Description of Artificial Sequence: Synthetic coding sequence
auggaagcccuccuucugggagccggucucuuacugggcgccuacguacuggucuacuacaaccugguaaaagcuccuccuuguggcggcauggggaaccugcgggggcggacagccgucguaacugguaucucuagcuguggacguacccgggaagccuuuaaucuccuccuccguguaaaccauauuggaccuuuccuucugacgcaucuacuguugccaugucuuaaagcuugugcaccaucucgcguggucgucguggcuagcgcagcucacuguaggggacgccuggacuucaagagguuggauaggccugucgucggcuggaggcaagagcuucgggcauacgccgauaccaagcuagcuaauguauuauuugccagggaauuagccaaucagcuugaagccacuggcgucaccuguuaugccgcccauccuggaccuguuaauuccgagcuguuuuugagacauguucccggcugguuaagaccucuccucaggccacuggccuggcucguacugagggcaccgcgcggcggcgcucagaccccccuauauugcgcucugcaggaaggcauugagccucuuaguggucgguauuuugcaaacugucauguugaagaagucccgccugcugcucgagacgacagggcugcacaucgauuaugggaagcaagcaagcggcucgcaggccuaggcccaggugaagaugccgaaccagacgaggacccccagagcgaagacucagaggcucccuccucccugagcaccccacacccagaagagcccacugucucucaaccguaccccuccccacaaaguaguccugaccugucuaagaugacucacagaauccaggcaaaaguggaaccggaaauccaacucuccuag

SEQ ID NO: 14533 - RNA, 567 nt, Artificial Sequence
  Description of Artificial Sequence: Synthetic coding sequence
auguuccaucagauaugggccgcacuguuauauuucuauggaaucauacucaacucaaucuaccagugucccgaacacagucaacuuacaacccucggcgucgaugguaaagaguucccugaagugcaucuaggucagugguacuucaucgcuggagccgcgccaacaaaggaagaacuugccacguucgacccuguggacaacauugucuuuaacauggcugcuggcagcgcuccaaugcagcuucaccugagagcaacgauccggaugaaagauggccucugcgucccccggaaguggauuuaccaucucacagagggcucaaccgacuugcggaccgagggacgaccugauaugaagaccgaacuuuuuucuagcuccugcccugggggcauaaugcugaaugaaacaggccagggauaccagcgcuuccugcuauauaauagauccccucauccuccugagaagugugucgaagaauucaagucacugaccucuugcuuagauucaaaggccuucuuacugacuccgcgcaaucaggaagcuugcgaacucuccaacaacuag

SEQ ID NO: 14534 - RNA, 978 nt, Artificial Sequence
  Description of Artificial Sequence: Synthetic coding sequence
augcaggguaggguagccggaucaugugccccucucggcuugcuccugguguguuuacauuugccaggacuauucgcuagaagcauuggaguaguugaagaaaaaguuagccaaaaucugggcacaaaucugccacaacugggccagccgucaucaaccggaccgaguaacagugagcauccccagcccgccuuagauccccgcucaaacgaccuggcaagaguuccucucaaacucucuguccccgcuagugacggcuuucccccugccggaggcagcgcgguacaacgcuggccgcccagcugggggcucccugcgauggacucuuggccuccggaggacccuuggcagaugauggcagcagccgccgaggaucggcugggagaggcucuucccgaagaacucuccuaucugucuagugccgcagcgcuugcccccgguagcggaccccuccccggcgaaaguuccccugaugcaaccggacucuccccaaaagcuucucugcugcaccaggacucagaaucacguaggcuuccucgaaguaacucauugggcgcuggaggaaaaaucuugucacagaggccaccauggucauuaauucacagggugcugccggaucauccauggggaacgcuaaauccuucagucagcuggggaggagggggaccgggcaccggcuggggaacgagacccaugccucaucccgaggggauaugggggauuaacaaccaaccuccaggaaccucguggggaaacauuaacagauacccaggcgguucguggggcaacaucaaccgguacccaggcggcagcuggggcaauauuaacagauauccuggcggguccuggggaaacauacauuuauaucccggcauuaauaaucccuuuccaccuggcguacuucgaccuccagguagcaguuggaauauacccgcaggauuucccaacccacccagccccagacuccaguggggauag

SEQ ID NO: 14535 - RNA, 2631 nt, Artificial Sequence
  Description of Artificial Sequence: Synthetic coding sequence
auggggcccgaagcacuaucuucgcuccuccugcuucugcugguagccuccggugacgcggauaugaaggggcacuuugacccugccaagugucguuacgcucuggguaugcaagaccgcacuaucccugacucagacauuagcgcuucaucuaguuggucagauuccacggcugcucggcauucccgucucgaauccagugauggcgacggcgccugguguccagccggcucaguguuccccaaggaagaggaauaucugcagguggaccuccaaaggcuacaucugguugcucuggugggaacucagggacgucaugcgggggggcucgggaaggaauuuucuagaagcuauagacucagguacucucgugauggcagacgcuggaugggauggaaagaucgcugggggcaagaaguuauaucugguaaugaagaucccgaaggcguuguguugaaagauuuaggcccaccaaugguggcucgacuggugcguuuuuacccucgcgccgaucggguuauguccgucuguuuacgaguggaacuguauggcugccuguggagagauggcuugcugucauacacugcuccagugggacaaacaauguaucugagugaagcgguguaucucaaugauucaacauacgaugggcauacaguagggggcuuacaguacgguggccugggacagcuggcugacggaguaguaggauuggacgauuucagaaaaagucaggaacugagaguguggccuggcuacgacuaugugggauggucuaaccauagcuucaguucuggguauguggagauggaauuugaguuugaucgucugagagcauuucaggcaaugcagguucacuguaacaauaugcauacccugggagcacgccuccccggcgguguugagugucgauucagaagaggacccgccauggcaugggaaggcgaacccaugcgacacaaucugggcggcaauuugggagacccaagggccagagcaguaucugucccucuuggaggccggguugcuagguuccuucaaugucgcuuccuauucgcugggccauggcuccuguuuagcgagaucucguuuaucuccgauguggugaacaacaguagcccagcucuaggcgguaccuucccccccgcuccuugguggccuccgggccccccccccacaaacuucucauccuuagaacuggagccacgcggccagcaacccguggccaaggcugagggcucuccuacugccauccuuauuggaugucuggucgcaauuauucugcuguugcuucucaucaucgcccuuaugcuguggagacuacauuggcgcagacuguugucaaaagccgagagacgcguucuagaggaagaauuaacuguacauuuaagcgugccuggagacaccauucugauuaacaacagacccggucccagagagccaccacccuaccaggaaccaagaccaaggggcaaucccccccacucugcuccaugugucccuaacggauccgccuauuccggggauuacauggaaccagagaagcccggugccccacugcugccgccccccccccagaacucaguuccccauuacgcagaagccgauaucguuacccuccagggagugacugggggaaauacauacgcagugccggcucugccuccgggcgcaguaggggacggcccacccagaguagacuucccucggucucguuugagauucaaagaaaaacucggugaaggacaauucggcgaagugcaucucugugaaguagacagcccucaagaucuuguuucucuugacuuuccacugaauguucguaagggccauccccuccugguugccgugaagauucuuagaccugacgccaccaagaacgcacguaaugauuuuuugaaagaagugaaaaucaugagcagacugaaggaccccaauaucauccggcugcugggggucugugugcaggaugacccccucuguaugauuacugacuacauggagaacggcgaccuuaaucaguuuuugucagcccaccaacucgaggauaaagcagccgaaggugccccaggggauggacaggccgcucaaggucccaccaucuccuacccaaugcuucugcauguggccgcccaaauagcuucugggaugagauaccuggcuacuuugaauuuugugcauagggaccucgcaacuagaaauugccuggucggugaaaauuucacuauuaagauugcugauuucgguaugagcagaaacuuauacgccggugauuacuauagaguacagggacgugcgguucugccaauuagguggauggcgugggaauguauccucaugggaaaguuuaccacagcuuccgacgugugggcguucgguguuacucucugggaaguccugaugcuauguagagcccagcccuuuggacaacucacagaugaacagguuaucgaaaaugcuggcgaguucuuccgcgaucagggucgucagguguauuuaagccgaccccccgcaugcccccagggacuuuacgaguugaugcuaagguguuggucuagagaauccgaacagcgcccacccuuuucccaguuacaucgcuuucucgccgaggaugcucuuaacacuguguag

SEQ ID NO: 14536 - RNA, 1482 nt, Artificial Sequence
  Description of Artificial Sequence: Synthetic coding sequence
auggcccugcuggccgguggacuguccagaggauuggggucccauccagcugccgccggccgugaugcaguuguuuucguguggcugcugcucucuacuuggugcaccgcccccgcucgggcuauccaggucacuguuucuaauccauaucacgucguuauacucuuucaaccugugacacuucccuguacuuaucagaugaccucaaccccaacccagcccaucgugauuuggaaguacaagucuuucugccgcgauaggaucgccgaugccuucucgccagccuccguggauaaccagcuuaacgcacagcucgcagccgguaauccaggcuacaaccccuauguggagugccaagacagcgucaggacagucagagucguugcaacuaagcaggguaaugccguaacucugggagacuauuaucagggccgccggaucacuaucacaggcauguacgcagccgguaaggccgcaacaagcggggugcccuccauuuacgcacccaguacguaugcccaccucuccccagccaaaaccccccccccuccagccaugaucccuaugggaccugcauacaacgguuauccuggagguuaccccggcgauguagaucgcucgaguagcgcugguggucaaggcucauauguaccucugcugcgggacacagacucgagcguggccuccgaaguacgcagcggauaccgaauacaagcuagucagcaagaugauucuaugcgcguguuauacuauauggaaaaagaacuggccaacuucgauccaucaagacccggccccccauccggacgcgucgaacgcgcuaugagcgaggugacuucacugcacgaggacgauuggagauccagaccaagccgaggacccgcucugaccccaauccgugacgaggaauggggaggucacaguccuagaagcccacggggcugggaccaggaaccagcccgagaacaggcuggaggaggguggcgcgccagacgcccccgcgcuagaucuguagaugcccuggaugaucuuaccccgcccaguacagcugagucuggauccagaucgccgaccuccaauggaggccggucucgugccuauaugccaccacgcucacggucaagggaugaccuguacgaucaagacgauagcagagauuuuccuaggucucgcgauccucacuacgaugauuuccgcucccgugagcgacccccggcagacccccgcucccaccaucaccggacuagggauccuagagauaacggcagcagaucaggagacuuaccauaugauggaaggcugcucgaggaagcaguuaggaaaaagggaucagaagagcgucgaaggccccacaaagaggaggaggaagaagcguacuauccaccugccccaccaccauacagcgagacagauagccaggccucaagagaaagaaggcucaagaagaaccuugcacugagucgggaguccuuagugguguag

SEQ ID NO: 14537 - RNA, 1788 nt, Artificial Sequence
  Description of Artificial Sequence: Synthetic coding sequence
auggacuuucuuuuggcccugguucucgucaguucucuuuauuuacaggcugccgcagaauucgaugggagauggcccagacagauuguguccuccauaggauugugucgauaugggggcagaauugauuguugcugggggugggcucgccagagcugggggcagugccagccagugugccagccccgcugcaagcauggagaauguauuggaccgaauaaauguaaaugccacccaggguaugcaggcaaaacgugcaaccaggaugaacauaucccagcaccucucgaccagggaagcgagcaaccccuguuccagccacuggaucaccaagcuaccucuuugcccucucgggaccuuaaugagugcggauugaaaccucgacccuguaaacacagguguaugaauacauacggcuccuauaaaugcuauugccugaacggcuauauguuaaugcccgacggcaguuguucuucagcuuugacaugcaguauggccaauugccaguacggcugcgacguggucaagggacagauacguugccaauguccauccccaggcuugcagcuagcccccgacgggagaacuuguguggauguggaugaaugcgcuacggggagagccucaugcccccgcuuuaggcaguguguaaauacguuuggaucauauauauguaaaugccacaaaggauucgaucugauguacauuggaggcaaauaccagugucaugauauagacgaguguucgcugggacaguaccaguguucaaguuucgcucgauguuacaauauaaggggcagcuauaagugcaaaugcaaagagggauaucagggagacgguuugaccuguguuuacaucccaaaaguuaugauugaaccaucugguccuauucacgugccgaagggaaacggaaccaucuuaaaaggggauacugguaacaauaauuggauuccagacguuggcagcacaugguggccacccaaaacccccuauauuccuccaaucaucacaaaucggccuacaucuaaacccaccacucgcccuacaccaaaaccaacaccuauuccaacgccaccuccucccccaccuuugccgacagaacuccggaccccacugccccccaccaccccagaaagaccuacuacuggguuaaccacaauugcuccagcugccucaacucccccuggcgggaucacagucgacaauaggguccagacugauccacagaaaccccgcggugacguguuuauaccacgccagcccuccaaugaucuguuugagauauucgagauagagcguggcgucagugccgacgaugaagccaaggaugauccgggcgugcuggugcacucaugcaacuuugaccacggccucugcggauggauuagggagaaagacaacgaccugcauugggagccaauccgagacccagccggcggccaauaccuuaccgugagcgcagccaaagccccagguggaaaagcugccagacuggugcuuccccuugguagauuaaugcacuccggcgaccugugccucuccuuccgacacaaggugacaggacugcacagcggcacacuccagguauuuguaagaaaacauggggcucacggggcggcgcuaugggguagaaauggcggacacggguggcgccagacucagauaacucugcggggggcugacauuaaaucggucguguucaaaggcgaaaagaggcgcggccacacaggggagauugggcuggaugacguauccuuaaagaagggucacugcucggaagaacgguag

SEQ ID NO: 14538 - RNA, 210 nt, Artificial Sequence; identical to SEQ ID NO: 12899
  Description of Artificial Sequence: Synthetic coding sequence

SEQ ID NO: 14539 - RNA, 483 nt, Artificial Sequence
  Description of Artificial Sequence: Synthetic coding sequence
auggccagggauuaugaccaccucuucaaguugcucaucaucggggacaguggaguuggaaaauccucgcugcucuuaagauucgcagacaacaccuuuucagggagcuacaucacaacuaucgguguugauuuuaagauuagaacgguagagaucaauggcgaaaaaguuaaauuacagaucugggauaccgccggccaggagcgauucagaacaauuacaucaacggccgagaccgcacugagaucccugccccaaccagaagcucacggcgggucuucaggggauagccuuuccuuugugccccuguucaaggaauucucccccugcuucugcauuggucgaugucacagacauuuccuacccagaccccccagaguaccgagacgcuguuggacuucacccccuuuucccacaggcgccccuucuagcccagcaaaagccccuggacccggcgaggacgcugcucgucgcgcugacuag

SEQ ID NO: 14540 - RNA, 360 nt, Artificial Sequence
  Description of Artificial Sequence: Synthetic coding sequence
augaacaagauuuugucuagcacaguuugcuucgggcuccucacgcuacuguccguauugucguuucugcagucuguacaugguagacccuaucugacgcagggaaaugaaaucuuccccgauaagaaauacacuaaucgcgaagaacuguugcuagcccugcuuaauaagaauuuugacuuucaaagaccauucaacacagaccucgcucugccaaauaaauuggaagaacugaaccaauuggagaaacucaaagaacaacucguggaagagaaggauucagagacuucauaugccguggacggcuuguuuucaucccacccgucuaagagagcauguuucuggaaguauuguguguag

SEQ ID NO: 14541 - RNA, 2514 nt, Artificial Sequence
  Description of Artificial Sequence: Synthetic coding sequence
auguuuaaguguuggucagugguccucgugcugggcuuuauuuuccucgagagugagggucgcccaaccaaggaagggggauauggacugaagaguuaccagcccuugaugcggcuuaggcacaaggaaaaaaaucaagaaaguagccgagugaagggcuuuaugauccaggauggcccauuugguucaugugagaauaaauauuguggcuuggguaggcauugcguuacauccagagaaacaggacaggcugaaugcgcuugcauggaccucuguaaacgacauuacaagcccguaugcggaagcgauggcgaauucuacgaaaaucacugugagguacacagggcagcaugucuaaaaaaacagaaaauuacaaucguacacaacgaagacugcuucuuuaagggagacaaaugcaagaccacagaguacaguaagaugaaaaacauguuauuagaucuucaaaaucaaaaguauaucaugcaggagaacgagaacccuaauggcgacgacauuucccggaaaaaacuguuggucgaccagauguucaaguacuucgacgcagacuccaaugggcuuguggacauaaaugagcugacccaggucaucaaacaagaggaacugggaaaagaucuguuugacuguacacuuuacguauuguuaaaauaugacgacuuuaaugcggacaaacaucucgcacuggaagaauuuuacagggccuuucagguuauccaguugagucuaccugaagaucagaaauuaucaaucacggccgccacaguuggccagucugccgugcugucaugcgcuauccaaggaacucugagacccccuaucaucuggaaaagaaacaauauuauccuaaauaaucuggaccuugaggacauuaaugauuucggagaugauggaucucucuacauuaccaaagucacaaccacucacgucggcaauuauacauguuacgcugacggcuacgagcaagucuaucaaacucauaucuuucaagucaacgugccucccgucauccgcguguaucccgaaagucaggccagagagcccggaguuaccgcuagucuacguugccacgcugagggcaucccaaaaccacagcuggguuggcugaaaaauggcauagacauuacucccaaauugucaaaacagcugacacugcaggcuaacggauccgaaguacacauuagcaaugugagguacgaagacaccggggcuuauaccuguauugcuaaaaacgaggcgggcguugacgaagacaucuccagucuguuuguagaggauagcgcacguaagacacggcuugguauugggaauauguucuaugucuuuuaugaagaugguaucaaagugauccagccaaucgaaugugaguuucaaagacacauuaagccuagugaaaaacugcucggauuccaggacgaaguauguccaaaggcagagggcgacgaaguacagcgcugcgugugggcgagcgccguaaacgucaaagacaaauuuauuuacgucgcucagcccacgcucgacagagugcuuaucguggacgugcaaucucagaaagugguccaagcaguuucuacugacccuguuccaguuaaauuacauuacgauaaaucgcaugaucagguuugggugcugaguuggggcacacuggagaaaaccagccccacgcuccaggucaucacccuagccucaggcaacguuccucaccacacuauacauacccagccagucggcaaacaauucgaccgaguugacgauuuuuuuauaccgacuacuacccuuaucauaacucacaugagauuuggauucauccugcacaaagacgaggccgcacugcagaaaauugaccuugaaacuauguccuacauuaaaacgaucaaccugaaagacuacaaaugcgucccucagagucucgcguacacucauuuaggcggcuacuacuuuaucggaugcaaaccugacaguacuggcgccguguccccccaggugaugguggacggcgugacugacagugugaucggcuuuaacagugacgugaccgguacacccuaugucucccccgacggacacuaucuuguaaguauuaacgaugucaaaggacugguucgcguacaguauauaaccauucgaggggagauccaagaggcauucgauauuuacacuaaccuucacauuuccgaccucgcauuucagcccucuuuuaccgaagcacaucaguacaacauuuacgggucgucaaguacucagaccgauguuuuguuuguugagcugucaagcggcaagguuaagaugauuaaaagccugaaggaaccccucaaagcagaagaauggccuuggaacagaaagaaccgacaaauccaggacucaggacuguucgggcaauaucuuaugacaccaagcaaagacucucuguuuauacuugacggccguuuaaauaaauugaauugugaaaucacugaaguggaaaagggaaacacugugaucugggugggcgacgcguag

SEQ ID NO: 14542 - RNA, 648 nt, Artificial Sequence
  Description of Artificial Sequence: Synthetic coding sequence
auggccgacaugcaaaaucuuguggaacgcuuagagcgagccgucggacgccuggaagcugucucacauacuucggauaugcacagagguuacgcagauucuccaucuaaagcuggggccgcccccuauguacaggccuuugacucacuucucgcagguccuguugccgaguaccugaaaauuagcaaggagaucggcggcgacguucagaagcacgcagaaauggugcacacagggcuuaaauuggagcgcgcccugcugguaaccgcuucccaaugucaacagcccgcagagaauaagcucuccgauuugcuugcuccaaucucagaacaaauaaaggaaguaauaacauucagggagaaaaauagagguucuaaacuguucaaucacuuaagugcugugagcgaauccauccaagcacuuggguggguggcuauggcuccaaaacccgguccuuacguuaaggaaaugaaugacgcugccauguuuuacaccaaccgcguauuaaaagaauauaaagauguagauaagaagcauguggauugggucaaggcuuaccugucuauuuggaccgaacuucaggccuauauuaaagaguuccauaccaccggccucgcuuggagcaaaaccggccccgucgcuaaguag

SEQ ID NO: 14543 - RNA, 3837 nt, Artificial Sequence
  Description of Artificial Sequence: Synthetic coding sequence
augcgucuguuacugcuagugccacuccuacuggcuccugcaccuggauccucagcccccaaagugcgcagacaaucagauacuuggggcccauggucccaguggucgccuuguuccaggaccuguggcgguggagugaguuuucgcgagagaccauguuacagccagcgucgcgacgguggaaguuccugugugggcccggcacgaucacaucgcuccugucguacugaaucuugcccugauggcgcuagagacuuuagagccgagcaaugcgccgaauuugacggcgcggaauuccagggacguagguacagguggcucccuuauuacuccgcuccaaacaagugugaacugaacugcauuccuaagggcgaaaacuuuuacuacaagcacagagaagcugucgucgacgguacccccugcgaaccugggaaaagagacguguguguugauggcucgugucggguagucgggugugaccaugagcucgacagcaguaagcaagaagauaagugccuaagaugcggaggagaugguacaacuugcuaucccguggcggguacguuugacgcuaacgauuugucacgaggcuauaaucaaauccugauuguaccaaugggagcaacauccauccugaucgaugaagcugccgcauccagaaacuuccuugccgugaagaaugugagaggagaauauuaucuaaacggucacuggacgauugaagccgcacgggcgcucccugcagcuagcacuaucuuacacuaugagcgcggugccgagggcgacuuggcaccagaaagauugcacgcucgaggcccaacaagcgaaccacuagugauugagcucaucucccaggagccaaaucccggcgugcauuacgaguaucauuugcccuugaggcgaccaagcccuggcuuuucuuggucccacggcaguuggucagacugcucggcagaaugugggggcggacaccagucccgacucgucuucuguaccauugaucaugaagccuacccugaccauaugugucagcgucagccucgccccgccgauagaaggagcuguaaccuucaucccugcccugagacaaaaagauggaaggccggacccugggcucccuguucugccucauguggaggcggcagccagagcagaucagucuacugcauuuccagugauggugccggcauucaggaagcuguggaggaagccgaaugcgccgggcugccugggaagccaccugcaauccaggccugcaaccuccaacgaugugcugcuuggaguccggaacccuggggagaauguucugugucuuguggggugggagugcguaaaagaucugugacauguagaggcgaaagagguucucuucugcacacugccgccugcagccuggaagaucgccccccccucacggaaccuuguguccaugaagauuguccauugcuguccgaucaggcuuggcacguggguacuugggguuuauguaguaaaagcuguaguucuggcacacguaggagacaggugaucugcgccauuggcccuccaucacauuguggaagucuacaacauuccaaaccuguagauguugaaccauguaauacccagccuugucaucugccccaggaaguucccuccaugcaggacguucacacgccagcuucuaaucccuggaugccucugggcccacaggaaucuccggcuuccgacucccguggccaguggugggcggcgcaggagcaucccagcgcucgaggcgaucauagaggggagagaggcgacccgagaggggaucaaggaacccaucuguccgcacucggacccgcaccaagccuccagcaaccaccguaucagcagccccuaagguccgguuccggaccccaugauugccgacauuccccacaugguugcugcccagauggccauaccgcuagucuaggcccacaauggcaggguugcccgggcgcacccugucagcagaguagguacggguguuguccugaucgagugucaguggcugaaggaccacaucacgccggaugcaccaaaaguuauggaggagauucuacggggggcaugccucgcucucgugcuguugccuccacugugcacaauacacaucaaccccaagcccagcagaaugagcccagcgaauguagaggcagccaguuuggauguugcuacgauaauguggccaccgcugccggaccacuuggagagggaugcgugggccaaccuucgcacgccuaccccguucggugucuucugcccucugcucaugguaguugugccgauugggccgcccgcugguacuucguggccuccgugggacaguguaacagguuuugguaugggggcugccaugguaacgccaacaacuuugcuucagaacaagagugcaugucaaguugucaggguucacuccauggccccaggagaccccaacccggugcuagugguaggaguacccacacagacgggggaggcagcucaccagccggagagcaggagccgucucagcaucgaaccggugcagcuguccaacgaaagccauggccaagcggaggauuauggaggcaggaucagcagccaggcccaggugaggcaccucacacccaggcauuuggagaguggcccuggggucaggaacuuggcucgagagcgcccggcuuaggcggagacgcaggcagccccgccccccccuuccauucaagcaguuauagaaucagucuugccggcguugagccgagucucguacaagcagcauugggccagcucgucaggcuaagcugcucagaugacaccgcucccgagucccaagccgcuuggcagaaagauggucagccaauaucauccgaucggcaucggcugcaauucgacgguucgcuaaucauucacccccugcaagcagaagacgcuggaacauacuccugcggcagcacaagaccagguagagacagccaaaaaauacagcugcgaauuaucggaggcgacauggccguucucucugaagcugaacugucccguuuuccccagccucgagacccggcccaggacuucggucaggcaggcgcugcaggcccguuaggggcaauuccuucuagccauccccaaccugcaaaccgacuucgcuuagaucagaaccaaccucggguaguggaugccagucccgggcagcgcauucggaugaccugccgcgcagaaggcuucccaccaccagcuauagaguggcagagagauggccaaccugucagcagcccacgccaccaauugcagcccgacggaucacuugugaucuccagaguggccguggaggacggaggguucuauacuuguguggccuuuaaugggcaagaccgugaucaacgcugggugcaauuacgugugcugggagagcucacuaucucugggcugccacccacggugacgguaccggagggagauacggcgagauuauugugcgugguggccggcgaaagugucaauauccgauggagucgcaaugguuuaccuguucaagcagacgggcaucgugugcaccaguccccagauggaacuuugcucauuuacaauuugcgggcgcgcgacgagggaucuuacaccuguucagcauaccagggaagucaagcagucucacguucgacagaagugaaaguggugucccccgcuccuaccgcccagccgcgcgaccccggccgugauuguguggaucaaccugaguuggcaaauugcgaccugauccuccaggcucagcuuugcggcaaugaauacuauucuuccuucugcugugcuuccuguucacguuuucaaccucaugcccagcccaucuggcaguag

SEQ ID NO: 14544 - RNA, 546 nt, Artificial Sequence
  Description of Artificial Sequence: Synthetic coding sequence
ugaaagggacaugccucacccuuacccccuucugcugcaccaaccaccgauucaacugauucuaucaccggccaaaauaguagacagagagaggaagaacucgagcucauugaccaguugcgcaaacauauagaguauagacuuaaggucagucuuccuugcgaccucggagcugcccuuacagauggagucguacugugucaccuagcgaaccacgucaggccacgcuccguccccucuauccacgugcccagucccgcuguuccaaaacuuacaauggcuaaguguagacgcaauguggaaaacuuccuggaagccugucgcaaaauuggcgugccucaggacaaccuguguucccccuccgauauacuccaacuaaaucucuccgugaagcgcacaguugaaacacugcugucccugggagcucauucugaagaaaguuccuuugucugccuuucccugcagcuguuagguuucguagcauuuuacugcacagugaugcuuacgcuaugcgugcuguacuacugguuguuucccgccagauag

SEQ ID NO: 14545 - RNA, 804 nt, Artificial Sequence
  Description of Artificial Sequence: Synthetic coding sequence
auggggccugaagcucugaguucacugcuacugcuucuucuuguugccuccggcgacgccgacaugaagggccauuuugacccggccaaguguagauaugcuuugggaaugcaagauagaaccauccccgacuccgacaucucagccucuuccaguuggucugauagcacagcugcccgacauucccgccucgaaucauccgacggagacggagcuuggugucccgcaggcucaguguuccccaaggaggaagaguaccugcagguggaucuccagaggcugcaccucguagcgcuggucggcacucagggaagacaugccggaggguuggggaaggaauuuagcagauccuauagauugagguauagucgagacggaagaagguggaugggauggaaagaccgcuggggccaggaggugauuagcggaaacgaggauccagaaggugugguauugaaggaucugggccccccaaugguugcucgucugguccgguucuacccacgcgcugaucgcguaaugucaguaugccugagaguggagcuuuaugguugucucuggcgggacgggcuguugucauacacugcuccugucggucagaccauguaucucucagaagcaguauacuuaaacgauaguacauacgacggucacacagugggcggccuccaauauggaggguuaggacagcuggcagauggagugguaggcuuggacgacuuucgcaaaucucaggagcuaaggguguggcccgguuaugacuaugucggcuggucaaaucauucuuucagcucgggauacuag

SEQ ID NO: 14546 - RNA, 345 nt, Artificial Sequence
  Description of Artificial Sequence: Synthetic coding sequence
auggcaccaaagaaacucuccugucuccgcagccugcuauuaccauugucccugacguuguugcugccucaggcagacacacggucuuucguuguugaucgcgggcacgaucguuuucuccuagacggagcaccauucagguacgucagcgggagccuccacuauuuuagagucccacgcguacuaugggcggacagguuguuaaagaugagaugguccggccucaaugcaauacaauuuuacguuccuuggaacuaucacgaaccacagccuggcguguacaacuucaauggcagcagggaucugaucgcauuccugaacgaagccgcucucgccaaucucuag

SEQ ID NO: 14547 - RNA, 507 nt, Artificial Sequence
  Description of Artificial Sequence: Synthetic coding sequence
gcaccccgcauggaaauguuucagggucuccugcuccugcugcugcuuagcaugggaggcacgugggcuucaaaagaaccccuucguccgagaugccgaccaaucaacgccacgcucgccguagaaaaagaagguugcccuguuuguauuaccgugaauaccacuauuugcgccgguuacugucccaccaugacucggguucuucaggggguucugccagcucuaccccaggugguuuguaauuaccgugacguccguuucgaauccauucggcucccaggauguccuagaggagugaaccccgucgugaguuacgcugucgcgcuuaguugucagugcgcucuguguaggagaucuacaaccgauugugggggcccuaaagaccaucccuugacaugugacgacccccgguuccaggauucaucuagcuccaaagccccuccccccucucucccgaguccgucccgucuccccgguccuagcgacacaccaauccucccccaguag

SEQ ID NO: 14548 - RNA, 1203 nt, Artificial Sequence
  Description of Artificial Sequence: Synthetic coding sequence
auggagacacaagaauugagaggcgcucuggcacuccugcuuuuguguuuuuucaccagcgcgagucaggaccugcagguuaucgaucugcuuaccgugggggagucucgacaaaugguggcuguggcugagaaaauuaggacagcccugcugaccgcuggagacaucuaccuucuaaguaccuucagacuuccgccaaagcaagggggaguguuguucggccuuuauuccagacaggauaacacacgauggcuggaagcauccguugugggaaaaauuaacaaagugacgaaugcacuccauuccauccucggagagggaaauguuccugacccuaagcaccacuacgguguauccggauuccacgagcagcgaucccauugcagcccuaauccuugcuucagaggcguggauuguauggagguguaugaguacccgggauacaggugcggaccauguccucccgggcuccaagggaacggcacucauugcucagacauuaacgaaugugcacacgcagauccuugcuuuccugguucuucuugcaucaacaccaugccagguuuccauugugaagccugcccacgggguuauaagggcacacaggugagcggaguaggcauugacuaugcccgagcaaguaaacaaguauguaacgacauagacgaauguaacgacggcaauaacgguggaugcgauccuaauucaaucugcacaaacacagugggcagcuuuaaaugugguccaugcaggcucggcuuccucggaaaucaaucacagggaugucugccagcaagaacaugccacucuccugcgcauagccccugccacauccaugcgcacugccuauucgagcggaacggcgcuguauccugccaaugcaacgugggaugggcugguaauggaaacgugugcggcacugacacggauaucgacgguuaucccgaucaagcccuaccuugcauggauaauaauaaacauuguaagcaagauaauugccugcugacacccaauucuggccaggaagacgccgacaaugacgggguaggagaucaaugcgacgaugacgcugacggagaugguaucaagaacguggaggcaucuccaauggacuggaccauagcacugaagucacccacccacuauagacaaaccggaaugcgaacaggcugggaaauguuggccaccgcggcucugaaauag

SEQ ID NO: 14549 - RNA, 618 nt, Artificial Sequence
  Description of Artificial Sequence: Synthetic coding sequence
augaugcggacccuaauaacuacgcacccccuaccauuacuucuccucccccagcaguuacuucagcuagugcaguuccaagaaguagacaccgacuuugauuucccugaggaggacaagaaagaagaauuugaagaaugccuggagaaguuuuucagcaccggaccggcaagaccacccacuaaagaaaaggugaaaaggcgggugcugauagagccuggcaugccacuaaaucacaucgaauacuguaaccaugagauuaugggaaaaaacguguauuacaagcaccgcuggguagcugaacacuacuuccugcugaugcaauaugacgaacuccagaaaauuugcuauaauagauuugugccaugcaagaacgggaucagaaaauguaaccggaguaagggacugguggaggguguguacugcaaucugacagaagcguuugagauacccgcauguaaauaugagagccuguaccgcaaaggauacguguugauuacaugcagcuggcaaaacgaaaugcagaagagaauuccccauacuaucaacgaucuggucgaaccacccgaacaucggagcuuucugagcgaggauggcguguucguaauuucaccauag

SEQ ID NO: 14550 - RNA, 177 nt, Artificial Sequence; identical to SEQ ID NO: 12911
  Description of Artificial Sequence: Synthetic coding sequence

SEQ ID NO: 14551 - RNA, 450 nt, Artificial Sequence
  Description of Artificial Sequence: Synthetic coding sequence
augaagguuaucgccauucugacucuucugcuguuuugcucaccaacccauuccucauucuggcaguuucagagaaggguaaagcauauaacuggccgaagcgcauucuucucauauuacgguuacgguugcuauugcggacuuggggacaaaggcauccccguugacgauaccgacagacacuccccuuccagcccgagcccauacgagaaacuaaaagaauuuuccugccaaccagugcuuaacagcuaccaguuccauauugucaauggcgcgguagugugcgggugcacccuagggcccggugcaucgugccacugucgccuuaaagccugugaaugugacaaacagucugugcacuguuucaaagagucccuccccacuuacgaaaagaauuuuaagcaauuuucaagccagccgcgauguggacgucauaagccaugguguuag

SEQ ID NO: 14552 - RNA, 237 nt, Artificial Sequence; identical to SEQ ID NO: 12913
  Description of Artificial Sequence: Synthetic coding sequence

SEQ ID NO: 14553 - RNA, 1461 nt, Artificial Sequence
  Description of Artificial Sequence: Synthetic coding sequence
augaucuccccaucaccaucacaggaggagcuccagacaacgcuggaagaaacagaccagucaacgcaggaaccuuuuacaaccaaaauuccuagaaccacagagcuggcgaaaacaacacaagcuccacaucguuuuuacaccacuguuaggccucgaaccucugauaagccucacaucagaccagugcucaacagaacuacaacccgaccaacucgcccaaaaccgucuggaaugcccucuggcaacggugucgguaccggggucaagcaagcaccacguccuucuggggcugaccggaacgugagcgucgauagcacacacccuacaaaaaagccagggacccguagaccuccccugccgccacggccaacccacccaagacggaagccacuccccccuaauaacgugacaggaaagccaggcuccgccgguaucauuucaucuggcccgauuaccaccccccccuugcgcucaaccccaagaccuaccggaacuccccuggagcgaauagagaccgauaucaagcaaccaacaguaccugccaguggcgaagagcuugaaaauaucacagauuucucuaguucuccgacucgugaaacagacccccuaggcaaaccucgguuuaaaggcccgcacguucgcuauauccagaaacccgauaauagccccugcuccaucaccgacucaguuaagcgcuuuccaaaagaagaggcaaccgaaggcaacgcaacaucgccaccccagaauccucccaccaaccugacuguagucacgguagaggguuguccaaguuucguuauacucgauugggagaaaccauugaacgacaccgugacagaguacgaggugauuagccgcgagaauggaucauucucaggcaagaauaaauccauccagaugacuaaccagacguucuccacagucgaaaacuugaagccuaacaccucauaugaguuccaaguuaaaccuaaaaacccccugggggaagggcccguguccaauacaguagccuuuagcaccgaauccgcagauccuaggguauccgaacccgucuccgcgggaagagacgcaaucuggacugaaagacccuucaauagugacuccuacuccgaaugcaaaggaaaacaguacguuaaacggacuugguacaagaaguuugucggugugcaacuguguaauagucuaagguauaaaaucuauuuaagcgacucacucaccggcaaauucuauaacaucggagaccaacgcgggcacggcgaagaucauugccaguucgucgacucauuucucgauggacggacaggucaacaacucacaucugaucagcuacccauaaaagaaggcuacuuuagggcuguacggcaggagccugugcaguucggugaaaucggcggucacacccagauuaacuaugugcagugguacgaauguggcacaacaaucccaggaaagugguag

SEQ ID NO: 14554 - RNA, 243 nt, Artificial Sequence; identical to SEQ ID NO: 12915
  Description of Artificial Sequence: Synthetic coding sequence

SEQ ID NO: 14555 - RNA, 1341 nt, Artificial Sequence
  Description of Artificial Sequence: Synthetic coding sequence
auguugcaccccgaaacaagccccgggcgcggccauuuauuagccgugcugcucgcucuccuaggcacaacuugggcggaaguuuggcccccacaguuacaagagcaggcaccaauggccggcgccuuaaacagaaaggaaucauuucuucugcugucucugcacaaucgccuccgcuccuggguccagccgcccgcugcugacaugagaagacuggacuggagugauucucuggcucaguuagcccaagcacgugccgcucuuugcggaaucccuacaccuuccuuagccuccgggcuuuggcggacacuacaaguaggauggaacaugcagcuacugccagccggguuagcaagcuuuguggagguggugagucuuugguucgccgaggggcaacgcuauucgcacgcagcuggcgaaugcgcacgcaaugccacauguacccacuacacgcaacucgugugggcaaccucuucacagcuggguugcggcaggcaccuguguucugcgggacagacagccauugaagccuuugugugugcuuacagcccgcgaggaaacugggaggucaacggcaaaacaauaaucccauauaagaaaggagcaugguguagccuguguaccgccucagucaguggcuguuuuaaagccugggaccaugccggaggauuaugugaagucccuaggaauccguguagaaugucuugucagaaccacggaagacucaacauauccaccugccacugucacuguccaccaggauauacgggaagguacugucaagugcgcugcagccugcagugugugcauggaagguuuagagaggaggaauguucgugcgucugugauauaggcuacggcggagcccagugugcgacaaaggugcauuucccuuuccacacaugcgaccuccguaucgauggagacuguuucaugguaagcucagaggcugacaccuauuaccgagcaaggaugaagugccaacggaaagggggcgugcuggcucagaucaaaucacagaaagugcaggauaucuuagcuuuuuacuuagggcgccuugaaacaacuaaugaggucaucgacagcgauuucgaaacacggaacuuuuggauaggauugacguacaaaacagcaaaagacagcuucagaugggcuaccggagagcaccaagccuucaccuccuuugccuucggacagccagauaaccacggauucggaaauugugucgagcugcaggccucagcagcuuuuaauuggaacgaucagcgauguaaaacaaggaaccgguacauuugucaguuugcccaagaacauaucucacggugggggccugggaguuag

SEQ ID NO: 14556 - RNA, 432 nt, Artificial Sequence
  Description of Artificial Sequence: Synthetic coding sequence
augcaggccgcgugcugguauguccuuuuccuucuacagcccaccgucuaucuggugacuugcgccaaccuaacaaauggggguaagucggaguuguuaaagaguggauccuccaaaagcacccuuaagcauauauggaccgaguccucuaaagaucuuucgauuucaagacuguugagucagaccuuccgcgguaaggaaaaugauacagaccuggaccugcgcuaugacaccccugagccauacagcgaacaagaucugugggacugguuacggaauaguacugaccuccaggagccuagaccucgcgcaaaaagaagacccaucguaaaaaccgguaaguuuaagaaaauguuuggauggggcgacuuccacuccaauauuaaaaccgugaaguuaaaucugcucaucaccggaaagaucguggacuag

SEQ ID NO: 14557 - RNA, 783 nt, Artificial Sequence
  Description of Artificial Sequence: Synthetic coding sequence
augcagggagaaccauucgcaugcuugacccaccaggagccucuucccaagauguucaagcuguuaagccgggcguacgccgacgugcauccuaugaugauggaccggucugaaaauagguguggcggaaauuuucugaaaaggggcucuaucauaaacggcgccgacugguauucuuuuacugggggaaugagugauuuuaacuaccugcauacaaauugcuuugagauuacuguugaacuggguugcguaaaguuuccgccugaagaagcccuuuacauacuuuggcagcacaauaaagagucccugcuuaacuuugucgagacagugcaucgcgguaucaaagggguaguuaccgauaaauucggaaaacccguaaagaaugcucgaauuucagucaaaggaauccgacacgacauuaccacggccccugauggcgacuacuggcguuugcuuccccccgggauucacauugugaucgcacaggcuccuggguaugcaaaaguaauaaaaaagguuauuauuccggcaagaaugaagagggccggcaggguagauuuuaucuuacagccucuggguauggguccaaagaacuucauucacggacugagacgaacagggccucaugacccucugggcggcgccucuaguuugggugaggcgacagaaccagacccacugagagcaagacgacaaccauccgccgacggcucaaagccaugguggugguccuauuuuacgucacucucaacucauagaccaagguggcuauuaaaguacuag

SEQ ID NO: 14558 - RNA, 882 nt, Artificial Sequence
  Description of Artificial Sequence: Synthetic coding sequence
augucaagcgguggagguucacgcggucugcuagccuggcuguugcuccugcaacccuggcccggacagaauugggcuggcauggccgccccacggcugccaucucccuuguuaagcgaggagggcggugagaaucccgaagccaguccugccccaggaccugaagcuggcccuccccugaacuuguucacaucuuuucccggagauucucucuugugcgguaggacccccuugagaauaguuggaggcguagaugcggaggagggaagauggccauggcaggucuccgucaggacuaaagggcgccacauaugcggugggacgcucgucacagccaccugggugcugacagccgggcacugcaucucuaguagauuucauuacuccgucaagaugggagacagauccguuuacaacgaaaauacaucagugguagucaguguucagagggccuuuguucauccuaaauuuucaacggugaccacaauucgcaaugaccucgcucuguuacagcuccagcaccccgucaacuucacuaguaacauacaacccaucuguaucccccaggagaauuuucagguagaaggcagaacaaggugcuggguaacagguugggguaagacccccgagcgagagaaacuggccucggaaauccugcaagaugucgaccaguacaucauguguuaugaggaaugcaacaagauuauucagaaagcucuuucaagcacgaaagacgugauaauuaaagguauggugugcggauauaaggagcagggcaaagauucaugucaaggagauagugguggacgacuggcaugcgaauacaacgauacauggguucaggucgguauuguaaguugggggauaggguguggcagauag

SEQ ID NO: 14559 - RNA, 870 nt, Artificial Sequence
  Description of Artificial Sequence: Synthetic coding sequence
auguuuguacuauuguacgugacuaguuucgcuauuugugcaucuggacagccuagaggcaaucagcuaaaaggugagaauuacuccccccgauauaucugcagcauuccaggcuugcccgggcccccagggccaccuggagcuaacggcagcccaggaccgcauggacgcauuggccugccggggagggauggaagggacggacgaaagggggagaaaggagagaaagggaccgccggacugcgagguaagacugguccacugggauuggcuggcgaaaagggggaucagggagagacaggaaagaaaggaccgauuggacccgaaggagagaaaggugagguggguccuaucgggccccccggccccaagggcgauaggggcgagcaaggagacccagggcuuccaggcgugugucggugugggagcauuguacugaaaucugcguuuucuguugguaucacaacaagcuaccccgaggaacgucuacccauuaucuucaacaaaguucuuuucaaugagggcgagcacuacaaccccgcuacuggcaaauucaucugcgcuuuuccaggcauuuauuacuuuucauacgauaucacacuggccaauaaacacuuggcgauuggcuuaguucauaacggccaauaucgcauuaagacuuucgacgcaaauaccggcaaucacgaugucgcgagcggaucuacuguuauuuaccuucagccugaggacgaaguuuggcuggagaucuuuuucaccgaucagaauggauuguuuuccgaucccgguugggccgauuccuuauuuuccggauuucucuuguauguggauaccgacuaccuggacaguauaucagaagacgaugagcucuag

SEQ ID NO: 14560 - RNA, 2742 nt, Artificial Sequence
  Description of Artificial Sequence: Synthetic coding sequence
augggccccgaagcucuauccucccugcuucuguugcuguugguugccucuggagaugcugauaugaaaggccacuucgacccugcuaagugcagguacgcacuggguaugcaagacagaacgauucccgauagugauauaagcgcuucuuccucaugguccgacagcaccgcagcccggcauucacgcuuagaaaguucugacggagauggcgccuggugcccagcuggaagcguguuuccaaaggaggaagaguacuugcagguugauuugcagagauugcaccuuguugcacuggucggaacucaagggagacacgccggcggccugggcaaagaauuuagcaggaguuaucgccugcgauacucccgggaugggcgucgcuggauggguuggaaagaucgguggggccaggaagucaucucuggaaaugaggacccugagggaguugugcuaaaggacuuaggaccaccaaugguagcaagauuagugagauuuuauccucgggcagaccgcgucaugucagucugccugcgggucgagcuguauggaugccuguggagggacggccuucugagcuacaccgcacccguaggucagacuauguaccuuucugaagccguguaccuaaacgauuccacauaugacggucacacagucggcgggcugcaguacggaggacuugggcaauuagccgauggcgugguuggccuugacgacuuucgcaagagucaggaacucagagucuggccaggcuaugacuaugugggauggaguaaucauucuuuuucuagcggauacguggaaauggaauucgaauucgaucggcuccgagcuuuucaggcuaugcaagugcauuguaacaacaugcauacgcugggcgccaggcugccuggaggcguugagugccgauucaggagaggcccagccauggcaugggaaggagaaccgaugcgucauaaccugggaggcaaucugggcgacccccgggccagagcaguguccgugccacugggcggaaggguggcuagguuccuucaaugucgguuccuuuuugcuggaccgugguuacuguucucugagauuucuuuuaucagugaugugguuaauaauucuucccccgccuuaggaggcacauuccccccagcacccugguggccucccggacccccccccacaaacuucuccucucuggagcuugaaccacgcggucagcaaccaguagcgaaagcagagggcuccccuaccgcuauucugauuggcugccuuguggccaucauccugcuccuacuucugauuauagccuuaauguuguggagauugcacuggcgccgccuauuaucaaaagcugagagaagaguucucgaggaggaauugacaguucacuuauccgugccaggagacaccauccugaucaauaacagaccaggcccucgcgaaccucccccauaccaggagccucggccucgcggaaaccccccucauucugccccuugcguccccaacgguuccgcucuccuucugucaaacccugcuuaccgucucuugcuugcuaccuaugcgcgaccuccucgaggcccaggacccccuacaccagcuugggccaaacccacaaauacacaggccuacaguggcgauuacauggaaccagagaaacccggagcaccccuucucccucccccuccccagaauagugucccccacuacgcugaagcugauaucgugacucugcaaggcgucacggguggaaacaccuacgcagugcccgcuuugccuccaggcgccgucggcgauggucccccuagaguggauuuccccagguccagauugcgcuuuaaggaaaagcucggggaagggcaguucggagaaguacaucugugugaaguagauaguccccaagaccucguaagucuagacuucccccugaacguuagaaaaggccacccucuguugguggccguaaaaauacugcgccccgacgcgacuaaaaaugccagaaacgacuuucucaaagagguaaaaaucaugucacggcugaaggaucccaacauuauccgucuucuuggcgugugugugcaagacgacccucucugcaugauuacggauuacauggaaaacggcgaccugaaucaauuccuguccgcccaucaacucgaggacaaagcagcugagggugcuccuggcgauggucaagcugcucagggaccuacaauuucauacccgaugcugcugcauguugcugcccagauugccuccgggaugcgguaccuggcuacuuugaacuuugugcauagagaucuugcaacacgcaacugucugguuggcgagaauuuuacaaucaagauugcugacuuuggcaugucaagaaaccucuacgccggugacuacuacagaguacaaggaagagcugucuuaccaauuagauggauggcuugggagugcaucuugauggggaaauuuaccacugcuucagacguuugggcuuuuggaguaacucugugggagguacuaaugcuaugcagggcacagccauuuggccagcugacugacgagcaggugauugagaacgcuggggaauucuuccgcgaccaggggaggcaaguguaucugucuagaccgccggcuuguccacaggggcucuaugaacugauguuacguugcuggagucgggaauccgagcagcgacccccuuucucucagcuccacagauuucuugccgaagacgcacugaacaccguauag

SEQ ID NO: 14561 - RNA, 1089 nt, Artificial Sequence
  Description of Artificial Sequence: Synthetic coding sequence
augcgcacucuauuuaacuuacucuggcuggcacucgcuugcagcccaguucacaccacguugaguaagucugacgccaaaaaagcugcuucuaagacuuuacuggaaaagagccaguucuccgauaaacccguccaagauagaggguuagucguuaccgaucugaaggcggaauccguugugcuugaacacagaagcuacuguagugcaaaggcucgggacaggcauuuugccggagacguguuaggcuaugucacuccuuggaauagccacgguuacgaugugacaaagguauuugguagcaaguucacgcagaucucuccaguguggcugcaauugaagagacggggccgagagauguuugaagugaccggcuugcacgauguggaucagggguggaugcgcgcaguuagaaagcaugccaaggguuugcacauagucccacgcuuauuguucgaagauuggacauacgaugauuuccggaacgugcuugacuccgaagaugagauugaggagcucucgaagacaguaguucagguggccaaaaaccagcauuucgacggauuugucguggaggucuggaaucaguugcucucacagaagagagugacagaccagcuuggcauguuuacucauaaggaauucgaacaacuggccccuguacucgauggauuuagucucaugacuuacgacuacaguacagcacaucagccuggaccuaaugcccccuugagcuggguaagagcaugugugcaagugcuagacccgaaaagcaaguggagaagcaagauucuguugggcuugaacuucuacggaauggacuacgccacuucuaaagaugcccgugagccugugguuggagcuagauacauccagacacuuaaggaucauagaccccggaugguaugggacucucaagcaagcgaacauuucuucgaauacaaaaaaagccgcuccggaagacauguuguuuucuauccuacacugaagucccuccaggugcgacucgagcuggccagagaauuaggcguuggcgucucuauuugggagcuggggcagggguuggacuauuuuuaugaccugcucuag

SEQ ID NO: 14562 - RNA, 1350 nt, Artificial Sequence
  Description of Artificial Sequence: Synthetic coding sequence
augaaauuucaggguccacuggcgugucuguuacucgcguugugucuaggcucuggagaagccggaccgcugcaguccggggaagagagcacaggaaccaacaucggggaggcucuugggcacggcuuaggagacgcgcucagugagggcguaggaaaagcaauagggaaggaagcuggaggugcugcuggaagcaaagugucagaggccuugggccagggcacucgggaagcaguugguacgggaguaaggcaggugcccgguuuuggaguggcggacgcccucggaaaucgcgucggcgaggcagcucacgcacucggaaauacuggccaugaaauuggaaggcaagcagaggacguuauacggcacggggcagaugcuguuagagguagcuggcaggggguacccggacacaacggggcaugggagaccucuggcgggcacggaauuuuuggaucucagggcggucugggaggacagggccagggaaauccuggcggucucggcacaccuuggguccacggguauccgggcaauucugccgggucuuucgggaugaacccacaaggcgcuccauggggucaggguggaaacggaggcccucccaacuucggcaccaauacucaaggcgcaguggcacagcccggauaugggucaguccgugcgagcaaucagaacgagggcuguacaaacccaccucccagcgggucgggcggaggaagcucuaauagcgguggcagcucaaccggaaguagcagcggcaaucaugguggauccgggggcggcaauggccauaagccaggcugugaaaaaccaggaaaugaggcaagagguaguggggagucagggauucaaggacaagguagcucauggggaucuggcgguggagaugccguugggggcgugaacaccgugaacucugaaaccuccccuggcauguucaacuucgauaccuucuggaagaauuucaaguccaagcuugguuuuauuaacugggacgccauuaacaaaaaucaggugccucccccaaguacgagggccuuacuuuauuuuagccgcuuaugggaagauuuuaaacaaaacacaccauuucucaauuggaaagccaucaucgagggcgccgacgccucaagucugcaaaaacgcgccggccgugacgaccagcccggcgcagguuggcaggaaguagcagcagugaccagcaaaaacuacaacuacaaccagcacgcguacccuacagcauacggcggaaaauacucagucaaaacaccugcuaaaggcggaguuagcccuaguucuuccgccucucgcguucaacccgggcugcuucaaugggugaaauuuugguag

SEQ ID NO: 14563 - RNA, 735 nt, Artificial Sequence
  Description of Artificial Sequence: Synthetic coding sequence
auguggggagcaccccugccacggcguccuguaugggauguuaggagcgccucugcuggaccacagccaugucuggggggaaagaugaaacuaaaucugguccagaucuuuuuuaugcuucugaugcugcuccucggacugggcaugggacucgggcucggccugcauauggccacugccguucuagaagaaagcgaccagccccugaacgaauuuugguccuccgacagccaggacaaggcugaagccacagaagagggcgauggaacacagacaacagaaacccucguguuaaguaacaaggaaguuguucagcccgguuggccugaggacccuauuuuaggcgaagaugaagugggaggcaacaaaaugcuaagagccagugcgcuguuccaaucaaacaaggacuaucucagacucgaucagacugaccgagaaugcaaugacaugauggcgcacaaaaugaaagagcccucgcagaguugcaucgcacaguaugccuucauccacgaagaccugaacaccgucaaagcaguaugcaauagcccugugauugccugugaacugaaagggggcaagugucauaagucaagucgccccuucgauuuaacguugugcgaacugagccaaccugaccaagucacccccaauuguaauuaucuuaccuccgucaucaagaaacacaucauaauaaccugcaacgauaugaagaggcaacugcccaccggccaguag

SEQ ID NO: 14564 - RNA, 1728 nt, Artificial Sequence
  Description of Artificial Sequence: Synthetic coding sequence
auggcuucaugguuaaggaggaaacuacgcggcaaacgccgcccugucauugcguuuugucuucugaugaucuuaagcgccauggcuguuacucgauucccgccucagaggcccucagcuggcccggaucccggaccaauggaaccacaggguguuacgggugcaccugccacucacaucagacaggcccuuucauccucccggcggcagcgggcucguaauaugggauuuuggcgguccagagcacugccuagaaauucaauucuggugugcgcagaagaacaggggcacagagcuaggguugauaggucuagagaguccccuggcggugaucuucgacacccgggaagaguuaggcgugauauuacauuguccgggcauccaagacugucaacacagcacguggugcuccugagagaggacgagguuggggauccuggcacaaaggacuuaggacacccucagcacggcagcccaauccaagagacccaaucugagguggugacacugguguccccucucccaggcucggacauggcggcacuaccugcuuggcgagcuacuuccgggcucacucuauggccccauacagcggaagguagagauuuguuaggggccgagaaccgggccuugacagggggccagcaggcagaggacccuacauuggcuucuggggcucaucaguggccagguucaguugaaaagcugcaaggcagcguguggugcgaugcagaaacauuguugucaucaucucgcaccggaggccaggcaccuccaugguuaaccgaucacgacguucagauguuacgucugcuugcccaaggggagguuguugacaaagcgcgcguuccagcccacggacagguccugcaaguuggauucucgaccgaagccgcguugcaggaucucuccagccccaggcugagccagcuuugcucucagggacuuuguggccuaaucaagcgaccaggagaucugcccgagguccuuaguuuccaugucgaccgagugcuuggccuacgucggucucucccagcuguugcgagacgguuccauagcccucuucuucccuaucgauacacugacgguggcgcccggccgguuauuuggugggccccagauguucagcaccugucagacccugaugaggaucaaaauucucuugcccucggguggcuucaguaccaagccuugcuugcccacucaugcaauuggccuggucaggccccauguccgggcauccaccauaccgaaugggcacggcuggcacuuuuugacuuucuacugcaaguacaugaccgccuggaucgcuauuguugcggauucgagccagaacccucagaccccugcgucgaagagaggcugagagagaagugccagaaccccgccgaacuuagacucguacauauacugguccggucguccgacccuucacaccuggucuacauagauaaugcugggaaccugcagcauccugaggacaaguuaaauuucaggcuguuggaggggauagauggauucccagagucagcugugaaagugcuggccagcggcugccuucagaauaugcuacucaagagucugcaaauggauccugucuuuugggagagccagggaggcgcacaaggacuaaaacaggugcuccaaacacuggaacaacgugggcagguguugcucggucacauccaaaaacauaaucuuacacuguuccgcgaugaagauccuuag

SEQ ID NO: 14565 - RNA, 390 nt, Artificial Sequence
  Description of Artificial Sequence: Synthetic coding sequence
auggcugcgggaucugcuccaaugcaacuccaccugcgcgcaacaauccggaugaaagacggacugugugugccccgaaaauggauauaccaucucaccgaagguaguacagaccuccguacagaggggagaccagauaugaagacugaauuauuuuccucuucgugccccggcggcauaaugcucaacgaaacaggucaaggguaccagagauuccuguuguacaacagaagcccacauccgccagaaaaauguguggaagaauucaagucccucacauccugccucgauucaaaggccuuucugcugacuccccgaaaccagggaaaaggcuuaaaaucccauaaaaccggauuggguuuaacaaaaucgaguggcgugaccggguag

SEQ ID NO: 14566 - RNA, 567 nt, Artificial Sequence
  Description of Artificial Sequence: Synthetic coding sequence
auguuccaccagaucugggcagcgcuguuauacuucuauggaauuauccuuaacucaaucuaccagugcccugaacauucccagcucaccacauugggcguggacggaaaagaauucccggaaguucacuuaggacagugguacuucaucgccggagcugcaccuacuaaagaggagcucgcgaccuuugaccccgucgacaauaucgucuucaacauggcagccggcagcgcuccgaugcaauuacaccugcgcgccacaaucagaaugaaagauggucuuugcguuccgcgaaaauggaucuaucacuugaccgagggaucaacugaccugaggaccgagggaagacccgauaugaaaacugaacuguucagcucaaguugccccggaggaauaaugcuuaacgagacuggccagggcuaccaacgguuucuccuguauaacagaucgccacacccaccugaaaagugcguggaggaguuuaagucccugacgucuugccuugacuccaaagcauuucugcugacaccccgaaaccaggaggcuugcgagcugaguaauaauuag

SEQ ID NO: 14567 - RNA, 2676 nt, Artificial Sequence
  Description of Artificial Sequence: Synthetic coding sequence
auguugccaaccgagguuccacaaagccacccuggucccagcgcccugcuccuucugcagcuccuccuaccccccaccucagcguuuuuuccaaacaucuggucccugcuggccgccccuggaagcauuacacaccaagaucucaccgaggaagccgccuugaaugucacccugcaguuguuucuggaacaacccccucccggcagacccccacugcgccuugaggauuuucucgggaggacacugcuggccgacgaccucuucgccgcuuacuucggccccggcucuaguagacguuuucgggccgcucuaggagaagucagccgcgccaaugcagcccaagauuuccugccuacuaguagaaacgacccagaccugcacuuugaugcagaacggcugggccaggggagagcccgguuagugggagcauuacgugagacuguaguugccgcccgcgcauuagaccacacccuggcaagacaacgccucggugccgcccugcacgcccuccaggacuucuacucccacaguaauuggguugaacucggagagcaacagccucauccucaccuuuuguggccccgccaagaguuacagaaucucgcacagguagcugaucccacauguucagacugugaagaacuaucuuguccgcguaauuggcucggcuucacuuugcuaaccucuggguacuuugggacacauccccccaaaccacccgggaaaugcucgcacgggggacacuuugaucgcagcagcagccagcccccaagaggcggcaucaauaaggacagcacaucuccuggauucaguccucaucacaugcugcauuuacaggccgccaaauuagcccuucuggcgucuauacaagccuuuucccuacugcgcucacgacuaggcgacagagauuuuucaagauugcuagacauuacacccgccucuagucuuuccuuuguccuggauacaacuggaagcaugggagaagaaaucaaugcugccaagauccaagcacgccaccucgucgagcagcgcaggggcagccccauggaaccuguucacuacguguuagugcccuuucacgaucccggauucgggccuguuuucaccacuuccgaucccgacagcuuuuggcaacagcugaaugaaauccacgcccucggaggaggcgacgaacccgagaugugccucagcgcacugcagcuggcucuacugcacacaccgccucuguccgacauauuuguuuucaccgacgccagccccaaggaugcauuccugacuaaccaaguagaaagccugacacaggagcgucguugccgcgugaccuuucuuguuaccgaagacacgagcagaguccaggggagagcacggcgggagauucugucaccauuaagauuugaaccauacaaggccguggcccuggcuucagggggggaagugauuuucacaaaggaucagcacauuagagauguggccgcaauaguaggagagucuauggccgcccucgugacacuaccccuagauccuccaguagucguccccggccagccacucguguucucugucgauggacuucuccagaaaauuacaguccggauucauggagauauuaguuccuuuuggaucaaaaacccagcaggaguuagccaaggacaggaggaaggaggagguccccuuggacauacccgcagauucggacaguuuuggaugguaacaauggaugaccccccucagaccgguacuugggagauacaggucacugcagaagacacucccggugugcgcgugcaggcacagaccucacuggauuuucuguuccauuucggaauaccuauggaagacggcccucaccccggcuuauauccucugacacaacccgucgccggacuccaaacccagcugcuggucgaagucacuggccuaggcucacgcgccaaucccggggacccucagccgcacuuuucucacgugauccuacggggugucccugaaggcgcggagcucggucaaguaccccuggaaccuguaggaccccccgaacgaggucuccuggccgcaucgcugucaccuacgcugcuguccacaccccggcccuucagucuggagcuuauaggccaggacgcagcuggcagacgucuucaccgugccgcuccucagccaucaaccguugugccuguucugcucgaacugucuggccccucuggauuccucgcgccagggucuaagguuccccugucauuaaggaucgcgucuuuuucugggccucaagaucucgaucugcggacguuugucaaccccucauucagccucaccucuaaccugucaagggcccaccucgaacugaacgagagcgccuggggcaggcuguggcuggaagugcccgauagugccgcucccgauuccgugguaaugguaacggucacugccggcggaagagaagccaauccuguaccaccaacacaugcuuuucugcgucuucucguuucagcccccgccccucaggaucgccauacaacuccaacaggcucaucagacccaauacucacuaccgccacacccgcauuuucuccuuucacacuggucacucaaggacgagcgggggcagggcucgccgcugguucaccuugguggggcacuguuggcggggugcugcugcuucugggucuugcaagcugguag

SEQ ID NO: 14568 - RNA, 2742 nt, Artificial Sequence
  Description of Artificial Sequence: Synthetic coding sequence
augggacccgaggcucuuagcucauugcuucuucuucuccugguggccucaggugaugcagacaugaagggacacuuugacccagccaaaugcagguaugcuuugggaaugcaggaucggaccauuccugauuccgauaucuccgccuccucuucuuggucagacucaaccgcugccagacauagccgccuggaaagcagcgacggcgacggagcuuggugcccugcuggcuccguguucccgaaggaagaagaguaccugcaagucgaucuucaacgccuccaucugguggcuuugguggggacgcagggaagacacgcuggugggcucgggaaagaguucucacgcucguauagauuaagauauagucgcgacggaagacgauggaugggcuggaaggaucgguggggccaggaagugauaagugggaaugaagacccagaagguguugugcugaaggauuuaggacccccgaugguggcucgacuagugagguucuacccccgcgcggaucgggugaugucuguguguuugagaguggaacuguauggaugucucuggcgugacggacuucugucuuauaccgcucccgucggacagacaauguauuuaagcgaagccguuuaucuuaacgacagcacuuacgauggacauacagucggcggucuccaguauggaggucuuggccaguuagcagacggggugguuggauuggacgauuuccggaagagucaggagcuuagaguuuggcccggcuaugauuaugugggguggucuaaccauuccuuuaguagcggauacguugagauggaauuugaguuugaucggcugagggcauuccaagccaugcaggugcacuguaacaacaugcauacccucggcgcuaggcuaccaggcggaguagaauguagguuccgcaggggccccgccauggcaugggagggcgagccaaugaggcauaaccuagggggcaaucucggagaccccagagcucgggccguuagcgugccucugggugggcggguagcacguuuuuuacaaugcagauuccucuucgccgggccuuggcugcuguuuucugaaaucucuuuuauaucugacgugguuaauaauuccaguccagcauuaggcggcacguuuccaccagcaccaugguggccaccgggacccccccccacaaauuucucuucguuagagcuugagccacgaggccaacagcccguagccaaagcugaagggaguccgacagcaauucucauaggcugccugguugcuaucaucuugcugcugcucuugauuaucgcucucaugcuguggagguugcacuggaggagacuucucucuaaggcagagaggcggguucucgaagaagaauugacugugcaccucuccgugccuggcgacacuauucuuaucaacaacagaccuggaccacgcgaaccucccccauaucaagaaccucguccgcgcggcaacccaccgcauucugccccuugcguacccaacgguucugcucuucuguugucaaaccccgcuuaucgcuuguugcucgccaccuacgcaagaccaccuagaggacccggaccccccacucccgcuugggcuaaaccuaccaacacacaggcuuauuccggcgacuauauggaacccgaaaagcccggagcaccucuauugccgccccccccacagaauucggucccacauuaugcagaagccgauauugucacacuacagggggucaccgguggcaauaccuacgcugugccagcauugccaccaggcgcugugggagauggucccccucguguugauuuccccagaucaagacugagauuuaaggaaaaguugggcgaaggucaguuuggcgaaguacaccuaugugagguugacuccccgcaggacuuggugagccuagauuuuccucucaacgucagaaaaggucauccccuuuugguugcagucaaaauucuucgaccugaugccacaaaaaacgcucgcaacgacuuucugaaggaaguuaagaucaugucacgccugaaggacccaaacauuauucgccugcucggcgucugugugcaggacgacccacuaugcaugauuaccgauuauauggaaaauggugaucugaaccaauuccuguccgcgcaccagcuggaagacaaagccgccgaaggagcaccuggcgauggucaagcagcacaaggaccuaccauuagcuaccccauguuacuccacguugccgcgcaaauugcuagcggaaugagauaucuugccacccugaacuucguucaccgcgaccucgcaacccggaauugccuggugggggaaaacuucaccaucaagauagccgauuucgggaugucccggaaccuguaugcaggugauuacuaucguguacagggaagagcaguucugccaaucagguggauggcaugggaauguauucugauggggaaauuuaccacugccucugauguuugggcauuuggagugaccuuaugggaggugcuuaugcuguguagagcccaaccauuuggccagcugaccgaugaacaaguaauugagaacgccggcgaauuuuuccgggaccaaggcagacagguauauuuaagcaggccacccgccuguccccagggucucuaugaauuaauguuaaggugcuggucgagggaguccgagcagagaccuccauucucgcaauugcaucguuucuuggccgaggacgcucucaauacaguuuag

SEQ ID NO: 14569 - RNA, 453 nt, Artificial Sequence
  Description of Artificial Sequence: Synthetic coding sequence
augcgcuuuauggcuggcccugccgguucucagagucuuggaccccucuguuuucacucuagcccccaggccuuauacacggugcuccuaaucguccuugugaugaugucucuugucuuuggaaaauuuguuccugucaacugggaacccccucagccucucccauuuccaaaauaccuccgcugcuauaggugccuccuggaaacuaaggaacuggguugucuccuugggucugauaucugcuugaccccugcugguagcucuugcauaacccugcauaaaaagaauucuucggggagugacgucaugguaucagauugcagguccaaagaacaaaugagugauuguuccaacacccggaccucucccgucagcgguuucuggaucuucagccaauauuguuuucuugacuucuguaaugacccccaaaaucgcggauuguacacacccuag

SEQ ID NO: 14570 - RNA, 192 nt, Artificial Sequence; identical to SEQ ID NO: 12931
  Description of Artificial Sequence: Synthetic coding sequence

SEQ ID NO: 14571 - RNA, 1212 nt, Artificial Sequence
  Description of Artificial Sequence: Synthetic coding sequence
augcaggguacucccggcgguggaacuagacccggcccaucuccaguugaucgaaggacccugcucguguuuucuuuuauccuugcugccgcccuuggccagaugaauuucacuggggaccagguucugagagugcucgcaaaggacgagaaacagcuaucacuacugggagauuuggaaggcuugaagccacagaagguagacuucuggagaggaccagcaaggccuucauuaccuguggacaugcgagugccauucagcgaacugaaagauauaaaagccuauuuggagucccauggccuggcguauaguaucaugaucaaagacauccaaguacuucucgaugaggaaagacaggcuauggcaaaaucaagacgauuagaacguuccaccaauucguucucuuacucuucauaucauacacuggaggaaauauauaguuggauagacaacuuugugauggaacauagugauauugucaguaagauccagauuggaaacucuuuugaaaaucaaagcauccuaguacugaaguucaguacggguggcagccgacaucccgcaaucuggauugauaccgggauccauagcagagaguggauuacucacgccacaggcauuuggaccgcuaacaagaucgucucagauuaugggaaagacaggguacucacagauauucucaaugcaauggacaucuuuaucgagcuggugacuaacccugauggcuucgccuuuacucacucaaugaaucggcucuggagaaaaaacaagaguauacgacccgguauuuucuguaucggcguggaccuuaaucgcaacuggaagagcggcuuugguggcaacggcucuaacucaaauccuugcagcgaaacuuaucaugggccaucuccccaauccgagcccgaaguugccgcaauaguuaauuucaucacugcacacgggaauuucaaggcguugaucuccauccauucauauucacagaugcugauguaucccuacgggcggcugcuggaaccagugucuaaucagcgagaacuuauguggcccgugggcagcccuucuacgggaccuaugacugucgccucaucgacccccucugcucugucuagugguacccucggcuccauggcaucauguugccgcccgcaucguucgagccccaggccaagaaggcgcgguuggcgguucggcccaagcugguccacgcccuag

SEQ ID NO: 14572 - RNA, 1542 nt, Artificial Sequence
  Description of Artificial Sequence: Synthetic coding sequence
auggccccugcucgcacuauggcccgggcccgacucgcccccgcugguaucccagcagucgcccuguggcugcucugcacacucggcuugcaaggcacacaggccggcccaccacccgcuccuccuggccuucccgcuggagcagacugccuuaauaguuuuaccgcuggggugccugguuucguguuggauacaaaugcuucagugucuaauggagccacuuuucucgaauccccaacagugcgcagaggcugggauuguguacgggcuuguuguacuacccagaauuguaaccucgcucuuguugaguugcagccagauagaggagaggacgccauagcagccugcuuccuuauaaacuguuuguacgagcagaauuucguuuguaaguucgcuccaagagaaggguuuaucaauuacuugacccgagagguuuauagaucuuaccggcagcuuagaacucagggauuuggugguucugguauuccgaaggcaugggccggcaucgaucuuaaggugcaaccccaagaaccgcugguacuaaaagauguagagaauaccgauuggcgucuccuuaggggcgauacugaugugcggguggaaagaaaggauccuaaccaggucgaguuguggggucucaaggagggcaccuaccuauuucaacuaaccgugaccaguucggaccauccugaagacacugcaaaugugacggucaccguguuauccacuaaacaaaccgaagauuauuguuuagccuccaacaaagugggucgauguagagguaguuucccaaggugguacuacgacccaaccgagcagauuuguaaguccuucgucuacggcgguugcuuaggcaacaagaauaacuaccugcgcgaggaagaauguauacuagccugucgaggcguccagggaccuucuauggagagacgucaccccgucuguuccggcacuugucagccuacucaauuccggugcucuaacggcuguuguauugacuccuuccuugaaugcgaugacacuccaaacuguccagaugcgagcgacgaggcagccugcgaaaaguacacaucuggcuucgacgaauuacagcguauccauuuuccaagcgauaaaggccacugcguagaucuaccggauaccggucuuuguaaggaauccaucccaagaugguauuacaaucccuuuucagaacacugcgcaagauucacauacgguggguguuauggcaacaagaauaacuucgaagaagaacaacaaugucucgagagcuguagggguauaucuaaaaaggacguguucggauuaaggagagaaaucccaauaccaagcaccggcagcguugaaauggcgguggcaguguuucuggucauaugcaucgugguggugguugcuauccugggcuacugcuucuucaaaaaccagagaaaagauuuucacggucaccaucaccacccacccccuacccccgcgucaagcaccguuaguacaacagaagauacagaacaucucgucuauaaucauacuacucgccccuuauag

SEQ ID NO: 14573 - RNA, 798 nt, Artificial Sequence
  Description of Artificial Sequence: Synthetic coding sequence
auggcaccuuggucucauccauccgcccaacugcaaccugugggaggagacgccgucucacccgcccugaugguccuacucugucugggacucucccugggaccccggacacaugugcaggccgggaaccucuccaaagcaaccuugugggcugagcccgguucuguuaucucccgcgguaacagcguuacuauccgaugccaggguacacucgaagcacaggaguaucgauuggugaaagaggguuccccugaaccuugggauacccagaauccccucgagccaaagaacaaagcucguuuuagcaucccaucgaugacagagcaccacgcaggucguuacagaugcuacuacuacucccccgccgguuggagugaaccuucagacccccuggaacuaguugugacaggguucuauaacaaaccaacacuuucugcacugccuagcccagucgucacuuccggcgagaacguaacauugcaaugcggcucuagacugcgguucgaucgauuuauucugacugaggagggugaucauaaauuguccuggacucuugacucucaacucaccccaucggggcaguuccaagcgcuuuuucccguggguccagugacaccgagccacagauggaugcuccggugcuauggaucacgucgccacauuuuacagguuuggucggagcccucagaccuauuagaaauccccgucuccggcgaagaggccacaguguuuuccaguacgauucagggaagucagacuggcuguggugagcucuacaggcaaggauccccauguuag

SEQ ID NO: 14574 - RNA, 795 nt, Artificial Sequence
  Description of Artificial Sequence: Synthetic coding sequence
auggaaaagccgaucuuaaaaaaccucaacgaaaugcucuguccaaucauugcuagcgaagugaaagcgcugaaugccaaucugagcacacuugagguccuuacuaaaauugauaacuacacacugcuggacuauucuuuaaucuccucccccgaaaucaccgagaacuaccuggaccuaaauuugaagggugucuucuauccccucgagaaccuuacugauccgccauucuccccugucccauuugugcuaccugaacgcagcaacuccaugcucuacauagguauugccgaguacuucuuuaagagcgccaguuucgcucacuuuacugccggcguauucaacgugacccuaucuacugaagagauauccaaucauuuuguucagaacagucagggacugggcaauguacuuucacguguagcuucaaccagcguggggcuugucaucuugggccaaagacuugucuguucccuuucacugaaccgcuuuagacuugcacuuccagaaucgaaucguucuaauauugagguuuuacguuucgaaaacaucuugucaagcauccugcauuucgguguccucccacuggccaaugccaagcugcagcaaggauuuccuuuaucuaauccucauaaauuccucuuuguuaauucugauauugaaguccuagaaggauuucugcucauauccacggaccucaaauacgagaccuccucuaaacagcagccgaguuuucacgucugggagggucucaaucuuaucucuaggcaauggcgcggcaaaucugccccuuag

SEQ ID NO: 14575 - RNA, 117 nt, Artificial Sequence; identical to SEQ ID NO: 12936
  Description of Artificial Sequence: Synthetic coding sequence

SEQ ID NO: 14576 - RNA, 567 nt, Artificial Sequence
  Description of Artificial Sequence: Synthetic coding sequence
auguuccaucaaauuugggccgcccugcuuuauuuuuacgguauaauccugaacagcauauaccagugucccgagcauagucagcucaccacacugggaguggacgggaaggaguuccccgaaguccauuuaggucagugguacuucaucgcuggcgcagcaccaacgaaggaagaacuagcuacauucgacccaguugauaauauaguguucaacauggcagcuggcuccgccccuaugcagcuucaccuccgugcaaccauccgaaugaaagauggucuauguguuccaagaaaguggauuuaccaccuaacagaaggaucaacugaccuaaggacugagggcagaccagauaugaaaaccgaacuguucuccagcucuugcccuggcggcauuaugcugaacgagaccggccaaggauaccagcgauuccuccuguacaaucgguccccacaucccccagagaagugugucgaagaguucaagucacucacgucuugucuugauaguaaagcguuccuauugacaccucggaaucaagaggcuugugaacuauccaacaacuag

SEQ ID NO: 14577 - RNA, 600 nt, Artificial Sequence
  Description of Artificial Sequence: Synthetic coding sequence
auggaaaccuucccucuacuuuuacucucuuuagggcugguucuagccgaagccucugagucuacaaugaaaauuaucaaagaagaguuuaccgacgaagaaaugcaguacgauauggcgaagaguggccaggagaagcaaaccauugaaauccuuaugaaucccauucuccuugugaaaaauacgucccuuucaaugucaaaagacgauaugagcagcacgcuacugacauuucguucacuucacuauaacgacccaaaggggaacucaucuggcaaugacaaggaauguuguaacgacaugaccguguggagaaaaguaagugaagcaaauggaucgugcaaauggucuaauaacuuuaucagaagcaguacggaaguuaugcgaagagugcaucgagccccgucuuguaaauuuguacagaauccgggcaucucuugcugugaaagucuugagcuggaaaacacagucugucaauuuaccacgggaaagcaauuuccucgcugccaguaucacucugucacuucacuagaaaagaucuugacuguucuaacaggccacagucugauguccuggcucguuugcggcaguaagcuauag

SEQ ID NO: 14578 - RNA, 30 nt, Artificial Sequence; identical to SEQ ID NO: 12939
  Description of Artificial Sequence: Synthetic coding sequence

SEQ ID NO: 14579 - RNA, 831 nt, Artificial Sequence
  Description of Artificial Sequence: Synthetic coding sequence
auggcccccucaccucugcagagacuacauugcggcccuucaccgagucccaggcccacagaaguaccucgggggacaguguccgucucaugucgguaccugaagaacagccuucaugucuuugucagcggcggagcuaucggcacuucguccccagcccuuuuggagugccaagaaggugucggaccagcacgucccucccuccucguuccuccuccaccucgcccucgccgcuuagaucucgcgagaacacuucccgcugagcgcaccgauagucagagccuguauaucguguauaucgcacugccaggccguacaccaagaccugcccuugcuuuugcguuucuaaugcccgcguguugcaaccgaccaagcccucgaccuuccccagcgcaucuaaccgcuuccagugugcugagaagacagcgucacguccuagccgcuuccgcugcaagcccaugccaguggagcgggcucagaguagcacauuccuuaagacaggugguuagccugugcccuagguguaccggauccugcccauucucuggcgcaugugcuucaucgcugccauccccucuuucuuguccacauucacacucuggauccuggggaaccuggagccaggggaggcccugcucgucuacagaagucgccggccuggcucuguggccaacagacuucuugucaugccucuuagaugcaagcgaacuccaaacccagggcagucacgguuucucuuuuacccccacaggcuucucuagcaaccggaaaguuggugugggaucuugcagggacggcgcuggacggggggccaugggcggucuguuuuag

SEQ ID NO: 14580 - RNA, 678 nt, Artificial Sequence
  Description of Artificial Sequence: Synthetic coding sequence
ugagcugaccuuccaucauguuggggcgccgggccgugcuauacaggccauaagguaggcgcccugcguagagauacagugaucuguuguuguagacauggagauuauuccacgcccugucucuucacacccgguaaacccaguagaaaucccucgccguggaaaaggacacuguggacucugucagcaccaugggcuggaccugccggauggacuggugaggaacaaaacgcaaccaaaaccggccugauuacucgcagaccccggccucugaggagacgaccccacccggcuccugcuaguccucugcccgaaauuauccgcggcaauauaccacgaaugcuugguaaguucgucccuguaaauugggagccuccccaaccguugccuuuucccaaauauuuacgguguuaucgcugccuucucgaaacuaaggaauuagguugccuccucggaucagauaucugcuuaacccccgccgggucaucgugcauaacucugcauaaaaagaacucaaguggcucugacgugauggugagugacugcagguccaaagaacagaugucagacuguaguaacaccaggacuucacccgugagugguuuuuggauauucucacaguacugcuuucucgacuucuguaacgacccccagaaccgaggcuuauauaccccuuag

SEQ ID NO: 14581 - RNA, 534 nt, Artificial Sequence
  Description of Artificial Sequence: Synthetic coding sequence
augguucccgccgccggcgcgcuucucuggguccugcuccuuaaucuggggccccgcgcugccggagcccagggccugacccagacaccuacggaaaugcaacgagucucacugcgcuucggcggaccuaugacuagaagcuaucgcuccacugcccgaacaggacucccucggaaaaccaggauuauuuuggaagacgaaaaugacgcgauggcagaugccgacagacuggccggaccggcugccgcggagcugcuggccgccacuguauccaccggauuuucucgaucuagcgcgaucaaugaggaggacggauccagcgaagagggcguagucauuaaugcaggaaaggacaguacauccagagagcucccgucagcaaccccuaauacagccggcagcagcaguaccagguuuaucgcaaacucucaagaacccgaaaucagauuaacgagcagccucccucgaucucccgggcgcagcacggaagacuugccucccugccaucugcuccggauuuguggaugguguuag

SEQ ID NO: 14582 - RNA, 912 nt, Artificial Sequence
  Description of Artificial Sequence: Synthetic coding sequence
augcuacacccagaaacuagcccugggcgaggccaccugcuugcuguguuacuugccuuguuaggaacugcaugggccgagguguggccaccacaguuacaagaacaggcucccauggccggcgcccuuaauaggaaggaauccuuucuucuacuaucauugcacaaucgucuacgcuccugggugcagccucccgcggcugacaugagacgacuugacuggagcgacucccucgcccaacuagcucaggcuagagcggcucuuugcggcaucccuacuccuucucucgcuuccggacucuggaggacauuacaagucggguggaacaugcaguuacucccagcaggccucgccaguuuuguggagguugucucucucugguucgcugaggggcaaagauacucccaugcagcaggcgagugcgccagaaaugcuacaugcacccacuauacucaacuggucugggcuaccucuucucagcuaggcugcgggcgacaucuguguucagcuggccaagcagccauugaagccuucgugugcgcguacagcccaagaggcaauugggaggucaaugguaaaacuaucgugccuuauaaaaaaggcgccuggugcuccuuguguaccgccagcguauccggauguuuuaaagcaugggaucacgccgguggccuaugcgaagugccccgaaauccuugccggaugucuugucagaaccacggacgacuuaauauuucaacuugccauugccacugcccaccugguuauacaggccgcuacugccaggugcggugcuccuugcagugcgugcacggucguuuuagagaagaagaauguuccugcgugugugauaucggauauggagaacccagcgugccaccaaggugcauuuucccgucgacacccgugacguag

SEQ ID NO: 14583 - RNA, 1482 nt, Artificial Sequence
  Description of Artificial Sequence: Synthetic coding sequence
uccgaggcuguguaucugaaugauucaaccuacgacggacacaccgugggcggauugcaguacgggggccugggucagcuggcugacggcguugugggucuggacgauuuucgcaagucccaagaauugaggguguggcccggcuaugauuauguggguuggaguaaccauaguuucucgagugguuacgucgaaauggaauuugaguucgaccgcuugcgagccuuccaagccaugcaggugcacuguaacaacaugcauacauugggugcaagacuccccggaggcguggaguguagguucaggcguggccccgcaauggcaugggaaggugaaccaaugcgacauaaccucggagggaaucugggugaccccagagcuagagcagucucaguaccccugggggguagaguggcgcguuuuuuacaguguagguuucuuuuugcaggccccuggcuccucuuuuccgagaucagcuucauuagcgauguggucaacaacagcucuccggcgcugggcggaacauuuccaccugcccccugguggccucccgguccaccuccgacaaauuuuaguaguuuggaacucgaacccagaggccagcagccuguggccaaggccgaggguucccccacagccauucuuaucggcugucucguugcuauuauucuccuccuacugcucaucauugcguugaugcuguggagguuacacuggaggcgccuguugucgaaaguucuagaaucacauccucgcacucggucuccuggucuuguugggauuaggcccaccccacuuccuguguccccgauggcccuccgaugcuguucucccauccaaccuacagcauccuucuggccucugacuccuguaccccucgaggcacgagcacccccccacccacccggcccuaauccacccaccccaagaggcgugacgggcgggaacaccuacgcagucccagcucugcccccuggagccgucggugacggcccuccucgcguagacuucccucgauccaggcugagguucaaggaaaaacugggagagggccaguuuggcgagguccacuugugugaagucgacuccccccaggaccugguuagcuuagacuucccuuugaaugucaggaaaggccacccauuacuaguggccguuaagauucuaaggccugaugccacuaagaacgccagaaacgauuucuuaaaggaggucaaaaucaugagcagacucaaggacccaaacauuaucagguuacugggcgugugcgugcaggacgaucccuuguguaugaucaccgacuacauggagaauggagaccuuaaucaguuuuuauccgcgcaccaauuagaagacaaagcagccgagggugccccgggcgacggccaagcggcgcagggcccuacuauuaguuacccaaugcuucuacacguggcugcccagauugcauccggcaugcgguaucuggcuacccugaacuag

SEQ ID NO: 14584 - RNA, 807 nt, Artificial Sequence
  Description of Artificial Sequence: Synthetic coding sequence
augaagcaaauucuacaccccgcauuggagaccacagauccuuguucgaccggcuucguuuuucccgccaugacacuuuucccaguucuauuauuccucguggcuggcuugcucccaucuuuuccugcaaaugaagacaaagaccccgcauucaccgcccugcucaccacacagacucaggugcagagggaaaucgugaauaaacauaaugaguugcgacgcgccguauccccuccugcucgcaauaugcugaaaauggaauggaauaaggaagcugcugccaaugcacagaaaugggcuaaccaaugcaacuauagacacaguaacccuaaagaucgcaugacgucucugaaguguggagagaaucuguacauguccucugccagcaguucuuggucccaggcuauucaaucuugguucgacgaguacaacgauuuugauuucgggguggggccgaagaccccuaaugcuguggucgggcauuacacucagguuguuugguauuccucauaccucguuggaugcggaaacgcuuacugcccaaaucagaaggugcuuaaguauuacuauguaugucaguauugucccgccggaaacugggcuaaccgucuguauguuccuuacgaacaaggagccccaugcgcaucuugcccugacaacugugacgacggccuaugcaccaauggcuguaaauaugaagaucuauacucaaauuguaagucccuuaaacuaacucugacauguaagcaucagcuggucagagacuccugcaaagcauccuguaacugcaguaauuccauuuacuag

SEQ ID NO: 14585 - RNA, 372 nt, Artificial Sequence
  Description of Artificial Sequence: Synthetic coding sequence
auguugccaaaaucaagacgcgcacugacuauucaagagauugccgcucucgcccgaucaagucugcacggcaucucgcaaguugucaaggaccacgucacaaaacccacagcaauggcacagggucgagucgcccacuugaucgaauggaaagguuggaguaagcccagcgacucacccgcugcuuuagagagcgcuuuuuccucauacucugaucugagcgagggggagcaggaagcucgcuuugccgcuggcguagcagaacaauucgcgaucgcggaggcuaagcucagggcuuggucgagcguggauggagaagacucaacagaugauucuuaugacgaagauuucgcuggugguauggauacuuag

SEQ ID NO: 14586 - RNA, 726 nt, Artificial Sequence
  Description of Artificial Sequence: Synthetic coding sequence
augggagcuguuauggguacuuuuucuagucugcagaccaagcagaggcggccaucaaaagacaaaaucgaagacgagcucgagaugacgauggugugucacaggccugaagggcuggagcaacuugaagcacagacaaauuuuaccaagagggaguugcagguucuauaucgcggcuucaagaacgagugucccuccggggugguuaaugaagacacuuuuaagcagaucuacgcccaauuuuucccacacggugcauugccuugucuggaaggcuccccuugcguggaauuccuucccccaucuccagccuuacucuuuugccucgucgacgccaguaccuaugcacacuauuuguucaacgccuucgacacaacucagacaggcuccgucaaguuugaggacuucgugaccgcccuaucgauuuuacuucgcggcacuguucaugagaaacucagguggacauucaaccuguaugauauuaacaaggauggauauaucaauaaggaagagaugauggauaucguaaaagcuauuuacgacaugauggggaaauacacuuacccaguacugaaggaagauacucccaggcagcacguagauguauucuuccagaagauggacaaaaacaaggacgggauugugaccuuagaugaauuucucgagagcugccaagaagacgauaauaucaugagaucacugcaacucuuucagaaugugauguag

SEQ ID NO: 14587 - RNA, 630 nt, Artificial Sequence
  Description of Artificial Sequence: Synthetic coding sequence
augggccccgaggcacugucaucuuugcuguuguuguuguuaguggccucuggugacgccgacaugaaaggacacuucgacccugcaaagugccgauaugcucugggaaugcaggauaggaccauuccagacucagauauuagugccuccucuaguugguccgauagcacugcagcacgccacucuagauuggagucaagcgauggggauggggcauggugucccgcaggauccguuuuuccgaaagaagaagaguaccuccagguggacuuacagcgccuacaccugguugcccuuguggggacucaaggaaggcacgcagguggccuggggaaggaauucagucguuccuauaggcuuagauauagcagagauggcagaagguggaugggguggaaagauaggugggggcaggaagugaucuccgggaaugaagaucccgaaggagugguacugaaagauuugggacccccaaugguugcucggcugguaagguucuaucccagggccgauagagugaugucagugugccugcggguggaacucuauggcugcuuauggcgcgacgggcuacuguccuauacugccccuguaggacagaccauguaccucucagaagcagucuacuag

SEQ ID NO: 14588 - RNA, 312 nt, Artificial Sequence
  Description of Artificial Sequence: Synthetic coding sequence
augagacaacgccugcugccuagcgucaccagucucuuacuuguggcgcugcuguucccagguucaucucaggcaaggcacguuaaccacuccgcaaccgaagcccugggagagcugagagagagagcaccugggcaagggaccaacggauuucagcuccuuagacacgcugugaaacgugaucuucucccuccgagaacaccuccuuaccaaguucacauaagccaccaggaagccaggggaccuucuuuuaagauuugcguuggauuccuaggaccuagaugggcgaggggcugcucuacagguaauuag

SEQ ID NO: 14589 - RNA, 426 nt, Artificial Sequence
  Description of Artificial Sequence: Synthetic coding sequence
augaaaaccggauuauuuuuucuuugcuuguuaggcacagccgcagcaauacccacaaacgcaagacuacucucagaucacuccaagccgaccgcagagacaguagcuccagacaauaccgccauaccaagcuugcgugcagaggccgaggaaaaugaaaaagaaacugcuguuucuacugaggaugacucccaucacaaagccgaaaaauccagcguccugaagucaaaagaggagucccacgagcagagcgccgaacaaggaaaaucgagcagucaggagcuaggccugaaagaccaggaggauagugacggccauuugagcgucaaucuggaguaugcaccuaccgaggggaccuuagacaucaaggaagacaugagugaaccacaggagaagaaacugagcgagaacacagacuuucuguag

SEQ ID NO: 14590 - RNA, 642 nt, Artificial Sequence
  Description of Artificial Sequence: Synthetic coding sequence
augcgacuugccggucccuuacgcaucguugugcuagucgucuccgugggcgugaccuggaucgucgugucaauccugcuggggggccccgguucagguuuuccaagaauucagcagcucuuuacaucaccggagucgagugugacagccgcgccuagagcaagaaaauacaaaugcggccucccacagccgugccccgaagaacaccuugcauuccgggucguuagcggugcagcaaacgugaucggacccaagauuugucucgaggacaaaaugcugaugucuagugucaaggacaauguggggcguggacugaacauugcccuggugaacgacgucaacgaccuccuaaaauuuauuagaccucugcacgaagggacacugguauuuguggcuagcuacgacgaucccgccaccaagaugaaugaagagacgcgaaagcuauuuagcgaacugggaucccguaacgcaaaagaacucgccuuuagggacagcugggucuucgucggcgccaaaggcguccagaauaaaucaccauuugaacagcacgucaaaaauaguaagcauuccaauaaauacgagggcuggccggaggcgcuggagauggaaggauguauaccccgcagaucuacggccagcuag

SEQ ID NO: 14591 - RNA, 2700 nt, Artificial Sequence
  Description of Artificial Sequence: Synthetic coding sequence
auguuauuacuucugcugcucgcuccacuguucuugaggccaccuggugccggcggcgcucagacaccaaacgcuacaucagaagggugccaaauuauccaccccccaugggagggcggcauccgguauagaggcuugacccgggaucagguaaaagcuauaaauuuccucccaguggacuacgagauugaauacgugugcagaggagaaagagaagucgucggcccuaaaguucguaagugucuggcaaacggcaguuggaccgacauggauacaccgagccgauguguaaaccggacaccccauuccgaacgccgggcggucuacauuggugcccuuuuuccaaugagcggaggauggccaggcgggcaagcuugucagccagcaguggaaauggcacucgaagauguuaacagcaggagggacauacugccggacuaugagcuaaagcugauucaccacgacucuaagugugacccaggccaggcuacuaaguaccuauacgagcugcuuuauaacgacccaauuaaaauuauucucaugccaggauguucuucagugucuacacucgucgccgaggccgcuagaauguggaacuuaauuguucugucauacgguuccuccucaccugcucugucuaaucgccaacgcuucccaacauucuuuagaacacauccuucagccacacugcacaacccaacaagagucaaguuauuugaaaaauggggguggaagaaaaucgccacuauacaacagacuacagaagucuucacuagcacucuggacgauuuggaagagcgcguuaaggaagcuggcaucgagauuacauuucggcagucauucuuuagugauccagccguaccaguaaagaaucugaagcgccaggaugcgagaauuaucguggggcuguuuuacgagaccgaggccaggaaaguguuuugcgaaguuuacaaggaaagguuguuuggaaaaaaauacgugugguuccucauaggcugguacgcugauaacugguucaaaaucuacgauccgucgauuaacugcacuguagacgaaaugacugaagcugucgagggucacauuacgacugagauugugauguugaauccggccaauacuagaaguauaucaaacaugacaucacaggaguuuguugagaaacucacaaagcgccugaaaagacauccugaagagacugggggauuccaagaagccccgcuggcauacgacgcuaucugggcacuggcacuggccuugaauaaaacuucaggaggggguggaaggucuggcguaagauuagaggacuuuaauuacaauaaucaaaccauuacugaucaaaucuaucgugcaaugaacucuagcagcuucgagggggugucaggccacgugguguucgacgcaagugggucucgaauggccuggacucugaucgagcaauuacagggcggcaguuacaagaaaaucggcuacuaugacucuaccaaggaugaucugucaugguccaagacugauaaguggauagguggcucaccuccagcggaccaaacacuggugaucaagacguuucgguuucucucccaaaaguuguucaucucggucucuguguugucgagucugggcaucguucuggccgugguauguuugucuuucaauaucuacaacucgcacguccguuacauccaaaauucccaaccuaaccucaacaaucuuacagcuguggggugcucucucgcccuugccgcgguauuuccacugggccuggauggcuaucauaucggcagaaaccaauuucccuuugucugucaagcccgauugugguuauugggccucggcuuuucacuggguuacggcaguauguuuaccaagaucugguggguucacacaguguuuaccaagaaagaggaaaaaaaggaguggagaaaaacacuugaaccauggaaguuauacgcaacuguaggucugcugguggggauggacgugcugacgcuggccauauggcaaauaguggacccuuugcaucgcacaaucgagacguuugcuaaagaggagcccaaagaagauauagacguuuccauucugccccagcucgagcacugcucuucucggaaaaugaauacuuggcuuggcauauuuuacggcuacaagggauugcuucuucuuuugggcaucuuccuggccuacgagacaaaauccgugagcacagaaaagauuaaugaccaccgggccgucgggauggcuauauauaacgucgcaguucuuugucucaucacugcgccugugacuaugauccuuuccucccaacaagacgcugccuuugccuucgccucacuugccaucguguucucaucauacauaacucucgugguuuuauucgucccuaaaaugaggcgcuugauaacucggggcgaguggcaaagcgaggcccaggacacuaugaaaaccggcagcaguaccaacaauaacgaagaggagaagucucgucuccuggagaaagagaaccgugaauuagagaagaucaucgcagaaaaggaagaaagagugagcgaacugagacaccagcugcagucuaggcaacaacugagguccagaagacaucccccaacacccccagagccgagcggagggcuuccacgagguccaccagaaccaccugauaggcuuucuugugauggaucuagagugcaucuccuauauaaguag

SEQ ID NO: 14592 - RNA, 192 nt, Artificial Sequence; identical to SEQ ID NO: 12953
  Description of Artificial Sequence: Synthetic coding sequence

SEQ ID NO: 14593 - RNA, 489 nt, Artificial Sequence
  Description of Artificial Sequence: Synthetic coding sequence
gacgaagaucgauacaccacuuguuggccaaaaacauggcuugcaaaggacugccccgcuuuaagaauuauauccguggaauacgauaccucucucagugacuggcgcgcucggugccccauggaaaggaaaaguauugcuuuccgcucuaaugaacugcuuagaaaacugagagccgcugguguuggagaccgacccguuguguggauuagucauagcaugggcggccugcuaguuaaaaaaauguuguuagaagcuaguacuaagcccgagaugaguaccgugauaaauaauacccggggaaucauauuuuacucggucccccaucauggaucccgcuuagccgaguacucaguaaauauaagguaucuguuguuuccaagccuggagguuaaagaacucucuaaggggaauacguucugucacaaaggaaacuggggcuauauuaacaucagcuacaccgaaaagaaaaagaaauuucugcccuag

SEQ ID NO: 14594 - RNA, 1083 nt, Artificial Sequence
  Description of Artificial Sequence: Synthetic coding sequence
augccagaguuggugguaacugcucuccucgcuccuucaagacuuagccucaaauuacugcgggcauucauguggucccuaguguucagugucgcucucguugccgccgcgguuuacggcuguauagcacugacacacguacucuguaggcccaggagagggugcugcggcaggcguagauccgcaucgccugccugucuuagcgaccccagcuuaggggagcaugguuuuuugaaucucaaauccucuggacuccggcugcacuacguauccgcuggacgcgggaauggaccucugauguuguuuuuacauggcuucccugagaauugguucuccuggcgguaucagcuucgggaauuccagucccgguuccacguagucgccguggauuuaaggggauacgggcccagcgaugccccuagagacgucgauuguuauaccauugaccugcugcucguugacauaaaagacgugauucugggucucggcuauucaaaguguauacucgucgcccaugauuggggggcucuccuggccuggcauuucucaaucuacuacccaucucuuguugaaagaauggucguugucagcggcgcuccaaugucagucuaccaagauuauucgcuccaccauauaagccaguucuucagaucccacuacauguuccuguuucagcuacccuggcucccugagaagcugcucaguaugucugacuuucagauuuugaagacaacccucacccaucgcaaaacgggcauccccugcuugacacccucugagcucgaagccuuccucuauaauuucucucagcccgguggacuaaccgguccccuuaauuacuaccgcaacuuguuucgcaauuuuccgcucgagccccaagaacuaacuacucccacccugcuauuguggggugaaaaggauacuuacuuagagcuuggguugguugaggcgauaggcagcagauucgugccugguagacuggaagcccauauccugccuggaaucggucauuggauuccccagucaaauccacaagaaaugcaccaguauaugugggccuuucuccaggaucugcucgacuag

SEQ ID NO: 14595 - RNA, 678 nt, Artificial Sequence
  Description of Artificial Sequence: Synthetic coding sequence
uaggcagaucuaccuagcuguuggggagcagguccuuguuauacagggcacaaagugggagcccuuagacgagacaccgucauaugcuguugucgccauggugauuauucaacccccugccucuucacuccuggcaagccuucuagaaacccaaguccuuggaagcggacccucuggacccugagugcuccuugggccgggccugccggauggaccggggaagaacagaacgccaccaagaccggacugauuaccagaagaccccggccgcuacgacgccggccacacccugccccagcgagcccucugccagaaaucauuagggggaauauaccacgcaugcucggcaaguuuguccccgugaauugggagcccccacagccacugccauucccuaaauauuuacgcugcuacaggugucugcucgagacaaaagaauugggcugccucuuaggguccgacaucugccuuacucccgccgguucguccugcauuacacuucacaagaaaaauuccuccgggucugauguuaugguuagcgacugcagaucaaaggagcagaugagcgacuguucuaauacccguacuucaccaguaagcggauuuuggaucuucucucaguauuguuuucucgacuuuuguaaugacccacagaauagaggccuguauacaccauag

SEQ ID NO: 14596 - RNA, 192 nt, Artificial Sequence; identical to SEQ ID NO: 12957
  Description of Artificial Sequence: Synthetic coding sequence

SEQ ID NO: 14597 - RNA, 5235 nt, Artificial Sequence
  Description of Artificial Sequence: Synthetic coding sequence
augaggcugcucuggggacugauuugggccucauccuucuucacccuaucucugcagaagccaagauugcugcuguuuagccccuccgucgugcaccugggcgucccccuauccgugggagugcaauuacaggaugucccacguggccagguugucaagggcuccguauuucucagaaacccuagucgaaacaacgucccauguagcccaaaaguggauuucacccucagcucagaaagagauuuugcucuacugucccuucaggucccacuaaaagacgccaaaagcugcggacugcaucaacuucuucgaggcccagagguccagcugguggcacacagcccaugguuaaaggauagccugucacgcacuacuaacauacaagguauuaauuuacuguuuucuaguagaagaggccaucucuuucugcaaacugaccagccuauauacaauccugggcagagagucagguacagggucuucgcccucgaccaaaagaugcgcccaagcacagacacgaucacagugaugguggagaacagucauggucuacgagugcggaaaaaagagguuuacaugccaucuuccaucuuccaagacgauuuugugauccccgacauuagcgaaccagguacguggaagaucucugcaagguucagugacggcuuagaauccaauaguucaacgcaguucgaggucaaaaaauacguucuccccaauuucgagguaaagaucacaccaggaaaacccuacauucugacugucccaggacaucuugacgagaugcagcuggacauccaggcacguuauauuuacggcaagccagugcagggcguggcuuaugugcgcuucggucugcuugacgaggaugguaaaaagacuuuuuucagaggauuagagucucagaccaagcuugucaacggccagucacacauaucacucaguaaggcugaauuucaggaugcuuuggaaaaguugaauaugggaauaacugaccugcaaggacugcguuuauacgucgcugccgcaaucauugaguacccuggaggagaaauggaggaagcugaauugacaucaugguacuuuguaagcucacccuucagccuggaucugucgaagacaaaacgucaccugguucccggggcacccuuccugcugcaggcccucguucgggaaaugucaggaucuccagccagcgggauucccguuaaggucagugcuaccgucuccucaccugggucugugcccgaaguucaggauauacagcaaaacacugauggauccggucaaguaucuauccccaucauuaucccgcaaacuaucagugaacuccagcugucagugucugcuggaucuccccaucccgcuauugcgcgucugacuguggccgccccucccuccgggggucccggauuucuuuccaucgaacgaccugauucuagaccuccucgcgucggcgauacccugaaccugaaucugcgagcugugggcagcggcgcuacguucucacauuauuacuacaugauacucucuaggggucagauuguuuucaugaaucgagagccgaaaagaacucucacaucagucucuguuuucgucgaucaccaccuggcgccgagcuuuuauuuuguggccuuuuacuaccauggcgaucauccaguugccaacucacugcguguggaugugcaagcuggggcuugugaaggaaaacuggaacucucugucgacggugcaaagcaguauaggaauggagagucugucaaacugcauuuggaaacugacucacuagcucucguugccuuaggagcccuugacacugcucuuuacgcagcuggaucaaagucccauaaaccauuaaauauggguaaagucuucgaggcuaugaauucuuaugaccuggggugcggaccaggcggaggcgauagugcacuucagguauuucaggcugcagggcuugcuuucucugauggagaccaauggaccuuaucacgcaagcgacugagcugcccaaaagaaaaaaccacacgcaaaaagaggaacgugaauuuucagaaggccauuaacgaaaagcugggucaguacgcuucuccuacugcuaagcgcuguugccaggacggcgugacacguuuaccaaugaugagaagcugugagcagagagcagcaagaguucagcaaccagauugcagagagccauuucucucaugcugccaguuugccgagucgcugagaaagaagagccgcgacaagggacaagccggacuacagagggcucucgagauacugcaagaagaggaucucauagacgaagacgacauuccuguuaggucuuucuuuccugagaauuggcuuuggcgugucgagaccguagaccgauuccagauccucacauuguggcugccugauucucugaccaccugggaaauccacgguuuaucacugucuaaaaccaaaggccucuguguugcaaccccgguacaacugcgaguuuuuagagaguuccauuugcaucugaggcucccgaugucuguacgcagguuugaacagcuggaacugcgcccaguccucuacaauuaucucgauaagaaucugaccgugucugugcauguuaguccuguggaaggccuuugucucgcagguggaggagggcucgcucagcagguguuggugccggcaggcagugcacgcccagucgcguucucuguggucccuacugccgcagcggcuguaucccugaaggucguggcuagaggcucauuugaguuucccgugggcgacgccgucucuaaaguguuacagauugaaaaagaaggcgccauccaccgcgaggagcugguguacgaauugaacccacuugaccaccgagggcguacucuggagauaccugguaacagcgacccgaauaugauuccagauggagauuuuaacucauacgugagagugacugccuccgauccccucgacacacuuggcagcgagggugcuuugucuccuggaggcguggcaucccuucugaggcuuccuagaggguguggggagcaaaccaugauuuaucuggcaccaacacuggccgcaucccgguaucuggacaagaccgagcaauggucaacacucccucccgaaacaaaggaccacgcaguggaccugauccagaaaggcuauaugagaauccaacaauuuagaaaggcugauggcucuuacgccgcguggcuguccagaggcucuuccacuuggcugacggcuuucgugcugaagguucugagcuuggcccaggaacaggugggggguucuccugagaaacugcaagaaaccucaaacugguugcucucgcaacagcaggccgacggauccuuccaagaccugagcccaguaauccauagaaguaugcaaggggggcugguaggcaaugacgagacuguggcccucacugccuuugucacgauugccuuacaucacggccucgccguguuucaggacgagggagcugagccacugaaacaaagaguugaggcgucaauuucuaaggcuucuucuuuccucggugaaaaagccagcgcaggcuuacucggagcucaugcagccgcuauuaccgccuacgcccugacucuaacgaaagccccugccgaccugcguggagucgcacauaauaauuuaauggcuauggcccaggagaccggagauaacuuauacugggggucaguaaccggcucucaguccaacgccgucaguccgaccccagccccccgcaaucccucugacccuaugccacaagccccugcacuauggauugaaaccacagcauacgcucuccugcaccugcugcuacaugaagggaaagccgaaauggcagaucaggcugcagcgugguugaccagacaaggaagcuuccaaggcggauuuagaucaacccaggauacagucauugcgcucgacgcucugucagccuacuggauugcaagccacaccacagaggaacggggucugaacguaaccuugagcagcacaggaagaaauggguucaaaagccacgcgcugcagcugaacaacagacagauuaggggccuggaggaagaauuacaguucucuuuaggguccaagauuaacguuaaagugggggggaacucuaaggggacacuaaagguucugaggacuuacaacguguuagauaugaaaaauacaacuugccaggaucugcagaucgaagugacugugaagggccacguagaguauacuauggaagcgaaugaggauuaugaggauuaugaauacgaugaacuaccugcaaaagacgaccccgacgcaccauugcagccagugaccccucuucaauuauucgaaggucggagaaauagaaggaggagagaggccccgaaagugguugaagaacaagaaaguaggguccauuacaccguguguaucuggcggaauggcaaggucggccugucaggaauggcuaucgccgacgugaccuugcugagcgguuuccacgcauugagagcagaucuggagaaauugacaagcuugucugauagauauguuucacacuuugaaaccgagggcccacauguucucuuauacuuugauucaguaccgacgucccgggaaugcgugggguuugaggcaguccaagaagucccuguuggccucguccagcccgcuucugccacucuguacgauuacuauaaccccgagagaagaugcaguguuuuuuauggcgcuccuagcaagucgcgacuucuggcaacacucuguagugcagaaguaugccaaugugcugaagggaaauguccccgucaaaggagagcucuggaacggggcuuacaagaugaggacggcuacagaaugaaguucgccugcuauuacccuagaguggaguauggcuuccaagugaagguucugcgggaagacuccagagccgcuuucaggcuguuugaaacaaaaauuacucaaguacugcauuuuacuaaagacgugaaagccgccgcaaaucagaugcgcaauuuccuggugagagcaucaugcaggcuacggcuggaacccgguaaagaauaccugauuaugggauuagacggggcaacauaugaucuggaaggacauccucaguaucuccuagacuccaauucauggaucgaggaaaugcccuccgagagacuuugccgaagcacuagacagagagccgcuugcgcgcaguugaacgacuuuuuacaggaauacggaacacaaggaugucagguuuag

SEQ ID NO: 14598 - RNA, 792 nt, Artificial Sequence
  Description of Artificial Sequence: Synthetic coding sequence
auggccgacaugcagaaucuaguggagaggcuggaacgagcaguaggaagauuggaggcagugucacacacuagugauaugcaccgcggcuaugcagacucuccaucaaagggcgccgcaccauauguucaggcauuugauucuuugcucgcgggcccaguagcugaauaccucaaaaucaguaaggaaaucggaggcgacguacagaaacacgcagaaauggugcacacuggcuugaaauuggaaagagcccugcuugugacugcaucacaaugccagcagccagcagagaauaaacucucagaccuccucgcuccaaucucugaacagauuaaagaagucauaacauuucgagaaaaaaauagggguucaaagcuuuucaaccaucuuuccgccgugucagaaagcauucaggcgcuggguuggguugccauggcaccgaagccaggaccguaugugaaagaaaugaacgacgccgccauguucuauacuaauagaguccugaaggaguauaaagauguggauaaaaaacacguagacugggucaaggcuuaccugucgaucuggacagaguugcaggccuauauuaaagaauuucauacaacaggccucgcguggucuaagacagggccgguugcaaaagaacucagcggauuacccucugggccaagugcgggcucuuguccuccucccccucccccuuguccuccaccaccucccgucaguacaaucuccuguaguuaugaauccgccucccgcucaaguuuauucgcucagaucaaccaagguuag

SEQ ID NO: 14599 - RNA, 501 nt, Artificial Sequence
  Description of Artificial Sequence: Synthetic coding sequence
augggcccugaggcucuguccagccugcuguuacuccuccucguggcaucaggugacgccgacaugaaaggccauuucgacccugccaagugccgcuacgcccugggaaugcaggauaggaccaucccagauucugacauuucagcuagcucuucguggucugauucuacugcugcacggcacucuagguuggaaaguucugacggagauggagcguggugcccugccggaagcguguucccuaaagaggaagaauaucuccaaguugaucuccagcgacugcaucuuguggcccuaguugguacucagggacgacaugcaggagggcuggguaaagaauucucucguagcuaucggcuacgguauucucgcgaugguagacgguggauggguuggaaagaccgguggggccaagaggucauaagcggcaaugaggauccugaaggcguggugcugaaagaucugggaccuccuaugguggcucgccuugugcguuuuuag

SEQ ID NO: 14600 - RNA, 2349 nt, Artificial Sequence
  Description of Artificial Sequence: Synthetic coding sequence
ucuauccugagaguagaggcuguagacgcagauugcagcccccaguucagucaaauuuguagcuaugaaaucaucacgccugacguaccuuuuacuguggacaaggauggcuacauuaaaaacaccgaaaaacucaacuauggcaaggaacaucaguacaaacugacgguuacagccuacgacuguggaaagaagagagcuaccgaagacguacuagugaaaauaaguauaaaaccaacgugcacaccggguuggcagggcuggaauaaucgcauugaauacgagccggguacuggugcgcuagcggucuuuccaaauauucaucuagaaacuugugaugaaccaguugcaagcgugcaggccacggucgaacucgagacuagucauaucggaaagggaugugaucgcgauaccuacucugagaagucacugcauaggcuuugcggcgcugcugccggaaccgcugagcugcugccaucccccucuggcucccucaauuggacgaugggccuaccaaccgauaaugggcaugacuccgaccagguuuuugaauuuaacggcacccaggcgguaagaauuccugaugggguggugucugugucaccuaaagaaccuuucacuaucuccguguggaugcggcacggcccuuucggcagaaaaaaagaaaccauuuugugcucauccgauaaaacugauaugaauagacaucacuacagcuuauacgugcacggauguaggcucauuuuucuauuuaggcaagauccuuccgaagaaaaaaaguaccgcccugccgaauuucacuggaaacuuaaccaagugugugaugaagaguggcaccacuaugugcugaacguugaguuucccuccgugacucucuaugucgacgguaccucccacgaaccuuucucugugacagaggacuauccacugcauccauccaaaauugagacucaauuaguaguuggggcuugcuggcaaggcggugaccuucacaugacccaguuuuucagagguaauuuagccgggcucacauugcggucagggaagcuagcagacaaaaaggugauugacugucuuuacacuuguaaagaaggccuggaucugcaaguacucgaggacagcggacggggcgugcaaauccaagcucaucccucucagcuggugcucacauuagaaggggaggaucucggcgaauuagacaaagccaugcagcauauuucauacuuaaauucgagacaauuucccaccccaggaaucaggagacugaagauaacuucuaccaucaaauguuucaacgaagcgacaugcaucuccgugccaccuguugacgguuacgugaugguuuuacagcccgaggaaccuaaaaucagucuuucuggagugcaccauuucgcaagagccgcuucugaguucgaaucuucugaagguguguucuuguucccugagcugcgcaucauuaguaccauaacccgagaaguagagccugagggagacggagcagaggauccuaccguucaggaaucauuagucucagaggagaucguucacgauuuggacaccugugaggucacaguagagggagaagaacucaaucacgaacaggaaagucuugaaguggauauggcccggcugcagcagaaaggaauagaggucucaucaagcgaauuagguaugacauuuacuggcguugacaccauggcaaguuaugaagagguacugcaccuauuacgguacagaaauuggcaugcuaggagccuccucgaccgcaaauuuaagcucauuuguucugaacuuaaugggagauauaucagcaacgaguuuaaggucgagguuaacguuauccauaccgccaaccccauggagcacgcaaaucacauggcagcucaaccacaauuugugcacccagaacaucgcucguuuguagauuuguccggccauaaucucgccaauccccaucccuucgcaguagugcccuccaccgcaacagugguuaucgucguuuguguaagcuuccucguguuuaugauuauacugggcguuuuccguauccgcgcugcacaucgacggacaaugcgcgaccaggacacugggaaagaaaacgaaauggacugggaugauuccgcccugacaauaacgguaaaccccauggagacuuaugaggaccaacauagcucagaagaagaagaagaggaagaagaagaggaggaaagcgaagacggugaggaagaagacgacaucacaucagcagaaagugaaucgagcgaggaggaagagggggagcagggagacccacagaacgcuaccaggcagcagcaguuagagugggacgacagcacuuuguccuacuag

SEQ ID NO: 14601 - RNA, 531 nt, Artificial Sequence
  Description of Artificial Sequence: Synthetic coding sequence
auggcacggagacauugcuucucuuacuggcuucucgugugcuggcuggucguuaccguggccgaagcccucucuaccuuuuaucugcagcagcacaucaaucugcacauggacaaaaagcguuaucugcgacugcuggaaauccacaaaaucaugaggacucugcccacugcccgcucgcuucacucaccuuuacaucugccccguggagugcgaucucaaggaccaucuccuagccaacgucacccuggugucccuagcauauuuuuucacgaagggcccgaguccaucuuaggcuuccaaacagaccugaguucuuuacagggaguuaccaccguauuucauagcucacauuucauuggccacaccguuacgcuccucauagguauuucaccugaggaagacucucgcgaagaagcccaccugcgcaaagcugaacgagaggaaaaaccaaagcauaccgaagccaagaagucacucucauuucguaagaaacagcagaaggauuuuugcuuuauuuuucgcaauuag

SEQ ID NO: 14602 - RNA, 1182 nt, Artificial Sequence
  Description of Artificial Sequence: Synthetic coding sequence
augcgcacccuguucaacuuacuguggcuugcgcuugcaugcucacccguccauacuacacuguccaagagcgaugcaaagaaagcugcaagcaagacccugcucgaaaagucacaauucuccgauaagcccguucaggacagaggccucgugguaaccgaucugaaagcagagagcguaguucuugagcaccggucuuauugcuccgccaaggccagagauagacacuuugcaggagauguauuaggcuaugugacucccuggaauagccacggguacgauguuacaaagguuuuuggaucaaaauuuacucagauuucgccagugugguuacaacuuaagagaagagggagggaaauguuugaagugacaggacuccacgauguggaccagggguggaugagagcuguuagaaaacacgccaaagggcuucacauugugccacggcugcuguucgaggauuggacuuaugaugacuuucggaaugugcuggauuccgaagaugagaucgaggagcugucaaaaacaguagugcaagucgccaagaaccagcauuucgauggguuugucguagagguuuggaaccaacugcuuagccagaaacgcgugggacugauucauaugcuuacacauuuagcagaagcacuucaucaggcacgccuccuggccuugcuugugaucccccccgcuauaacucccggcacggaccaguuggggauguuuacccauaaagaauucgaacaacuugccccugugcuugacggguuuucucugaugacauaugacuauucaacugcgcaccaaccgggcccuaaugccccucugucuuggguucgagcaugcguccagguucuggacccaaaaucuaaguggaggucuaaaauccuuuuaggucugaacuuuuauggcauggacuacgccacauccaaagaugccagggaaccaguggugggcgcucgcuauauucaaacucugaaagaccauagaccccgcaugguaugggacucacaggcaagugaacacuuuuucgaguauaaaaaaagucgcucuggacgucacgugguguuuuauccaacguugaaaagcuuacaaguuagacuggaacuggcacgagaguugggaguggggguaucuaucugggaacuggggcagggacuggauuauuuuuaugaucugcuguag

SEQ ID NO: 14603 - RNA, 324 nt, Artificial Sequence
  Description of Artificial Sequence: Synthetic coding sequence
augcuacccugccuggcacugcuauuacuuauggaacugucggugugcacaguagcaggagacgguggcgaagaacagacccuuucgacggaggcugagaccugggagggagcagguccgagcauucagcugcagcugcaggaaguaaaaacagguaaggcaagucaauucuuuggcuugauggggaagcgagucggggggcggccauugauacaaccuagacgcaagaaagcguaucaguuggagcauaccuuccaaggauugcucgguaaacggucacuuuuuacugaaggacgggaagacgaggcucaaggaucagaauag

SEQ ID NO: 14604 - RNA, 1086 nt, Artificial Sequence
  Description of Artificial Sequence: Synthetic coding sequence
augggaauuauccagagcauacuugcgaccagccgggacuguuacuccuucaaaaagaaaccuauuccuaagaaaccgacaaugcuugcucuagcaaaaauacugcugaucucuacccucuucuacagcuuauugagcgggucccacggcaaagaaaaucaagacaucaauacuacacagaacaucgcggaggucuucaaaaccauggaaaacaaaccaaucucgcucgagucagaagcgaaccuaaacuccgauaaggagaauauuacaacauccaauuugaaagcuagucauagcccaccccucaaucuacccaacaacucccacgggaucaccgauuucagcaguaacaguagcgcugaacacucccucggcucacuuaaaccgacaucgacaaucagcacaagccccccacugauccacuccuuugucagcaaagucccuuggaacgccccuauagcagacgaagaucuacuaccuaucucagcccaccccaaugcaacaccagcacugucguccgaaaacuuuacauggucccuugucaaugacacagucaaaacgccggauaacucuaguaucaccgucaguauucuguccucggaaccuacauccccaagcguaacuccccugauuguagaaccaucaggcuggcuaaccacuaacuccgacucauuuaccggauucacaccuuaucaagaaaagacuacucuucagcccacacugaaauuuacaaacaauuccaaguuauuuccaaauaccagcgauccgcagaaagagaauagaaacacagguauuguuuucggggcaauucuuggcgcaauacugggggucucguugcugacccugguuggguaucuacuguguggaaagagaaagaccgauucuuucucccaucgacgauuguacgaugaucgaaaugagcccguauugcgauuggauaacgcucccgaacccuaugaugucagcuuugguaauucaaguuauuauaaccccacguugaaugauagcgccaugccagaauccgaagagaacgcucgcgauggaaucccuauggaugauauuccuccuuuaagaaccucuguguag

SEQ ID NO: 14605 - RNA, 279 nt, Artificial Sequence; identical to SEQ ID NO: 12966
  Description of Artificial Sequence: Synthetic coding sequence

SEQ ID NO: 14606 - RNA, 1125 nt, Artificial Sequence
  Description of Artificial Sequence: Synthetic coding sequence
uagcggguccgacggggcccccuaccagcugaccgcccacgcgcccuaggcccugcuaggcgcugcuccagacacccacaucccgcucccuuucgcgucuguuccgaaggcgcugcucauagacugaggagacccgaacgccucccucugcccagcagggcccuacggccucgacccgcacauaccccuauccucggccccgcacccagagcgugccccggcgcccccagggccagugacaguccaaccugugcugccgcggcugcuacugccuggccccgcacccgagccgucgagcguaaaggcugccaaguugcugcugccgccggcguucguggaacaggaugucccucgagagccgaucuggaaaaagauagcuggaaugacaccaaagaggacguuuucgugcaucagacggccaucaagaaaaauaacccuagaaaauacuuacgcagcgugggagacggcgagacgguggaauucgaugugguggagggggagaagggagcagaggcugcaaacguuacggggccgggggguguuccugugcagggaucaaaauacgccgcugaccggaaucacuauagaagguacccucgcaggagaggcccgccccgcaacuaucagcagaauuaccaaaacagcgaguccggcgagaaaaacgaggguuccgagucggcuccggaaggacaagcccaacaaagacgaccguaccggcgaagacgcuuuccgccuuacuauaugagacgcccuuauggaagacggccgcaguauagcaacccaccugugcaaggugaaguaauggagggagcagauaaccaaggagccggagaacagggacgucccguucgccagaacauguacaggggguaucgcccgagauuuagaaggggacccccucgucagcgccaaccccgagaggaugggaacgaggaggacaaggagaaccagggcgaugaaacgcaaggacaacaaccaccacaacgcagauaccgacgcaauuucaacuaccgcagacgacgccccgagaacccuaaaccccaggauggaaaggagaccaaggcagcagauccuccagcagagaacucguccgccccagaggcugagcaaggcggugccgaauag

SEQ ID NO: 14607 - RNA, 420 nt, Artificial Sequence
  Description of Artificial Sequence: Synthetic coding sequence
auggcauugcggauguugugggcugggcaagcaaaggguauucuugggggauggggaauuauuugccugguaaugucucuucuccuacagcacccagggguguacuccaaauguuacuuucaggcacaagcccccugccacuacgagggaaaguauuucacccuuggcgagucuuggcuaagaaaggauuguuuucacuguacgugccuucacccgguuggggugggauguugcgacacaucucagcacccuauugauuuuccugcaggcugcgaggugaggcaagaggcagguaccugccaguuuucacugguccagaaguccgacccuagacuacccuguaaaggaggcggcccugaucccgaguggggauccgcuaacacccccgugccuggcgccccugccccacacucuucauag

SEQ ID NO: 14608 - RNA, 462 nt, Artificial Sequence
  Description of Artificial Sequence: Synthetic coding sequence
cauuacugcaaagaaggcuacuaucgggauaugggaaaacccauaacacacagaaaggcauguaaagccugugacugccauccuguuggcgccgcaggaaagaccuguaaucagacaacuggccagugccccuguaaagacggaguuacagguaucaccugcaacagaugcgccaaaggauaccagcaaucaagaagcccaauagcaccuuguauaaagauacccguggcgccaccuacuacagcugcuaguuccguggaagaaccugaagcagcacgccaaccuaacacauuucaggccgaaggccugagccugcugccaggagccgcugagaaggagggugcgagauguugggguuacaggcgccgccuaggccauaggguagcacaggcugaaugucgagggccacggucaugggcuuggggaagaauuacuucaucuuucucguuugcuuccaauuag

SEQ ID NO: 14609 - RNA, 213 nt, Artificial Sequence; identical to SEQ ID NO: 12970
  Description of Artificial Sequence: Synthetic coding sequence

SEQ ID NO: 14610 - RNA, 567 nt, Artificial Sequence
  Description of Artificial Sequence: Synthetic coding sequence
auguuucaucaaaucugggcagcucugcucuacuucuacgguauuauucugaacuccauuuaucaaugcccagaacacagccaacuaacaacgcucggcguugacggcaaggaguuuccugagguacaucucggccagugguauuucaucgcuggagccgccccgacaaaagaggaacuggcuacauuugacccuguugacaauaucgucuucaacauggcggccggaagugccccaaugcaguuacaccucagagcaacuauucgcaugaaagauggccucugugugccccgcaaauggauuuaccaucuuacagaaggaucuacugaccucagaacagaaggcaggccagacaugaaaacggaacuguucaguucaaguuguccaggcgguauuaugcuuaacgaaaccggccagggcuaucagagauuucugcuguacaaccgcuccccccaccccccagaaaaaugcgucgaagaguuuaaaucucuuaccagcugcuuagacucaaaggcuuuucuacugaccccuagaaaccaggaggccugcgaauugucaaacaauuag

SEQ ID NO: 14611 - RNA, 2316 nt, Artificial Sequence
  Description of Artificial Sequence: Synthetic coding sequence
augggaugguugaccagaaucguguguuuauucuggggaguucuauugacggcccgagcaaacuaucagaacggcaaaaacaacgugccgagauuaaaacucaguuauaaggagauguuggaaagcaauaaugugauaaccuuuaacggacuggcaaauucaagcucauaccacaccuuccuucucgaugaggagagaucaaggcuguauguuggagccaaagaucacauauuuagcuucgaccucgugaacaucaaagauuuucaaaaaauuguuuggccuguauccuacacccgacgagaugaaugcaagugggcuggaaaagacauucugaaagaaugcgcaaauuucauaaagguucugaaggcuuacaaucaaacccaccuguacgcuugcgguacuggcgcuuuucauccaaucugcaccuauauugaaauaggccaucacccagaggauaacaucuuuaagcuggaaaauucgcacuucgaaaacgguagaggcaagucucccuacgacccaaagcuucuuacugcaucccuucucauugauggcgaacucuacuccggcacugcugcggacuuuaugggccgggacuuugcuauuuuucgaacacuugggcaccaccacccuaucaggaccgaacaacacgacucccgguggcucaacgacccuaaauucauuucagcucaucugauuuccgaguccgacaauccagaagacgacaagguuuauuuuuuuuuucgugagaaugccauagauggagagcacagcggcaaggcuacacaugcuaggauaggacaaaucuguaagaaugauuuuggagggcaccgcucucucgucaauaaauggaccaccuucuuaaaagccagacucaucugcucugugccaggccccaauggcauugacacucacuucgacgaauuacaggacgucuuccuuaugaauuuuaaggauccaaaaaaccccgucguuuaugguguguuuacaacaagcaguaacauauuuaaagggucugccguaugcauguauagcaugucugacguccggaggguuuuccucggacccuacgcacacagagauggcccaaacuaccaauggguucccuaccaaggucggguucccuaccccaggccuggaaccugucccagcaagacuuucggcggcuucgacucuacaaaagacuugcccgaugauguaauuaccuucgcucgaucucaccccgccauguacaacccuguuuucccaaugaauaaccggcccauagugaucaagacagacguaaacuaucaguucacucaaauagugguagacaggguggacgcagaggacggucaauacgaugugauguuuauugguaccgauguugggacaguacugaagguugugucuauuccuaaggaaaccugguacgaccuggaagaagugcuacuggaagagaugacgguguuuagggaacccaccgcaauaucagcgauggagcuuucuacuaaacaacagcaauuauacauagggaguacugcugguguagcccagcuaccacugcacagaugcgacaucuacgggaaagcaugcgcagaguguugucucgcccgugauccauauugcgcaugggacggcagugcauguucaagauacuuuccuacugccaagcgucguacgagaagacaagacauaagaaacggcgacccacugacucacuguagcgacuugcaccacgauaaucaccacggacauagcccagaggagaggauuauuuauggcguagaaaacucgagcaccuuucuggaguguuccccuaaaucccaaagagcucucguguauuggcaauuucagaggaggaacgaagaacggaaagaggagauucgcgucgacgaccacauuauccguacagaucagggucuacuucuaaggagucugcaacaaaaagauagugggaacuaucugugccacgccgucgaacauggauucauccagacacugcugaaagucacguuggaggugauugacacugaacauuuagaagaguugcuccacaaagacgaugauggggacggcaguaagaccaaagagaugagcaauucuaugaccccgucacaaaagguuugguaccgcgauuuuaugcaguuaauuaaucacccaaacuuaaacacaauggacgaauuuugugaacagguguggaagagagauagaaaacagaggagacaaaggccaggacauacccccggaaacagcaauaaguggaagcaucuucaggaaaauaagaaaggaagaaaccgucgcacacacgaguuugagcgcgcaccaagaagcguguag

SEQ ID NO: 14612 - RNA, 1014 nt, Artificial Sequence
  Description of Artificial Sequence: Synthetic coding sequence
auggcgcgaccaaugaucaaggaagccagaauggccagccuucugcuugaaaauccauauuacggaugccggaaacccaaggaucagguaagaagcucccugaaaaauguguccgaucuguucgugauggggggcgcauugguucuggaguccgcagcauuacugcauuggcuggagcgggaaggguacgggccguugggcaugacuggaaucaguauggggggacauauggcuucacucgccgucucaaauuggccuaaaccaaugccacuaauccccuguuugagcuggaguacugcuucaggagucuucacaaccggcguuuuguccaagagcauuaacuggcgagaacuggaaaaacaauauuacacucaaacgguauaugaagaggagaucauacauauguuggaguauuguggaaccgacagcuucaagaugggccaggaguucgugaagcacuuuacuucuagcgccgacaaacugacaaauuugaaccuagugucucgaacgcugaaucucgauaucaguaaucaggucgugucacagaaaccugccgacugucauaauagcagcaaaaccuccguuuccgcaacgucagaaggccuucucuugcaggacacaaguaagaugaaacguuuuaaccagacacugucaacuaacaaauccgguuacaccagccgcaauccucaguccuaccaccuacucagcaaagaacagucucgaaauucacucaggaaagagagucuuauuuuuaugaaaggagugauggacgaauguacucaugucgcuaacuuuuccgucccugucgacccaucacugauuaucgucguacaagcuaaggaagacgccuacauuccaaggaccggcgugcgcucacugcaggaaauauggcccggcugcgagaucagauaccuugaaggcggccacauuagcgcguaucuguucaagcaggguuuauucagacaggcuaucuacgaugcauucgaccgcuucuuacacaaguacgccaauuag

SEQ ID NO: 14613 - RNA, 462 nt, Artificial Sequence
  Description of Artificial Sequence: Synthetic coding sequence
augggacccgaagcacuaaguucccugcuccucuugcuguugguggccucuggugaugcagauaugaagggacauuucgacccugccaaaugcagauaugccuuggggaugcaggacaggacaaucccugauagugauauaucagcaaguucgagcuggagugacucaaccgccgcccgccauucacgccuggaaagcuccgacggugacggcgcuuggugcccagcuggaucuguguucccaaaagaggaagaguaccuacagguugaccuccagagacuccaucucgucgcucuugugggcacccaaggccggcacgccgggggguuagguaaggaguuuagucgaucuuacagacuacgguacagcagggacggucggcgauggaugggauggaaggacaggugggggcaagaaguaaucucagggaaugaagauccugaaggggugguuuugaaauag

SEQ ID NO: 14614 - RNA, 345 nt, Artificial Sequence
  Description of Artificial Sequence: Synthetic coding sequence
auggacaagucacuacugcuggaacucccuaucuuacucugcugcuuuagagcccugagcggcuccuugucaaugagaaacgacgcugugauugaaauaguacaauguagaaugugccaccugcaguuuccuggagagaaguguucccggggcagaggaauuugcacugccacaaccgaggaggccugcaugguugggagaauguucaagagagacgguaacccauggcuaacauucaugggauguuuaaagaacugcgccgaugugaaagggauacgauggucaguuuaucuggugaacuucagaugcugccgaagccaugauuuauguaaugaagauuuguag

SEQ ID NO: 14615 - RNA, 630 nt, Artificial Sequence
  Description of Artificial Sequence: Synthetic coding sequence
augggacccgaagccuugagcucucugcuacuguugcuccuagucgcgucuggagacgcagacaugaagggccauuuugaccccgccaagugucgauaugcccuuggaaugcaagauaggacaauuccagauuccgacauuucagcgucuagcucuuggucugacucgacugccgcacggcacagccggcuugaaaguagcgacggggacggugccugguguccggcaggaucuguguuucccaaagaagaagaauaucugcaggucgaccuucagcgccugcaucugguggcccuaguggggacgcaaggccgacacgccggaggacucggaaaagaauucucucgaucuuauaggcuucgauauucacgggauggcagaagauggaugggauggaaagauaggugggggcaggaaguaaucucugguaaugaggacccagaggguguuguccugaaagaucuugggccucccaugguugcacggcuggugcgcuucuauccucgcgccgauagaguuaugagcgugugucugagaguggaauuguacggcugccuuuggcgcgacggucuguugaguuacacagcuccugucggacagacaauguaccuauccgaagcugucuauuag

SEQ ID NO: 14616 - RNA, 639 nt, Artificial Sequence
  Description of Artificial Sequence: Synthetic coding sequence
gauuuuggauacugcccgcgaguuuauugugaaaaccaacccaugcuuccuaucggugugcuugugauggucggcuuuacgguaggaaagguuccuguaccggauauucgcaccugccauuuuugucugguggaagaucccucugugggcugcaucucuggcagugagaaaugcacaauuuccuccaguagucuguguaugguuauuacuauuuauuacgacgugaagguucgcuuuauugucaggggcugcggucaauacauaaguuaucguugucaagagaaaagaaauacuuauuuugcagaguauugguaucaggcccagugcugucaauacgauuacugcaauucaugguccuccccucaguuacagucuucccugccugagccccacgaucgaccccuggcgcucccccuuucagauucucaaauccaaugguucuaucaagcccucaaucucucccugccccucccuaauuuccaugccggcaccgaaccagacggccuggaucccauggucacucucucccugaaucuggggcugucauuugccgaacuuaggcgaauguaucuguuccugaacagcucuggacuccugguccugccacaagccggauugcugaccccccacccgucauag

SEQ ID NO: 14617 - RNA, 240 nt, Artificial Sequence; identical to SEQ ID NO: 12978
  Description of Artificial Sequence: Synthetic coding sequence

SEQ ID NO: 14618 - RNA, 1620 nt, Artificial Sequence
  Description of Artificial Sequence: Synthetic coding sequence
augagcgagccacaggaaaagaaacuaagcgagaacacugacuuuuuagcucccggcgugaguagcuucacagacagcaaccaacaggaguccaucacaaaaagggaggaaaaucaggagcaacccaggaauuacagucaccaucagcuuaauaggucgagcaagcacucacaggggcugagggaucaaggcaaucaggagcaggacccaaauauuagcaauggcgaagaggaggaggaaaaagaacccggugaaguaggcacacacaacgauaaucaggagcggaaaacugaguugccucgagaacaugcaaacagcaaacaagaagaggacaacacucagucugacgacauccuggaggaguccgaucagccaacacaagugucgaagaugcaagaagacgaguuugaucaggguaaucaggagcaagaggacaauucaaaugcggaaauggaggaggaaaacgccaguaacguuaauaaacacauucaggaaacagaguggcaaucacaggaggggaaaaccggacuagaggccauuagcaaccacaaggaaaccgaagaaaagaccguaagcgaggcuuuacucauggaaccaacugacgacggcaauaccacaccuagaaaucacggcguagacgaugacggggaugaugauggagaugacggaggcacagacggcccaagacacucugcgucugaugauuauuuuaucccuagucaggcguuucuugaagccgaaagagcccaguccaucgcguaucaucugaaaauugaggaacaacgggagaaagugcaugaaaaugagaauauaggaaccacagagccuggagaacaucaggaagccaaaaaggcugagaacagcagcaacgaagaagagacgagcucugaaggcaacaugcgcguccacgcaguugauuccugcaugagcuuccaguguaagcguggucacaucugcaaagcggaucaacaagggaagccccacugcguaugccaggacccaguuaccugcccuccaaccaaaccgcucgaccagguuugcggaaccgacaaccaaaccuacgccucaucaugccaucuauuugccacaaagugcaggcuggaaggaacaaagaaaggccaucagcugcaauuggacuauuucggcgcaugcaaaucuauaccuacuugcacggacuuugaggugauacaguuuccauugcgcaugagagacugguugaagaacauacuuaugcaguuauacgaggcgaauucugaacaugcuggguaccuaaaugaaaagcaacgcaacaaggugaagaagaucuaucuggacgaaaaacgguuacuggcaggggaccauccaaucgaccuucugcugcgagauuucaagaaaaacuaucacauguacguguaccccguccauuggcaguucuccgagcuugaccaacaucccauggaucgaguacugacccacuccgaacucgccccacugagagcaagucuaguuccaauggagcacuguaucacuagauucuuugaggaaugcgauccaaauaaagacaaacacaucacucugaaagaauggggacacuguuuugguauuaaggaggaggacauugaugagaaccugcuguuuuag

SEQ ID NO: 14619 - RNA, 2535 nt, Artificial Sequence
  Description of Artificial Sequence: Synthetic coding sequence
augggacccggugcccccuucgcccgcguuggguggccccugccucugcuggucgugauggcugcaggagucgcucccgugugggccucccauucuccucaucugccccgcccucacagccgagucccaccucauccgucaagcgagagacgggcgguuuauauuggugcccuguuccccaugucgggcggauggcccgguggucaggcuugucaacccgcagucgagauggcccuagaagacguuaacuccaggcgcgauauccuucccgauuacgaacugaagcugauacaccaugacagcaaaugcgacccuggucaagcaacaaaauaucuuuacgagcuacuguacaacgauccuaucaaaauuauccugaugccgggcugcagcuccgugaguacucuagucgccgaagccgcaagaauguggaaucugaucguccuuaguuauggcagcaguucucccgcuuuaucuaauagacagcguuuccccaccuuuuuccggacacacccaucugcaacuuugcauaaucccacacgcgugaagcucuucgagaaguggggcuggaaaaaaaucgcaaccauucaacagacuacggagguauucacuucaacacucgacgaccucgaggaacgagucaaggaggcugggaucgaaaucaccuuuaggcaaucauucuucagugacccagcaguuccuguaaaaaaccugaagagacaagacgcgcggauuauuguaggccuguuuuaugagaccgaggccagaaagguauucugugaaguguacaaagagagacuguucggaaaaaaguacgugugguuccugaucggaugguaugcagacaacugguuuaagaucuaugaucccucaaucaauuguacaguagaugaaaugaccgaagccgucgagggccauauaacgaccgaaauagucaugcuaaacccugcaaauaccagaagcauuucaaauaugacgagucaagaauuugucgagaaguuaacaaagcgacugaagagacaucccgaggagacugguggcuuccaagaagcgcccuuagccuaugacgcaaucugggcacuugcccuagccuugaauaagacuucuggugggggagguagaagcggggugcgccuggaagauuucaacuauaauaaccagacaaucacagaccagauauacagagcaaugaacucuagcuccuuugagggugucaguggucaugugguguucgacgcuucgggaucuaggauggccuggacucuaauagaacaacugcagggggguucuuauaagaagauugguuacuaugauucaacuaaggacgaucucucuuggucgaagacagauaaauggaucggaggcucaccacccgcugaccagacucuugugauuaagaccuuuagauucuugucgcaaaaacuguucaucucagucagcguguugucuuccuugggcaucgugcucgccgucgugugcuuaagcuuuaauauuuauaacucccacgugagguauauccaaaauagucaaccaaaucucaauaaucucacagcaguugguuguuccuuagcguuggcugcuguguucccccuaggauuagacggguaccauaucggaaggaaucaguucccauuuguuugccaggcucgguuauggcugcucggacuuggcuuuucacucggcuacggcucuauguucaccaagaucugguggguucacacaguguuuaccaagaaagaggaaaagaaagaguggagaaaaacucucgaaccauggaaauuguaugccacggugggccugcuggugggaauggauguccugacacuggcuauuuggcagauuguggacccccugcacagaacaaucgagacauuugcaaaggaggaaccuaaagaggauaucgacgucagcauucugccucagcuugaacacugcuccucacguaagaugaauaccuggcugggaaucuucuacgguuacaaaggacuacugcuccuucugggaaucuuucuagcuuacgaaaccaagagugugaguacugagaaaauuaacgaccauagggcuguuggcauggcaaucuacaauguggcggugcuuuguuugauuacggcuccuguuaccaugauccucuccagccagcaggacgcagccuuugccuuugccucccucgccauuguuuuuucuuccuacaucacuuuaguugugcuguucguacccaagaugcgccgacuuaucacaaggggagaauggcaaagcgaagcccaggacacaaugaagacuggcucauccaccaauaauaacgaagaagaaaagaguagacuguuagagaaggaaaauagagaguuagagaagauuauagcagaaaaagaagagcgcguuuccgaauugcgacaccagcuucagucgcgccaacaacuaagaucaaggagacacccaccaaccccgccagagcccucagguggacuccccaggggcccucccgaaccccccgacagacuuuccugcgaugguagccgagugcauuugcuauauaaauag

SEQ ID NO: 14620 - RNA, 993 nt, Artificial Sequence
  Description of Artificial Sequence: Synthetic coding sequence
augcagcuguuccuguugcugugucuuguauuacugucuccucaaggggcaagccuccauagacaccauccuagagagaugaaaaagagagucgaggaucuucauguuggggcuacagucgccccuucuagccgccgcgauuucacguucgaccugcucggcaaugcccuguuuacugaucucgucguugacuugcaagacacuuucguuucugccaugaagacccuuuaccuagccgacacuuuccccaccaacuuucgcgauucugcaggagcuaugaagcagauaaaugauuacguugcuaagcaaacaaagggaaagaucguagaucuguuaaagaaccuggacuccaaugcgguaguuaucauggucaauuauaucuuuuuuaaggcuaagugggagacgucauucaaccacaaagguacccaagagcaggauuucuaugucacuucagagacaguggugcgagucccaaugaugagccgcgaagaccaauaucacuaccuauuagaucgcaaucuaucguguagaguuguagggguuccauaucaagggaacgcuaccgcacuauuuauacugccgagcgaaggaaagaugcagcaaguggagaacggucuguccgagaaaacccuccgcaaauggcucaaaauguuuaagaagcgccaacuagaguuauaccugccaaaauuuucuaucgaaggcuccuaccagcuagagaagguucugccuagccuggggauuaguaauguguucacaucacacgccgaccuuagcggcaucuccaaucacagcaacauucaggucagcgaaaugguccauaaagcuguaguugagguugacgagagcgggacaagggccgcggccgcaacaggcaccauauuuacauucagaucggcaaggcuuaacagccaacgacucguguucaauaggccauuucugauguuuauuguggauaauaauaucuuauuucugggaaaagucaaccgaccauag

SEQ ID NO: 14621 - RNA, 2676 nt, Artificial Sequence
  Description of Artificial Sequence: Synthetic coding sequence
augcugccaaccgagguuccacagagccaucccggcccuucugcgcugcuccuuuugcaauugcugcugccucccacauccgcauuuuucccuaacaucuggucccugcuagcagcacccggcuccauuacacaccaggauuugacugaggaggcugcccugaacgugacucuacagcuguuccucgaacagcccccaccuggacgccccccacuacgacuagaagauuuccugggacgcacccuguuggccgacgauuuguuugcugcguauuuuggcccuggcucaucucgcagauuucgcgcagcguuaggagaggugucucgggcuaacgcugcacaagauuuuuugccaacuucuaggaacgacccagauuuacacuucgacgcagaaagguuagggcaaggaagagcuagacuugugggagcuuugcgugaaaccguggucgccgcccgggcacuggaucauaccuuagcccgacagagauugggcgcugccuugcacgcacugcaggacuucuacucacacaguaauuggguggagcuuggggaacagcaaccucauccacaccuacuauggccacggcaggagcuucaaaaucuggcucagguggccgaccccaccugcuccgauugugaagaacugucuugcccuaggaacuggcucggcuucacacuucugaccucaggcuauuuugguacacauccuccuaagccuccaggaaagugcucucacggcgggcacuuugaccgaucaagcucucagccuccuagaggagggauuaacaaggacucgaccucgcccgguuuuuccccacaccauaugcuucaccugcaggccgcuaaauuagcauuacucgcguccauccaggcuuucuccuuguugcguagcagacucggcgauagagauuuuagucgccuacuugacaucacucccgcuagcagccugagcuuugugcuggauacaacaggaaguaugggugaagagauuaacgccgccaaaauucaggcccgucaucuagucgagcagaggcgcggcagucccauggaaccaguucacuacguacuuguuccguuccacgauccuggauucggacccgucuucacuacauccgaccccgacucauuuuggcagcaguuaaaugaaauucaugcucucggcggaggcgacgagccugagaugugcuugagcgcuuuacagcuggcccuacuucacacaccuccacugucggacaucuuuguguuuacugacgcuagccccaaggacgcuuuucuuacuaaucaaguggaaucuuuaacccaggaacgucgguguagagugacauuucucgugaccgaggauaccagucgcgugcaaggccgggcaaggcgagaaauccuauccccccugcgcuucgagccauacaaagcggucgcccuagccuccggcggugaggucaucuuuacaaaagaccaacacaucagagauguggccgcaauugucggugaguccauggcagcucugguuacccugccccucgacccgcccguggucguuccuggccagccucucguguucucaguggauggacugcuucagaagauuaccgugaggauucacggagauauauccucuuucuggauuaaaaacccugcaggcgugucucagggacaggaagaaggagguggcccacucggccauacucggcgauuuggacaauuuuggauggucacgauggacgaccccccucaaacaggcacuugggaaauacaagucaccgccgaagacacuccugguguacgaguucaggcccaaacuucccucgauuuccuuuuccacuuugguauucccauggaagacggcccacacccaggacuuuaucccuuaacucaaccuguugcuggccugcagacccaguuguugguggaaguaacuggccuuggcucuagggccaauccaggagauccacagccacacuuuucacaugugauucuuagaggugucccugaaggcgcagaacucggccagguaccucuggagccaguugggccgccagagaggggccugcucgcggcaucacugaguccuacucuucuuucuaccccccgaccauucagucucgaacugaucggccaggacgccgcuggacgccgccugcauagagccgcaccucagccuagcacugugguucccguguuauuggaacugucugggccuucaggguuuuuggcccccggauccaaagucccgcucucauuaaggaucgccucuuucucuggaccccaggacuuagaccucagaacguucgugaauccaagcuucaguuuaacaaguaaucucucccgugcgcacuuggaauugaaugagucugcauggggccggcuguggcuugaaguaccugauucagcugcccccgacagcgucgucauggugacaguuacugccggcggucgcgaagcuaauccggugccgccaacucaugcuuuuuugaggcugcuugucuccgcuccagcuccccaggauagacauaccacaccaaccggcuccucugauccuauuuugaccacagcuacuccagcuuucucaccuuuuacccuggugacucagggcagggcaggcgcaggccucgcugcuggaagucccugguggggaaccgucggcggaguguuacuccuccucggccuugcuuccugguag

SEQ ID NO: 14622 - RNA, 708 nt, Artificial Sequence
  Description of Artificial Sequence: Synthetic coding sequence
augaaguacguauuuuaccugggggugcucgcuggcacuuucuucuuugccgacucaaguguacagaaagaagaucccgcgccauaccugguuuaccugaagagucauuucaaccccugcgucggugugcucauuaagccuagcuggguccucgcucccgcccauuguuaccuuccaaaccuuaaagugauguuaggaaauuucaagaguagaguacgagacgggacagaacagacaauuaaccccauucaaauuguuagauacuggaauuacagccacucugcgccacaagacgacuuaaugcucaucaagcuggccaaacccgcaaugcucaauccaaaaguccaaccccuuacccuggcuacgacuaauguucguccggguacggucugcuugcugucaggacuggacuggucucaggaaaauucaggacgacauccagauuugcgccagaaucucgaagcaccggucaugagcgaucgcgaaugucaaaagacagaacaaggaaagagucacagaaauucucuuuguguuaaguuugucaaggucuucucucggaucuuuggugagguggcuguggcaaccgucauuugcaaggauaaacugcagggcauugaaguuggacacuuuaugggaggugauguuggaauuuacacuaauguuuauaaguacgugucauggauagaaaacacggccaaggauaaauag

SEQ ID NO: 14623 - RNA, 1386 nt, Artificial Sequence
  Description of Artificial Sequence: Synthetic coding sequence
augucacuggacauucaaucauuagauauacaaugcgaagagcuuucugacgcuagaugggcugaacugcucccauuauugcagcaaugccagguggugaggcucgacgacuguggcuuaacggaggcucguuguaaggacaucucauccgcuuugagagugaauccugcgcuggcagagcugaaccugcgaucuaaugaacucggggaugucgguguacauuguguguuacaagggcuucagaccccauccugcaaaauucaaaagcugucucugcaaaacuguugcuugacuggugccggaugcggcguccugucaagcacccuccgcacgcugccuacucugcaggaauugcacuuaucugacaaucugcugggugaugccgggcugcaacugcuaugugaaggacugcuagauccacaaugcaggcucgagaagcuccaguuagaguacuguucccucucagccgcuucuugugagccgcucgccagcguccuccgcgcaaaacccgauuucaaagagcugaccguuuccaauaaugacauuaacgaggccgggguaagaguccucugucagggccugaaagacucucccugucagcuggaggcccucaagcuggaaucuuguggggugacaucagacaauuguagggauuugugcggaaucguggccagcaaggcaagccuccgagaacuggcccugggauccaauaagcugggagacguagguauggccgaguuaugcccuggacuguugcacccaagcucuagauugagaaccuuguggauaugggaauguggaauuacagcuaaagguuguggagaucugugcagaguacuucgcgcuaaggagucucucaaagagcugucacuggccgguaacgaguugggggacgaaggggcccgguuacucugugaaacacuccucgaaccaggaugucaauuagagaguuugugggugaaguccugcuccuuuaccgcagcuuguuguucucacuuuucuagugugcuugcgcaaaaccguuuccuauuagagcuccagaucucaaacaacagguuagaagacgccgggguccgggagcugugucaagguuuggggcagcccgggaguguacugcgagugcucuggcuugccgacugugacgugucugacucuagcuguucuucccuagcugcaacucugcuugcaaaccauucccuuagagaauuggaucugaguaauaauugucuaggagaugcggggauucugcaacugguggagucaguacgucagccugggugcuuauuggaacagcucgugcucuaugauauauacuggagcgaagaaauggaagaucgucuacaagcacuggagaaggauaagcccagccugcguguaauuucauag

SEQ ID NO: 14624 - RNA, 2676 nt, Artificial Sequence
  Description of Artificial Sequence: Synthetic coding sequence
augcuacccaccgaggucccacagagucauccugggccgucugcgcugcuacugcugcaacuccugcuaccccccaccagugccuucuucccuaacauauggucauuacuggcugcaccgggauccauaacacaccaggaccucacagaggaagccgcauugaacguuacauuacaacuauuccucgaacaaccccccccagggcgcccuccucuccgacuugaagacuuucugggcaggacucuucuggccgacgaucucuuugccgcuuacuuuggccccggaaguucccgcagguuccgggcagcucucggggaaguaucaagagcgaacgccgcccaggauuuccuccccacaucccgaaacgacccggaccugcacuuugacgcugagcgacugggacagggccgugcccgacuggucggcgcuuugagggagaccguuguagccgcacgggcccucgaucacacacuggcacggcagagguuaggugccgccuugcacgcccuccaggauuuuuauucucauuccaacuggguggaacucggugaacaacagccucacccacaccugcuuuggccccggcaagaacuccaaaaucuggcccaggucgccgaucccacuuguucugacugugaagaauuaagcuguccucgcaauuggcucggcuuuacccuccugaccucuggcuacuuuggcacccaccccccaaaacccccaggcaaauguucacacggaggacacuuugaucgaucuucaucccagccgccacguggaggcauuaauaaagacuccacuucacccggcuucuccccucaccacaugcuacacuugcaagccgcuaaguuggcacuccucgcuuccauccaggcauucucccugcugcggucucguuuaggggauagagacuuuucucggcugcuagauauuacaccugcauccagcuuguccuucguccucgauaccacaggcucaaugggggaggaaaucaaugccgcuaaaauacaagcccgccaccuugucgagcaacgccgcgguagcccaauggaacccguccauuacguucucguucccuuucaugaccccgguuuuggacccguuuucaccaccucagacccagauaguuucuggcagcaauuaaacgaaauccacgcacugggugggggagaugaaccugagaugugccugucagcucuacagcuggcccuccuccacacaccuccacuauccgauauuuuugucuucacagacgccucacccaaagaugccuuucugacaaaccaggucgagagcuuaacccaggagagaaggugucgcgucacauuccugguuaccgaggacaccuccagagugcagggccgugcccgccgggagauccucucaccacugcgauuugaacccuacaaagccguggcacuggcaucaggcggagaaguaauuuuuacuaaagaucaacacauccgggaugucgcagcaauugugggugaaagcauggcagcacuggucacuuuaccucucgauccucccguugucgugcccggccagccucuaguuuucaguguugacgggcuccugcagaagauuacugugagaauccauggggacaucaguucuuucuggauaaaaaacccagcuggaguuagccagggccaggaagaaggaggaggcccacuuggacacacacggagauuugggcaauucuggauggugaccauggacgacccuccgcaaaccggcacuugggagauucaaguuacugcagaggauacaccaggcguacgcguccaagcccagacuucccucgacuuccuguuucauuuuggaauuccaauggaagacggcccucauccaggacucuaucccuugacacaacccguggccggauuacagacacaacuucugguugaggugacaggcuugggcagcagagcgaaccccggagacccacaaccccauuuuucucaugucauccuuaggggaguucccgaaggggcggagcugggacaggugccgcuggaaccggugggcccuccugaaaggggacuguuggcagcaucccugagucccacacuucuaagcacuccaagaccauucucacuggagcuaauagggcaagacgcagcaggacgacgauugcauagagcugcgccucaaccaucuacaguuguucccgugcuucucgaacugagugggccuucuggauuccucgcccccgguucaaaagugccucugagccugcguauagcuucauucuccgggccucaagaccuugaccucaggacauucgucaaucccagcuuuagcuuaacuuccaaccucucucgcgcccaccuggaguuaaacgagagcgccuggggcagacuguggcuggaaguuccggacagcgcugcuccggacucuguggucauggucaccgucacugcugggggacgagaagccaauccagugccccccacucaugccuuucugcgguuacugguuucggccccugcaccucaggaccgccacacaacaccuaccggcagcuccgaccccauccucacuaccgcuacccccgcuuucaguccauuuacucucguaacccagggccgagcaggugccggucuagcggcaggaucuccuugguggggcaccguagggggcguucuauuacugcugggcuuagcuagcugguag

SEQ ID NO: 14625 - RNA, 501 nt, Artificial Sequence
  Description of Artificial Sequence: Synthetic coding sequence
augggcccagaagcacucucaucccugcugcuguuauuauuggucgcaagcggcgacgccgauaugaagggacacuuugacccugccaaauguagguacgcuuuagggaugcaagaccguacgauuccagacucagacauuagugccucuaguucuuggagugauaguacagcggcucgccacucacggcuggagucauccgacggagauggugcauggugucccgccggcagcguguuuccuaaagaggaagaauaccuucaggucgauuugcagagacuccauuuaguggcucuggucggcacacaaggcagacacgccggagguuuaggaaaagaauuuucucgcagcuaccgacugcguuauagucgugacggacggcgauggaugggauggaaggaucguuggggccaggaagucauuucagggaacgaagacccagaaggaguuguguugaaggaucuagggccucccaugguggcuagauugguacgcuucuag

SEQ ID NO: 14626 - RNA, 420 nt, Artificial Sequence
  Description of Artificial Sequence: Synthetic coding sequence
augcaggccgcuugcugguacguguuguuccuucuucaaccaacaguguaucuagugacaugugcaaaccuuacuaacggcggaaagucagagcuucucaagucaggaagcuccaagagcacauugaagcauauuuggaccgaaucauccaaggaccuuucuauuucaagacuacucucgcaaaccuuccgcggcaaagaaaaugacacggaccucgaccuuagauacgauacccccgaaccguacuccgaacaggauuugugggauuggcuucgcaauagcaccgacuugcaggagcccagaccuagagccaaaaggaggccuauaguaaagacugguaaauuuaagaaaauguuugguuggggagacuuccacucuaauauaaagaccgugaagcugaaccuauugaucacaggcuag

SEQ ID NO: 14627 - RNA, 2412 nt, Artificial Sequence
  Description of Artificial Sequence: Synthetic coding sequence
auggcggcugcaggccuuguggccguugcagcagcugcugaauacucaggaacugucgcaucuggaggcaaccucccaggagugcacugcggaccaagcucaggagcagguccaggcuucggcccggguucauggucuagaucccucgacagagcgcuugaggaagcugcuguuacaggcguccuuucccugucuggccggaaacugcgggaguuuccgcgcggugccgcaaaccacgaccugaccgacacaaccagagcugaucugagcagaaacaggcuuagcgagauccccauugaggcgugccacuucgucucauuagaaaaucuuaaccuuuaucaaaacugcauccgguacauuccugaagccauucucaaccugcaggcucuaaccuuucuaaauauaucaaggaaccagcuuagcacccucccuguucacuuauguaaccucccgcucaaaguccugauugcuucaaacaauaaacugguaagucuucccgaggaaauuggacauuugcgccaccugauggaauuggacguuucguguaacgaaauccagacuauucccagccagauugguaacuuagaggcucuccgcgaucucaacguucgaagaaaccaccuggugcauuugcccgaggaauuggccgagcugccccuuauaaggcuggauuucaguugcaacaaaaucaccaccauccccgucugcuaccggaacuugcgccacuuacagaccaucacacucgacaauaauccucuacaauccccucccgcucagaucuguauuaagggaaaggugcauauuuuuaaauaccucaauauacaggcuuguaaaaucgcucccgaccuaccugacuacgaucgccgcccacucggauuuggcucgugucaugaggaacuguauaguaguagaccguacggcgcucuggacaguggcuucaacucugucgacuccggugacaagagguggagcggcaacgaaccgacagaugaguucuccgauuugccccuucgaguagccgagauaaccaaggaacagcgauugaggcgugagagccaguaucaggaaaauaggggaucucuagugguuaccaauggcggaguagagcacgaccuugaccaaauugacuacaucgauuccugcacggccgaagaagaagaggccgaggugcgacagccuaagggcccugacccugauucuuuaagcucacaguucauggccuauauugagcaacgcagaauaagucaugaagguucgcccgugaaaccaguagcuauuagagaauuccagaaaacugaggacaugagaagauaccuucaccagaauagaguacccgcagaaccaaguucccugcugucuuugucugccagccacaaucaacucagccacacagaccuugaauugcaccagagaagagagcagcugguugaacguacucgacgggaggcccagcucgcugcucuacaguacgaggaagaaaaaauuaggacuaaacaaauacagcgcgacgccgucuuggauuucgugaagcagaaggcuagucagucaccccaaaagcaacauccacuguuagauggcguggauggugaaugcccauucccaagcaggagaucccagcauaccgaugauucugccuugugcaugucauuauccggccuuaaucaagugggaugcgcugccaccuuaccucacucuucagccuucacaccacuaaaaagcgacgaucggccaaacgcccuucugaguuccccagccacugaaacaguacaccacucaccugcuuauaguuuuccagcagcuauccagcgaaaccagccucagagaccagaaaguuuucuguuccgagcgggagugcgugcagaaaccaauaaaggacacgcuuccccucugccuccuucagccgcgccgacaacggacucaacugauucuauuaccgggcaaaacuccaggcagcgcgaagaggaacucgaauuaauagaucaacugcgaaaacauauagaguaccgacugaaagugucacugccaugcgaccuuggggccgcccugacugacggagugguccugugccacuuagcuaaccacguacggccaaggucagugccgucuauccacgugcccuccccugcuguacccaaacugaccauggcuaaauguagaagaaaugucgaaaauuuuuuggaagcuugccggaagauuggcguuccacaggauaaccuuuguucccccucggauaucuugcaacucaaccugucugucaagaggacgguugaaacacuguugucgcuuggagcucacucugaagaaucuaguuucguaugccugaguuugcagcugcuaggauuugucgccuucuauugcaccgugauguugaccuuguguguucuguacuacuggcuuuuuccugcaagauag

SEQ ID NO: 14628 - RNA, 633 nt, Artificial Sequence
  Description of Artificial Sequence: Synthetic coding sequence
auguacaaagcuagaccuccagccggcagcgggggacccggggccgaacccccagcuauggcagccccccggggacgcgccgccccauggaccaccgcccuacuucugcugcucgcuucucagguguugagcccuggcaguugcgccgacgaagaagaagugccagaggaaugggugcugcugcacgucguccaaggccaaauuggggccgggaacuauucguauuugcgccugaaucaugaaggaaaaauugugcugaggaugaggagccuuaagggagacgcggaucuauaugucagugcaaguucuuuacaucccaguuuugacgauuacgagcuucagagugccacgugcggaccagaugcuguuucuauccccgcacacuuuaggaggccaguuggcauuggcguguacggacauccaucacaccuagagucagaguuugaaaugaagguauacuaugacggaacgguagagcagcaccccuucggugaagccgcauacccagccgacggagccgacgccggccagaagcacgccggagcccccgaggacgcaagccaggaagaggaaucugugcuuuggacgauucucauuagcauccuuaaauugguacuugaaauucucuuuuag

SEQ ID NO: 14629 - RNA, 486 nt, Artificial Sequence
  Description of Artificial Sequence: Synthetic coding sequence
uaauguccgaccgaaaucaucgccuucggagacagauuagaagaguuuagaagcaucaacacagaagucguugcguguuccguggauucucaguuuacucaccuagcuuggaucaacacaccaagacgccagggaggcuuaggcccuauucgcauuccccugcugucugaccugacacaucaaaucucuaaggacuacgguguauaccucgaggacagugggcauacccugcgaggacuauucauuaucgacgauaaaggaauacuuagacagauuacgcugaaugaccugcccgucggcagauccgucgacgagacucuucgacugguacaagccuuccaguauaccgauaagcacggagaaguuugucccgcaggguggaagccagguuccgaaacuauuaagccugaggacacuaugaaagcuugguggccaagggaauccuacaacccaagauccuccuggaaagcagaaguuuuuagguag

SEQ ID NO: 14630 - RNA, 2886 nt, Artificial Sequence
  Description of Artificial Sequence: Synthetic coding sequence
augcugcugcuacugcuccuggcuccacuauucuuacgcccaccuggggcaggaggcgcccaaacuccaaaugcuacaagcgaaggcugucagauuauccaccccccuugggagggcgguaucagauaucggggguugaccagagaucaggugaaagcaauuaauuuccuacccguggacuaugagauugaguacgucuguaggggagagagggaagucgucggcccuaaagugaggaaaugcuuagcaaaugggucauggacugacauggauaccccaaguagauguguucgaaucugcucgaagaguuaccuuaccuuagaaaacgggaaaguuuuucugacagguggcgaucuccccgccuuagauggagcucggguggauuucaggugcgaccccgacuuucaucugguugggucuucuagaagcaucuguucacagggacaauggucaacuccuaagccacauugucaggucaaccgaaccccacauagcgagagaagggccgucuauaucggagcucucuucccaaugagcgggggcuggcccgggggucaggccugccagccggcugucgaaauggccuuagaagacguuaauucacgacgagauauucugcccgacuacgaacugaagcugauccaucacgauaguaaaugcgaccccgggcaggcuacuaaauaccuguacgaauugcucuacaacgauccaauuaaaauuauucucaugccuggaugcagcagcgucagcacccuugucgcggaagcugcacgcauguggaaccuaauaguccucucauacggcagcuccucuccugcacuuucuaauagacagcgguuuccaacguuuuuccggacccaucccuccgcuacuuuacauaaucccacccggguaaaguuauuugagaaauggggauggaaaaagaucgcaaccauucaacagaccacagaagucuucacaucuacccuugacgauuuagaggaaagagugaaggaagcaggaauagaaauaacauuuagacaguccuuuuucagugaucccgccguuccaguaaagaauuuaaaaaggcaagaugcccggauaauagugggauuguucuacgagaccgaggcacgaaaaguuuucugugagguguauaaggagcgacucuucggcaaaaaguacgugugguuccugauugggugguaugcggacaacugguucaaaaucuaugacccuucaauaaacugcacaguggaugaaaugacugaggcuguagaaggucauauuacgacugagauuguaauguuaaauccugccaacacacgaaguaucagcaacaugacgucacaggaauuuguggaaaagcugacuaagcggcugaaaagacauccggaggaaacaggcggcuuccaagaggcuccgcucgcauacgaugccauuugggcacuggcacuugccuuaaauaagaccucaggcggaggaggcagauccggggugagacuggaagauuucaacuacaacaaucaaacaaucacagaccagaucuauagagcuaugaacaguagcagcuuugaaggggugucuggccacgucguguuugacgcgucgggcaguagaauggccuggaccuuaauagaacagcugcaaggugguucuuacaaaaaaauuggguauuaugacucuaccaaggacgaucucuccuggagcaagacugacaaauggauuggcggaagcccccccgcagaccaaaccuuaguuauuaagacauuccgcuucuuaucucagaaacuguuuauaucagucagcguccuuuccucacucgggauugucuuagccgucguguguuuaaguuuuaacauuuacaacucacaugugagguauauacagaacucacagccaaaucugaauaaccugacagccguggggugcucuuuagcucuggcagcaguguucccucuggggcuugacggauaucauauugggagaaaucaguuuccguuuguaugucaggcgcgacuguggcuacuggggcugggguuuucauuagguuacggcagcauguuuacgaaaaucuggugggugcauacugucuucacgaagaaagaggaaaagaaggaauggagaaaaacgcuggagccuuggaagcuguacgccacaguaggguugcucgucggaauggauguccugaccuuggccauuuggcagaucguagauccccuucaccguacuaucgagaccuucgccaaagaagagccuaaagaagauauugaugugaguauacugccacagcuugagcauugcuccucucggaaaaugaacaccuggcuugggauuuucuacggauauaagggccugcuucugcugcuuggaaucuuucuggcauacgaaacaaaauccgugaguacggaaaagaucaacgaucaccgcgcaguggguauggcuauuuacaacgucgccguccucugccugauaacagcacccgugacuaugauucugucuagccagcaggacgcagccuuugccuuugccucacuagccaucguguucaguuccuacaucacacuugucgugcuguucgugcccaagaugcgccgacucauuacucgcggagaauggcaaagcgaggcgcaggacacaaugaaaaccgguucaucaaccaauaauaaugaggaggagaaaucaagacugcucgagaaagaaaaccgcgaacuugagaaaaucauagcagaaaaagaggaacgcgugucugaguuacgucaccagcuccagucccggcaacaacuaagaucucgacgacacccuccuacaccacccgagccuucaggcggauuaccucgcggaccuccggagccccccgaccggcugaguugcgaugggaguaggguacacuuacuguacaaguag

SEQ ID NO: 14631 - RNA, 2853 nt, Artificial Sequence
  Description of Artificial Sequence: Synthetic coding sequence
augacguggcggaugggaccacguuuuacuauguuacuggccaugugguugguaugcggcuccgaaccccacccucaugccaccauacgcggcucccaugguggcagaaaagucccccucguaucaccugauuccucaaggccggcgcgcuuuuugcgccacacaggcaggucccgcggcauugaacgguccacucuggaagaaccuaauuuacagccgcugcagcgucgacgaucaguaccagugcuuagauuagcgagaccaaccgaacccccugccagaucagacaucaauggagcagccguaaggcccgaacagaggccagcugcccgcggaucccccagagaaaugauuagagacgagggaucauccgcgcggucuagaaugcugcgguucccuucagggaguucaucgccuaacauucucgcaucauucgcugguaagaaucgcgucuggguuaucagcgccccacacgcuucggaggguuauuacagguugaugaugucucugcuaaaagacgacguguacugcgagcuggcugaacgucauauucaacagauuguucuauuucaccaggcaggagaagagggagguaaggugcgccgaaucacaagcgagggccagauacuugagcagccauuggauccgucccuaauucccaagcucaugucauuucugaaacuggagaaaggaaaauucggcaugguguugcuaaagaaaacuuugcagguggaggaaagauauccauaucccgugagacuggaagccauguaugaggucauagaccagggcccuauaagaaggauagaaaaaauacgccagaaggguuuugugcagaaguguaaggcgucaggaguugaaggucagguagucgccgaagguaaugacggcgggggaggugcagggcgccccucacuugggagcgagaagaagaaagaagacccccggagagcacagguccccccuacucgcgagagucgcgucaaaguccugcggaaauuggccgccacugcucccgcacucccucagccaccuucuaccccccgcgccacuacacugcccccugccccugcuacuaccguuacacggagcacaagcagagcuguuacggucgccgcacgccccaugaccacuaccgcuuuccccacaacacagagaccauggacuccaucacccucccacaggccuccaacaaccaccgaagucaucacagcccgccgcccaucugugucugagaauuuauauccucccucacggaaggaucaacaccgggagcguccacaaaccacacgucgucccucaaaagcuaccagccucgagaguuucaccaacgcccccccuaccaccaucagcgagccguccacaagagccgccggcccgggcagguuucgcgacaauaggauggaccgccgugagcaugggcaccgagauccgaacguugucccaggucccccaaaaccagcuaaagagaaacccccaaaaaaaaaagcccaggauaagauccuguccaacgaauaugaagagaaauacgaccuaucacggcccaccgcuucccagcucgaagaugaacugcagguuggaaaugucccucugaaaaaggcuaaggaaucuaaaaagcacgagaagcuggaaaaaccugagaaagagaagaaaaaaaagaugaaaaaugagaacgcagauaaacuccucaagagugagaagcagaugaagaagagugaaaagaaaaguaagcaagagaaggagaagucaaagaagaagaaaggcggaaaaaccgagcaagaugguuaucaaaagccuaccaauaagcauuucacccagucccccaaaaaaagcguggcagaccuccugggcaguuuugaaggaaagcgucgccuccuccugaucaccgcaccuaaggcugaaaacaauauguaugugcaacagcgcgaugaguaucucgaaucguuuugcaagauggccaccagaaagauuagugucaucaccaucuuuggcccugugaauaacucuaccaugaagaucgaccauuuccaacuggauaaugaaaaaccaaugcgggucguggacgaugaggauuuggucgaccagcggcuaauuagcgaacugagaaaagaauauggcaugacauauaaugauuucuucaugguacugacagauguugaucugcgagucaaacaguacuacgaaguucccauuaccaugaagucuguauuugauuugauugauaccuuucagucucguauuaaagacauggaaaaacagaaaaaagaggguauuguuugcaaagaagacaagaaacaaucccuggagaauuuuuugucccgauuuagauggagaagaaggcuucuugugauuucagcuccuaaugacgaggauugggcuuauagccagcagcugucagcauugucaggacaagcuugcaacuucggcuugcgucacaucacgauacuaaagcugcuaggaguuggugaggaaguuggcggaguccuugagcuauuccccaucaaugguuccuccguagucgagcgcgaagauguuccagcacaccugguaaaagauaucagaaacuacuuccaggucagcccagaauacuuuuccaugcucuuggucgguaaggauggcaaugucaagagcugguacccgucaccaauguggagcauggugauuguguaugaccuuauugauagcaugcaguuacgccgccaggaaauggccauucaacaaucccuggguaugcgcugucccgaggaugaauacgccgguuacgguuaccauucuuaucaccagggguaucaggacggauaucaggaugauuacagacaccaugaaaguuaccaccacggguauccauacuag

SEQ ID NO: 14632 - RNA, 351 nt, Artificial Sequence
  Description of Artificial Sequence: Synthetic coding sequence
auggcagcuggcuccgcaccgaugcagcuacacuugcgggcuaccauucguaugaaggacggguugugcgugccgcggaaauggauauaucaccugacagagggcucaacagaucugaggacggaaggcagaccggauaugaagaccgagcucuuuuccagcagcugcccaggaggaauuaugcuaaacgagacaggccagggcuaccagagauuucuguuguacaauaggucaccccacccuccugaaaaauguguugaagaguuuaaaucgcugacauccugccuggauagcaaggcuuuccuguuaacgccuagaaaccaagaagccugugaguuauccaauaauuag

SEQ ID NO: 14633 - RNA, 1251 nt, Artificial Sequence
  Description of Artificial Sequence: Synthetic coding sequence
augaaguuucaggguccacuggccugccuguugcucgcauuaugccuggggagcggugaggcuggaccacuccaaagcggcgaggaaagcacaggaaccaacauuggcgaggcccugggacacggacugggggaugcauuaagugaaggggugggaaaggcaauuggcaaagaagcagggggugccgcagguuccaaggugucagaggcucugggacaaggaacccgcgaggcgguugggacuggaguucgucaggugccagguuuugguguagcugaugcgcugggaaaccggguuggugaggcagcccaugcgcuaggaaauacaggccacgaaaucggaaggcaggccgaggaugugauucggcacggagcugaugcagugagaggaaguuggcagggugugccuggacacaauggcgccugggagacaagcgggggucauggcauuuuugggagucagggugggcuuggaggccaggggcagggcaaccccggaggacuuggcacuccuugggugcacggcuacccuggaaauagugcugguaguuuuggaaugaauccgcagggugccccauggggucagggaggaaaugggggaccucccaacuuuggaacaaauacacagggcgcggucgcucagcccgguuaugguaguguccgcgccagcaaccaaaaugagggguguacaaacccgccuccuuccggaucuggaggaggcucuagcaacucaggaggcgguucagggucccaauccgguucuucaggcucaggcucuaauggcgacaacaauaacgguaguucuagcggcggcuccaguagcgguagcucuaguggcgggucaaguggcggaucuuccggcgggucuagcggaaacuccggcgguucacguggugauuccggaucugagucaaguuggggcagcagcacugguagcagcagcgggaaccacggggggaguggcggcgguaaugggcauaaaccagggugugagaaaccaggcaaugaagcacgugguucaggggaguccgguauucagggauuucgaggacagggugugagcagcaacaugcgugaaaucagcaaagaagggaaccggcugcugggcggaaguggugacaauuaucgcaauuccgaaaccuccccaggcauguuuaacuuugauaccuucuggaaaaauuuuaaaaguaaacugggauucauuaacugggacgcaaucaacaaggaucagagaucuagccgcauaccuuag

SEQ ID NO: 14634 - RNA, 150 nt, Artificial Sequence; identical to SEQ ID NO: 12995
  Description of Artificial Sequence: Synthetic coding sequence

SEQ ID NO: 14635 - RNA, 978 nt, Artificial Sequence
  Description of Artificial Sequence: Synthetic coding sequence
augcagggccggguugccggcagcugcgcuccauuaggacugcuucuggugugccuccacuuaccgggauuguucgcucguuccaucggcgucguagaagaaaaggucagccaaaaucucgggacuaaccugccccaacucggucagccgagcucgacugggcccuccaauuccgaacacccccaaccagcucuugauccccguaguaacgaucuggccagagucccuuugaaauuaagcguuccagccagcgauggguuuccuccugccggcgguucugccguccaaagguggccuccgagcugggguuugccggcuauggacucuuggccgccugaggaccccuggcaaaugauggcugccgcagcagaagaucggcuuggggaggcucucccugaagaacugucauaucugucaucagccgccgccuuggcaccuggcuccgguccauugccuggagaaucaucgccugaugcuacaggacuguccccaaaggccucacucuuacaccaggacagcgagucaaggaggcuaccgcgcuccaacucuuugggugcaggcggcaagauuuugagucaaaggccaccauggucacucauccauagaguccugccagaucauccauggggaaccuuaaacccuucugugucauggggaggugguggcccugguacgggauggggcacccgaccuaugccccauccagaaggcaucugggggaucaauaaccagccucccggcacuucauggggaaacauuaaucgcuaucccggcggcucaugggggaacaucaauagauauccaggugguuccuggggcaacauuaaccgguacccuggaggcucuuggggaaauauccaucuguacccuggcaucaacaaccccuuuccgcccggcguucugagaccuccuggcagcaguuggaacauuccugcaggcuuuccuaauccccccucaccccgacuucaguggggauag

SEQ ID NO: 14636 - RNA, 390 nt, Artificial Sequence
  Description of Artificial Sequence: Synthetic coding sequence
auggccgccggcuccgcaccuaugcaguugcaccugcgggccaccauucgcaugaaagacgggcucugcgugccccgaaaguggauuuaccacuugacagaagguuccacugaucuccggacugaggguagaccagauaugaaaacugaguuguucagcucuucuugccccgggggaaucaugcugaacgagaccggucaaggcuaucagagauuucugcuuuauaaucgcucgccccauccuccugaaaaaugcgucgaagaauuuaaaucacuuacaucuugccuagauucaaaagcuuuccuucuaaccccucgcaaucaagggaagggcuugaaaucucauaaaacaggacuaggccuuacaaaguccucuggcguuaccggcuag

SEQ ID NO: 14637 - RNA, 1056 nt, Artificial Sequence
  Description of Artificial Sequence: Synthetic coding sequence
auggcuggcauuccaggacuguuauuccucuuguuuuuccuucucugugccguuggacaggugaguccauauagcgccccauggaaacccaccuggcccgcauauaggcuucccguugugcuaccacagucaacuuugaauuuggccaagcaguaucugaguuaugaaacauuauacgcaaaugguucuagaaccgaaacccagguuggaauuuacauauuaagcucauccggggauggggcccaacauagggauucggggaguuccgggaaaagucggcgaaagagacagauauacggguacgauagccgcuucuccaucuuuggaaaagauuuccuccucaauuauccguucagcacaucaguaaaacugucgacaggcuguacaggcacacugguugccgagaaacacguacuuacugccgcacauuguauacacgaugguaagacuuacgucaaagggacacaaaaguuacgagugggcuuccuaaaacccaaguuuaaagauggcggacggggugcuaacgacagcaccuccgcuaugcccgagcagaugaaauuucaauggauccgcgugaaaagaacucauguuccaaaaggguggauuaaggggaacgcgaaugacaucggaauggauuaugacuacgccuuacuggagcucaagaagccacauaaacggaaauuuaugaagauuggcgucucaccuccugccaagcagcucccaggcggccggauacauuuuagcggguaugacaaugaccggccugguaaccuuguguauagauuuugcgaugugaaggaugaaacguacgaccucuuauaccagcagugugacgcacagccaggugcgagugguagcggcguguacgugcggauguggaagcggcagcaacagaaaugggagcgcaagauaaucggaauuuucucgggacaucaaugggucgacaugaacgggucaccacaagauuuuaauguggccgugagaauaacuccccugaaguaugcucaaauuuguuauuggauuaagggaaacuaccucgauugccgugaggguuag

SEQ ID NO: 14638 - RNA, 345 nt, Artificial Sequence
  Description of Artificial Sequence: Synthetic coding sequence
auggagcgcggcgcuggcgcaaagcuacugccccugcuccuccucuuaagagcgaccgguuucacuugcgcccagacagacgguagaaacgguuacaccgcagucauagaagugacgaguggcgguccuuggggugacugggccuggccagaaaugugccccgauggauucuuugcuucgggcuuuucccugaaagucgaaccaccacaaggaauaccuggcgaugacacagcauuaaauggcaucagacuacacugugcacgcggaaaugucuuaggcaauacgcacgugguggaaucacaaucagggagauggggugcaggcguggaagauccgcucgguuag

SEQ ID NO: 14639 - RNA, 825 nt, Artificial Sequence
  Description of Artificial Sequence: Synthetic coding sequence
auguggcguugcccgcucgguuugcuguuguugcugccccuggcaggucauuuagcucucggggcccagcaggggcgcggccgucgggaacuugcuccaggacuucaucugcgcggaaucagagacgcaggcggaagauauugccaggaacaggacuugugcugucgcggaagagcugaugacugcgcucuucccuaucugggagccauauguuacugcgaccuguuuugcaaucggacagugucagacugcugcccugacuuuugggacuuuugucugggcguuccccccccuuucccccccauucaaggcuguaugcauggcggccgcauuuaccccgugcuggggaccuauugggauaacuguaaucgauggccaccacucgaguguugggauuugcuuccaccugcccugcccggcccuguaugggcggcccucggagccaaggaagaaauggcugggaaggaccguaccguguauuguccacucuugaugaaggcguugggcgccagagucggugaaugucccgggugccaguccccucaaagaaugcucccagagucaucuagggugcugcugccaaggugcgcggaaggcgaacaacccggcguacaaagaggcaagggccgcaugcgcaaggccuuuccugcucuucagacaccccuagcacugccuagcuccgcuccagccuccccaggagccgggaagccaucacauacuggcagcugguugccucuccgauuacucaagcggcaacauuggcgaugggaaccauggaccgcuuguaaagaggccgugcagcaccuagugauuacugaguuauag

SEQ ID NO: 14640 - RNA, 438 nt, Artificial Sequence
  Description of Artificial Sequence: Synthetic coding sequence
auggcucagcuguuccucccacugcucgcagccuuagugcucgcacaggcuccugcugcacuugcugacguguuagaaggggauucuucagaggaucgcgcuuuccguguucgaaucgcuggcgaugcaccucuacagggagugcucggaggcgcgcucaccauucccugccauguccacuacuugcgaccaccuccuucaaggagggccguucuagggucacccagggucaaguggacuuuccugucucguggccgagaagccgaaguucugguagcucgaggcguacgugucaaagugaaugaagccuacagauuccgcguugcucuuccagccuaucccgcaucccugacugacguuucccuggcccuuagcgaacuucgacccaaugacaguggcauuuauagaugcgaagugcagcaugguauugacgauuag

SEQ ID NO: 14641 - RNA, 567 nt, Artificial Sequence
  Description of Artificial Sequence: Synthetic coding sequence
auguuucaucagaucugggcagcucuccucuauuuuuacggaauuauucuaaacucgaucuaucagugcccagagcauucccaguugacaacucucggcguggacggaaaagaauucccugaagugcaccucggccaaugguauuucauugcaggggcagcaccuacaaaagaggagcucgccacuuuugauccugucgauaacauuguauucaacauggccgccggaucggcucccaugcaauugcacuuaagggcuacuauucgaaugaaagacggguuguguguucccaggaaguggauuuaucaucucacugaagguuccacugauuuacgaacugaaggaaggcccgacaugaagaccgagcuguucucaaguuccugcccuggagggauaauguugaaugagacuggccagggauaucagcguuuccugcuguauaauagaagcccgcauccaccggaaaaaugcguugaggaauucaaaucauugacgucuugccuggacagcaaagccuuuuugcuuacuccccguaaccaagaggccugugaguuaaguaacaacuag

SEQ ID NO: 14642 - RNA, 558 nt, Artificial Sequence
  Description of Artificial Sequence: Synthetic coding sequence
auggguccagcuggcugcgcauucacccuccuacuccugcucggaauaucugacagagacuaccacagugcccuccaggaagccgaagugccuaucauugauagacaggcuugugagcagcuguauaacccuaucgguaucuuucuuccagcccucgaaccuguaauuaaggaggauaaaaucugugccggcgauacucaaaacaugaaagacucuuguaagggagauucaggagggcccuuaucaugucacauagacgguguuuggauucagacagguguaguuucguggggccuggagugugggaaaucauugccugggguguacacaaacgucaucuacuaucagaaauggauuaaugcuaccauuucucgagccaacaaucuugauuuuuccgauuuucuuuuucccauuguuuuacucagccuagcucuacuacgcccuagcugugccuucggaccaaacacaauccauagagucgguacuguggcagaggcgguugccuguauucaagggugggaagagaaugcuuggcguuuuaguccacgcggccgguag

SEQ ID NO: 14643 - RNA, 1653 nt, Artificial Sequence
  Description of Artificial Sequence: Synthetic coding sequence
cccgccccugcuagucgaaagcugcugccccgcaggcacuugagcgaaaagagccaccacauaucaauccccagcccagauauuagccauaagggccuccgaucaaagaggacucaaccgagcgaucccgagacaugggagucccugcccagacuugacucacagcgacauggcggcccugaauuuucauucgaucuguugccagaagccagggcaaucagagugacgauaucaagcggaccagagguuagcgugaggcucugccaccagugggcacuagaaugcgaagaacuauccucaccauaugacgugcaaaaaauugucucagggggccauacuguagaacucccauaugaguucuuguuaccaugccugugcauugaagcuucguaucuccaagaggacacuguccgcagaaaaaagugucccuuccaaucauggccugaggcuuauggaagcgauuuuuggaagucuguucacuuuaccgauuacucucagcacacacagauggucauggcguuaacgcuccggugcccacuuaaacuggaagccgcacugugucagagacacgauuggcauacccugugcaaggacuuaccaaaugcgacagcaagagaguccgacgggugguaugugcuugagaaagucgaucuccauccccagcugugcuuuaaguucuccuucggcaacaguucacacguggaaugcccgcaucaaacugguucuuuaacuucauggaauguuucuauggauacccaggcucaacaacugauucugcacuucucuagccgaaugcacgccacuuuuucagcagcauggaguuuacccggacucggccaggauacccuggucccgccaguguauacaguuucccaggcccgagguuccucaccaguuucucuggaucuaauuaucccuuuccuuagaccuggaugcugugugcucguuuggagaucggacguccaguucgcuuggaagcaucuuuugugucccgaugugaguuaccgucaucugggcuugcuaauucuggcacugcuagcucuacuuacgcugcugggagucguccucgcuuuaacuugucgucguccacagucugguccaggccccgcuagaccagugcuucugcugcaugcugccgauucugaggcccagaggcgacuugugggcgcccuagcugagcuucugcgggccgcucucggggggggccgcgaugugauaguugauuugugggaaggucgacauguggccagggugggcccacucccuuggcugugggcugcucguacccgcguugcgagagaacagggcacaguucugcuguuguggucaggugcugaucugaggccuguuucugguccagacccccgugcugcuccccuauuagcacuucuccacgccgccccccguccccuccuccuguuggcauauuuuucaagauugugugccaaaggcgauauaccaccccccuugcgugcauugccucgauauagacuguugcgagaccugccccguuuauuaagagcccuggacgcccgcccuuuugcggaggccacgagcugggggagacugggugccaggcaaagacgccaaucucggcuggagcuguguucaagacuagaaagagaggccgcaagacuggccgaucugggauag

SEQ ID NO: 14644 - RNA, 816 nt, Artificial Sequence
  Description of Artificial Sequence: Synthetic coding sequence
augggaauaguuugcgcacaguguucauucauauugcugcucucaauaauccgcgccagacccccccccuuucucuuuugccccuugaguucccagcgcacagaaucuccguacaaaccuguccaccuggguuuaggaccuacagacaaaguagcagccauugccauggcaagaauuaucgaccugguuccgugggacgacggcaguacacaugucuacgcaucccccgcaauccuguugccaauggaacgccaacggaaucagcuagcuggagugaagcagcagcuauaccaccccgcacuuccaacacugaggcacauggaccgcgauaccguuaaggcaugucuaccagacgaacauugucaaaguaccacuuacugucgcaaagacgaguuugacaacgcccacuuuacccugcugggagucccgaauaagccacuucaaugccucgacaucacggccacugggcagaagcuuaggaaccgcuaucaugaaggcaagcucgcacccaucgcuccuggaauuaacagaguugacuggccauguuucacgcgcgcuaucgaggauuggucccauuucgugucauccgccggggaauucaagcugccuugucugcgcaagcgcgcugagggucuauccggauacgcagucagauaucucaagccugacgugacacaaacauggagauacugucugucacagaacccauccuuagauagauacggccagaagccuuuaccuuucgauagucuuaacaccuuucgcaguuuuggcucuuccuauucccgcgucaacuaccuaacacccuggcacuag

SEQ ID NO: 14645 - RNA, 1743 nt, Artificial Sequence
  Description of Artificial Sequence: Synthetic coding sequence
augcaucuaucugccguguuuaaugcccugcucguuaguguccucgcugccguguuauggaaacauguccgcuugagggaacaugcugccacccuggaggaggaacucgcacucucccgacaagcgacugagcccgcuccugcacugcguaucgauuaucccaaagcacuccaaaucuugauggagggcggcacacacaugguuuguacaggaaggacacauacagaccguaucugccguuuuaaauggcucugcuacucaaaugaggcagaggaauucauuuuuuuucaugggaacacuucugugauguugcccaacuuaggcucaagaagauuccagccagcccugcucgaccucuccaccgucgaagaucauaacacccaguauuucaauuucgucgagcugcccgccgccgccuugagguucaugccaaagccggucuucguuccagauguggcccucauagcaaauagauucaaucccgauaacuugaugcaugucuuccacgacgaccuccuuccgcuguucuauacucuccgccaguuucccggacuugcucacgaagccaggcuguucuuuauggaaggguggggugaaggagcgcacuuugaccuguacaaacuucuuucccccaaacagccgcuucuucgggcucaguuaaagacacugggacgguugcugugcuucucacacgcuuucgugggacuaucuaagauuaccaccugguaucaauauggauucgugcagccucaggggcccaaagcuaacaucuugguuuccggaaacgagaucagacaguucgccagauuuaugaccgaaaaacucaaugugucccauacaggcguuccacugggcgaagaguacauccugguguucucccggacacagaauagacugauucucaacgaagccgaacugcuacuagcucucgcucaggaguuccagaugaaaacaguuacaguauccuuggaagaucauaccuucgccgacguggucagacucgugucuaaugcgagcauguugguuaguaugcauggcgcacaauuggucacuacucuguuucugccacgcggagcaaccguuguggagcuguuuccauacgcgguaaauccggaucauuacaccccuuauaaaacccucgcaaugcugcccggaauggaucuucaauauguggccuggaggaauaugaugcccgagaauacuguaacacaccccgaacgaccuugggaucagggggguauuacacauuuggaccgagcagagcaggcaagaauccuacagucgagggaggucccuaggcauuuguguugcagaaacccagaauggcuuuucagaauuuaucaggacaccaaaguugacaucccaagccugauccagaccaucagacgaguggugaagggucguccugguccuaggaaacagaaguggacugugggcuuauaucccggaaaaguuagagaagcacgaugucaggcaucugugcauggcgcaucugaggccagacugaccguaucuuggcaaauuccuuggaaccugaaauaccugaaaguucgcgaaguuaaguacgagguuuggcugcaggaacagggagagaacacauacguccccuauauuuuggcgcugcagaaccauacauuuaccgagaacauuaagcccuuuacuaccuaucucguuuggguccgguguauuuuuaacaaaauccugcuggggcccuucgcugacguccuggugugcaauacuuag

SEQ ID NO: 14646 - RNA, 513 nt, Artificial Sequence
  Description of Artificial Sequence: Synthetic coding sequence
auggaauucguagaugucacugaaagcaaugcgagaugggugcaagacuuucggcugaaagccuaugcaucaccagcaaaauuagaauccauagauggagcccgguaccacgcacuacugauccccuccugucccggugcucugacugaccuggcaucuucuggcucccuggcucgcauucuccagcacuuucacagugagaguaagccuaucugcgcagugggccaugggguugcugcuuugugcugcgcgacuaacgaggaccgcaguuggguguuugacaguuacucccugaccggcccuucagugugcgaacuugugagagccccugguuuugcucgccuaccccugguaguggaggauuuugucaaggauuccggcgcaugcuucucggcgagcgaacccgaugccguucauguaguccucgaucggcaccucguuaccggacaaaacgcuuccucuacagugccagcuguucaaaaucugcuguuucuauguggaagccggaaauag

SEQ ID NO: 14647 - RNA, 1041 nt, Artificial Sequence
  Description of Artificial Sequence: Synthetic coding sequence
augaggcucuuauuucuagcaguacugcggccgcacacuggaaacgccgucacugcccaacgcguacgagcccaccuggaagccgcaggacacgugugcgugcugaaagacgccuucgauuuugaaucccgaucugagaucgccaauuugauucuagccgaaaauugugaggccgcacucgcccuccaccuguaucggggcggcagauugcuucaagggcacagaauccccuucggagucauuuuuggagggaccgacgucaacgaggaugcuaaccaggccgaaaagaauacuguaaugggcagggucuuggaggaggcuagguuugcggucgcuuuuacugagucuaugaaggagauggcacaggcccaguggccccacgcaaaaggaaaaguuuacguucagucccagggaauugccaccacccccaacgcggcuuucaauuggaauacuuuccugcaaagaucagaaaucaaucagagcgccgacaaucuacauauuuuucugcuuaucugcggccucaggcaggucaaagaucccuuguauuuaguggaugcauucuccgccuggcaucaagaggagccgaacgugcaucugguaaucgugggaccagaaguugacccaguuuuuacucgggaaguuaaggcuaaagucaaaagggccgcaggagugagacucauuggcgagaugccccaggaagaucuccaugccguggucaaaaacugcuuugcgguggugaacagcucuguaucagaagguaugucugcugcaauauuagaagcgauggacuuagaagugccaguucucgcuaggaauauaccgggaaacgcagcagucguuaagcacgaagugaccggccugcuauucucaaauccacaggaguucgugcaccuggccaagcgccuugucucugacccugcucucgagaaggaaauugugguaaauggaagggaguacgugcggauguaccacucauggcagguugaacgugauacuuaucaacaacugauacgaaaauuagaagggaguacugaagacuag

SEQ ID NO: 14648 - RNA, 1482 nt, Artificial Sequence
  Description of Artificial Sequence: Synthetic coding sequence
agcgaagccguuuaucugaacgacaguacauaugacggacauacuguggggggacuucaauacggugguuugggacagcucgcggacggggugguaggcuuagaugacuuucgaaaaagucaggagcuaaggguguggcccgguuacgacuacguugguuggucaaaucauucuuucaguucugguuaugucgagauggaguuugaguucgaucggcugagagcuuuccaagcuaugcagguccacuguaauaauaugcauaccuuaggcgcaaggcucccaggcggcguggaauguagguucagaagagguccggcaauggcuugggaaggugagccgaugcgacauaacuugggagggaacuugggggauccacgcgcccgagcugugucuguaccacugggcggccgcguggcaagauuuuuacagugccguuuccuguuugccggaccuuggcucuuauucucagaaaucuccuucaucucagauguggucaacaauucaucaccagcccuuggggguaccuuucccccggcgccuugguggccaccaggccccccaccuaccaauuucucuucucucgagcuagaacccagaggacagcaaccuguugcuaaggcggagggcucacccacagccauacugauagggugucuugucgcuauaauacuccugcuucuccugauuaucgcucuuaugcuguggcgcuugcauuggcguagauugcucagcaaagucuuagaaucccauccucgaacccgcucacccggacugguagguauccgacccaccccacugcccguuucaccaauggcccugcgcuguuguucuccuauccagccaaccgcuaguuucuggccucugaccccugugccgcuagaggcucgggcucccccacacccaccuggacccaacccccccacuccgagaggcgugaccggcggcaacacauaugccgugccagcccucccgccaggggcagugggcgauggcccaccccguguagauuucccgaggagcagacugcgguucaaagaaaagcugggugaaggucaguuuggggaaguacacuugugugaagucgacucuccucaggaucuugugagucuagauuucccacugaacguccgcaaaggacacccucuucucguggccguuaagauucugaggccagacgccacuaaaaaugcucguaacgauuuccugaaggagguaaagauuaugucacgacucaaggaucccaauauaauccggcuccugggcguguguguacaagaugauccccuaugcaugauaaccgacuauauggaaaacggggaccugaaccaguuccuuagcgcucaccaacuggaagauaaagcugcagaaggggcaccuggggauggccaggcugcccaaggcccaaccauaucuuacccuaugcuauuacacguggcugcucaaaucgcuaguggcaugcgcuaucuagcuacccucaauuag

SEQ ID NO: 14649 - RNA, 354 nt, Artificial Sequence
  Description of Artificial Sequence: Synthetic coding sequence
auguuaauuuucuggaccauuacacuguuucugcucggggcugccaagggaaaagaagucugcuacgaagaucugggcugcuuuucugauaccgaaccaugggggggcacagccauucgaccucugaaaauccugcccuggucuccugagaaaauuggaacaagauuccugcucuacacuaacgaaaauccaaauaauuuccagauucuccuguuaagcgauccuagcaccaucgaggcgaguaacuuccaaauggaucguaagacccgguucaucauacacggauuuauugauaagggggaugagucaugggugaccgauaugugcaagcccggagccuccccacgagccuag

SEQ ID NO: 14650 - RNA, 1581 nt, Artificial Sequence
  Description of Artificial Sequence: Synthetic coding sequence
augcaaggccccuuacuccuaccaggauuguguuuucuccugucccuguuuggagccgucacacagaagaccaagacuucuugcgccaaguguccacccaacgccucuugugugaacaauacucauugcacaugcaaucacggcuauaccaguggaagcggccaaaaacuguucaccuucccucuugaaaccugcaacgccauugagacucaggccaucacggacaauugcucggaggagagaaagaccuucaaucuuaacguacagaugaauaguauggauauccgauguagugacauuauccagggcgauacacaaggucccucugccaucgcuuuuauuucuuacagcucucugggaaauauaauuaaugcgacauuuuucgaggagauggauaaaaaagaccagguuuaccuuaacucccaagugguuucagcugcuauuggucccaaaagaaacguuucacuaaguaaaucaguuacucugacuuuccagcaugugaagaugacuccauccacaaagaagguguuuuguguauauuggaagaguaccggacagggcucgcaauggucgcgggauggauguuuucucauucauguaaacaaaucacacacgaugugcaacugcucacaucuuucaagcuuugcagugcugauggcccuuaccucacaggaagaagauccaguacuuacuguuauuacauacgugggccucuccguaagccugcucugccuucuguuagccgcauuaacuuuucuacuauguaaagccauuaggaacaccaguacaagccuccaucugcagcugucccuuugucuguuccuagcccaccuccuguuucucguggguaucgaucggaccgagccaaaggugcugugcucaaucaucgccggugcacugcauuaucucuacuuggccgccuuuacauggaugcugcuugaaggcgugcacuuguuccugaccgcucguaacuuaaccgucguaaacuacuccuccaucaacaggcucaugaaguggauuauguuuccagugggcuaugggguucccgccguuaccgucgccauuuccgcugccaguuggccucaccuuuacgguaccgcugacagguguugguugcaccuagaucaaggcuuuauguggucuuuucucgguccagucugcgcuauuuucucugcuaaucuggugcuguuuauacuggucuucuggauucucaaacggaaacuuuccucccuuaauucagagguaucgacgauccagaacacacgcaugcuagccuucaaagcgacagcacagcuguucauucuggguugcacauggugucuuggccuacuacaggucgggccggccgcucaagugauggcauaccuauuuacuauaauuaauucgcuucagggauucuucaucuuuuuagucuacugcuugcuaagucaacaggugcaaaaacaguaucagaaaugguuuagagagauuguaaaaagcaagucugaguccgaaacauauacccugaguaguaaaaugggacccgauucuaaaccaagcgaaggagacguuuucccugggcagguaaagagaaaguauuag

SEQ ID NO: 14651 - RNA, 5832 nt, Artificial Sequence
  Description of Artificial Sequence: Synthetic coding sequence
ugacccagccuggcuggucggggagcaggacgcauggcuccaggggcacugagaggcgggugcgaacagagagcuccaggaggcggggcccguacagcugcucuugggccguggccuuggccaaguccugggccugcaccuucuccuggggccgcccccccacggucaagaaagaugucaggcgcccugcuauggccucugcuaccgcuccugcuacugcuuuugucagcgagagaugggguccgagcagcccaaccacaagcuccagguuaccucaucgcagcccccagcgucuuccgggccggaguagaggaaguuaucucagugaccauauuuaauagcccucgagaagugacuguccaggcucaguuaguggcucaaggcgaacccguggugcaaucucagggagcgauccuugacaaaggaacuauuaaacucaaagucccgacaggccugcguggacaagcucuguugaagguuuggggcaggggauggcaggccgaagagggaccuuuguuccauaaucagacuucagugaccguugacggccgcggcgcuagugucuuuauccagaccgacaagccaguguacagaccccagcaucgagugcugaucuccauuuuuacugucucuccuaauuuacgacccgucaacgagaaacucgaagccuacauucuugacccucgaggcucacguaugaucgaguggcgccaccuuaaacccuucuguuguggcauaaccaauauguccuuuccauuguccgaucaaccuguccuuggcgagugguuuauauucguagagaugcagggccaugcauauaacaagucauucgagguacagaaguacgugcugcccaaauuugaacugcuuauugacccuccaagauacauacaagaccuagacgcuugugaaaccgguacugugagggccagauacacauucggcaaaccaguggccggagcacugaugaucaauaugaccgugaauggcgugggcuacuacagccacgaaguugggaggccaguacugcgaacuaccaaaauucuuggcucucgagauuucgauauuuguguaagggacaugaucccagccgacguuccugagcacuuccgcggaaggguaucuaucugggcuauggucaccuccguagacgggucucaacaagucgcguuugaugacuccaccccggugcagagacaacuuguggacauacguuauucuaaagacacaagaaagcaguucaagccgggacucgcauauguagggaaaguggagcuaucuuacccugauggcuccccugcugaaggaguuacugugcaaaucaaggcugagcuaacgccgaaggacaacauauauacgagcgaaguggugagucagcgaggucuuguggguuucgaaaucccuagcaucccuacgucugcccagcacgugugguuagagacuaaaguuauggcauugaauggaaaacccgugggugcgcaauauuugcccaguuaucucagccucggcuccugguauagccccagccaaugcuaucugcaacugcagccuccaucacacccacuucagguuggagaagaggccuacuucucagugaaauccacauguccuugcaacuuuacucuuuauuacgaaguggccgcgcgcggcaauaucguucugaguggacagcagccagcccauacuacgcagcagagaucaaaacgggccgcaccugcacuagaaaagccaauucgacugacacacuuauccgagacagaaccuccaccggccccagaagcagagguagauguuugcguaacaucucugcaucucgccgugaccccaucaauggugcccuugggcagauugcuugucuuuuacgugcgggaaaacggggaaggaguggccgauaguuuacaauucgcaguggagaccuucuuugagaaucaaguuagcguaaccuacucugcuaacgaaacccagccuggcgaggugguggaccuaaggauccgagccgcacgaggaucaugugucuguguggcugcaguggacaagucaguguaucuuuuacgauccgguuuccgacugacacccgcucaagucuuucaggaacuggaggacuaugacgugagcgacagcuucggaguuagcagagaagacggaccauuuuggugggccggccuuacugcacaaagacgaagaagaucaagcguuuuuccuuggccauggggaauaacaaaagauagcggcuuugcauucacugagaccggacuuguugugaugacagaccgcguuagucuuaaucaucggcaggaugggggccuguacacugacgaggccgucccagccuuccagccccacacuggaucucuuguugcaguugcucccucuagacauccaccccggacggaaaagcguaaacguacuuucuuuccugaaaccuggaucuggcacugccugaacauuagcgaccccagcggggaaggcacccuuaguguaaaagugcccgacucuaucaccuccugggugggggaagccguagcccucaguacuagucagggucuuggaauagcugaaccaagccuccugaaaacguuuaagcccuuuuucguugauuuuauguugcccgcgcuaaucauccgaggggaacaagugaaaauucccuuaucuguguauaacuacauggguacuugugccgagguguauaugaaacugagcgucccuaaaggcauccaguucgugggucaucccgguaagagacaugugaccaaaaaaaugugcguugccccaggcgaggccgaaccaaucuggguggucuuauccuucagcgaucuuggacuuaauaauauuaccgcuaaggcccuugccuauggggacacaaacugcugucgagacggucgcaguagcaaacauccagaagaaaaucaugccgaccgcagaguuccuaucggcguagaucacguacgaagaucuguaaugguagaagcagagggggucccucgcgcuuauacuuauagcgcuuuuuuuugcccuuccgagcgcguccacauauccacucccaacaaauacgaguuccaguacguucagagaccccugcgccuuacccgauuugacgucgcaguuagggcccauaaugaugcacgagucgcccuguccagcggaccucaggauacagcaggaaugaucgagauaguccuggggggccaucagaacacacgguccuggaucucaacuuccaaaaugggagaaccuguagccagugcgcauaccgccaaaaucuuaucuugggaugaauucaggacauucuggauuagcuggcgcgguggacucauccaggugggccauggaccagaacccagcaaugagagcgugaucguagcuuggacccucccuagacccccggaaguccaguuuauugguuucuccaccggguggggcucaaugggagaauucagaauuuggagaaagauggaagucgacgaaagcuauagugaagcguuuacacuaggaguaccccacggugccauccccgggucagaacgggcuacagccagcauuaucggcgaugugauggggcccacccucaaucacuugaacaaucugcucagguugccauucggaugcggugagcaaaauaugauucacuucgcucccaacguguuuguacucaaguaucuucagaagacucaacagcuuagcccugagguagagagagaaaccacagacuaccugguccaggguuaucagaggcagcucacuuauaagcgacaggauggcuccuauucugcuuuuggagagagagacgcguccggcucuauguggcugaccgcauuuguguuaaaaucauucgcucaagcacggucauuuauuuuugucgacccucgagaacuggcugcagcuaagucauggaucauccagcagcagcaagcugacggaucauuccucgccgucggacgcgugcugaacaaagacauacaggguggaauucacgguacugugccgcuaaccgcguacguuguugucgcccuguuggagacuggcacagcuuccgaagaagaacguggauccaccgacaaggcgaggcacuuuuuagagagugcagcuccgcuggcgauggaccccuauuccugcgcauuaacuacauacgcucucacccuccuacguucucccgcugcucccgaagcacuuagaaaacugagaucacuugcaauuaugagggauggcguaacccacugguccuuaaguaacuccugggauguggacaaaggaacauuucugagcuuuagcgaccgugucucucaaucugucguuucagccgagguggagaugacagccuacgccuugcucacauacacacuccugggcgacguggccgccgcacugccagugguuaagugguugagucagcaacgaaaugccuuaggagguuucucuucuacccaagacaccuguguggcccuucaggcccuggccgaguaugcaauucugucuuacgcuggcgggauaaaucugacugucucccuggcuagcacaaaccucgauuaccaagagacuuucgaauugcaccgcaccaaccagaaaguuuuacagaccgcugcgauuccaagccucccgaccggacuguuuguaucugcaaaaggagauggcuguuguuugaugcagauugaugugacauauaacguuccagauccaguggcuaaaccagcuuuucagcuacuaguuucccugcaagagccagaagcacaggguagaccaccuccuaugcccgcuucugccgcagagggcucuagaggagauuggccccccgcugaugacgaugaucccgcugccgaccaacaucaucaggaauauaaaguaaugcucgaggucugcacaagauggcugcacgccgguagcagcaacauggcaguacuggaagugccacugcugucuggauuuagagccgauaucgagagccuggagcaguugcuucuggacaaacacaugggaaugaagcgauaugagguggccggccguagagugcuguuuuacuuugaugagauuccaagccggugucugaccugcguccgcuucagagcccuaagagaguguguugugggaagaacuuccgcccuuccagugucgguguacgacuacuaugaacccgcguuugaagcuacucgguucuauaauguauccacccacagcccguuggcucgggaacucugugcaggcccagcguguaaugaggucgaaagggcgccagcuaggggacccgggugguuccccggugagucagguccugccgucgccccugaggagggggccgccauagccaggugcggcugugaucacgacuguggugcgcaaggaaacccgguguguggcucugauggugucguuuaugccagcgccugucgccuuagagaagcagcuugucgccaggcugcaccguuggagccugcgccuccuuccugcugugccuuagaacaaagacugccugcaagcucuaguucaacguacggugaugaucuggccucagucgcacccgguccgcuucagcaagaugugaaacugaauggggccggccucgaggucgaagauucggacccagaaccugaaggcgaagcggaggacagaguuaccgccggcccgcggcccccuguaucuucuggcaaucuugaaucauccacgcagagcgcaucaccuuuucaucgguggggacaaacgcccgcuccacagagacauucaggaaggguugugggagcucaccggccagggcuucucuccccaguguuuguuuauaguccagcguuucagagugguggcgaagaaggccuguggauguccaacacuuguacucugcgguag

SEQ ID NO: 14652 - RNA, 456 nt, Artificial Sequence
  Description of Artificial Sequence: Synthetic coding sequence
auggaggccaccggaacagacgagguugauaaauugaaaacgaaguucauauccgcauggaauaacaugaaguauagcuggguuuuaaagacgaaaacuuacuucuccagaaacaguccaguacugcugcugggaaaauguuaucacuuuaaauaugaagacgaggacaaaacuuuaccugccgaaucaggaugcaccauugaggaccauguuauugcuggaaauguugaggaguuucggaaggacuuuauuucucgcauuuggcugaccuaucgggaagaguuuccacaaaucgaaggguccgcucucacgacugauuguggauggggaugcacccucagaacuggacaaaugcuccuggcucaaggcuugauacugcacuuucugggucgagcguggacuuggccugaugcccugaauauagagaauagugacucugaguccuggacaucuuag

SEQ ID NO: 14653 - RNA, 2616 nt, Artificial Sequence
  Description of Artificial Sequence: Synthetic coding sequence
augcggaagccucgccgaaagucccgucagaaugcagagggucggcgcucaccaucccccuauucccuuaaaugcucuccaacacgagagaccuuaaccuacgcacaggcucagagaauaguugaaguugauauugaugggagacuccaucgcauuucuaucuacgauccacuuaagaucaucacugaagacgaacucacugcccaggauauuacagaaugcaacaguaauaaagagaacucggaacagccccaguuucccggcaaguccaagaaaccauccagcaaggguaaaaagaaggaaucuuguagcaagcacgcgaguggaacgagcuuucaccucccucagcccuccuuccggauggucgauuccgguauccagccagaggcccccccacugccugcagccuacuacagauauauugagaaaccuccugaggaccuggacgcagagguagaauaugacauggacgaagaagaucucgcauggcuugacaugguuaaugaaaaaagaagggucgacggccacagccugguaucugcugauacauuugagcuucuuguagauagacuugagaaggaauccuacuuagaaagccgcuccagcggagcccagcagagccugaucgaugaggacgcauuuugcugcguaugcuuggacgaugaaugccacaauucaaacguuauucuauuuugugauauuugcaaccuagcagugcaccaggagugcuacggcgugccauacaucccggagggucaguggcucuguagauguugucugcagucuccuucacgcccaguagauuguauuuuguguccaaacaagggaggggccuuuaaacaaacuucagauggacacugggcgcacgugguuugcgcgauauggauuccagaggucuguuuugccaacaccguauuucucgaaccgauagaaggaauugacaauauccccccagcccgguggaaguugacgugcuauauuuguaagcagaagggauugggggcugcaauccagugucacaaaguuaacugcuauaccgcuuuccaugugacuugugcccaacgugccgggcuuuuuaugaagauugagcccaugagagagacaagccuaaacgggaccaucuucaccguaagaaaaaccgccuauugugaagcgcauagcccuccuggcgcagcuacagcccgucgcaaaggcgacaguccacgcagcaucagcgagacgggagacgaggagggacucaaagagggagauggggaagaagaagaagaggaggagguugaagaggaggaacaggaagcacaaggaggagucaguggcagccugaaaggaguacccaaaaagucaaaaaugucacugaagcaaaaaaucaaaaaagagccagaagaagccgggcaggacacucccagcacucucccuaugcuugccguaccucagauuccuagcuauagacucaacaagauuuguucuggacuuucauuucaacgaaaaaaccaguucaugcagagauugcacaauuauugguugcugaagcggcaggcccggaauggagucccacucauucguagacuucacucucauuugcagucccagagaaacgcugaacagagagaacaggacgaaaagacaagcgccguuaaggaggaacugaaauauuggcagaaguuaagacacgaccuggaaagagcacgccuccugauugaacucaucagaaaacgcgagaaacugaaaagggaacaggucaaaguucagcaagcugccauggaacuggaacugaugcccuucaaugugcugcugagaaccacuuuagaccuucuccaagagaaagaccccgcucauauuuucgcugagccagucaaccucagugaaguucccgauuaucucgaauuuauuuccaaacccauggauuucucaaccaugaggagaaaguuagaaagccaccuguaucgaacccuugaagaauucgaagaagacuuuaaucucaucguuacuaauuguaugaaguauaacgcaaaggauacaauuuuccaccgagccgccguucggcuccgcgaucucggaggggccauauuacggcacgcccgaaggcaggcugaaaacauuggguacgaucccgaacgagguacgcaucugcccgaaucaccaaagcuggaagacuuuuacagauucuccugggaggacgggcgaucucuucuguugccuuucgaagaucggggcgaccuggaaccacuggaacucgucugggcaaaaugccguggcuauccaucuuauccugcucuuaucaucgacccaaaaaugccaagagaagggcuccuucacaaugggguaccuauuccuguacccccccuggauguguuaaaacucggugagcagaaacaggcagaagcuggagaaaaauuauuuuuagucuuguucuuugacaauaagcgcaccuggcagugguugccccgcgauaagguucugccucuaggaguagaggacacaguugacaagcuuaaaaugcuggaagguagaaaaacaaguauucguaagucaguccagguagcauacgauagagccaugauccaucugucaagaguaagggggccucauagcuuugugaccaguucguaucucuag

SEQ ID NO: 14654 - RNA, 2700 nt, Artificial Sequence
  Description of Artificial Sequence: Synthetic coding sequence
auguuacuacuguuguugcuugcaccucuuuuucugcgaccuccaggugcaggaggagcccagacgccaaaugcuaccucagaagggugccagauuauucauccgccaugggagggcggcauccgguauagaggauuaacgcgggaucaggugaaggccauaaauuuucugccaguagauuaugaaauagaguaugucugcagaggcgagcgagaagugguggggccaaaagugcggaagugccuugcaaauggaaguuggacagauauggauacuccaagucgcugugugaaccguaccccacacucugaaaggcgugccgucuacauaggcgcucucuuucccaugucaggcggauggccaggugggcaagcuugucagcccgcgguagagauggcacuggaggaugucaacucucgacgcgauauacuccccgacuacgaacugaaguugauacaccacgacucuaaaugugaucccggucaggcaaccaaguaucuauaugagcuucuguauaacgauccuauuaaaauaauucuuaugccggggugcuccagcguaucaacauuaguagcugaagccgcacgcauguggaacuuaaucguucuuucuuauggaagcuccucaccagcccucucuaacagacagcgcuuuccuacauuuuuuaggacccauccuuccgccacacuccacaaucccaccagagucaaguuguucgagaaaugggguuggaaaaaaauugccacuauccagcagaccacugaaguauucaccucuacacuggacgauuuggaagaaagggugaaagaagccggcauagaaaucaccuuucgucagagcuucuucuccgaucccgccgucccgguuaaaaaucugaaaagacaagaugcuaggauaauugucggacuguucuacgagacugaggcucggaaaguguucugugaggucuacaaagaaagacuguucggcaaaaaauacgugugguucuuaauuggaugguaugcagauaacugguuuaagauuuaugaccccuccaucaauuguacaguugacgaaaugacagaagccguggagggccacauuacuacugagauugugauguuaaacccagcaaacacuagaucaauuucuaacaugacaucacaagaauucguagaaaaacucacuaaaaggcuaaaaagacaccccgaagagaccgguggauuccaagaagcuccucucgccuacgacgcaaucugggcauuggcacuggcacuaaacaaaacaagugguggaggcgggagaucaggggugagauuggaggacuuuaacuacaauaaccaaacaauuaccgaucaaauuuacagggccaugaauaguuccuccuuugaaggcgucucagggcaugucgucuucgaugcuagcggaucacgaauggccuggacacucauugagcagcugcaaggaggauccuauaaaaagaucggauacuacgacuccacaaaagaugauuuaagcugguccaaaaccgacaaguggaucggcggcuccccuccagccgaccagacccucgucaucaagacuuuucgguuccugucgcaaaaguuauuuaucaguguaucuguccuaucuucgcuuggcaucguccucgcaguugugugucucuccuuuaauauauacaauagucaugugcgguauauccagaacucacaaccaaaccugaacaaccuaacugccgucggauguucccucgcucuggccgccgucuuuccucuuggacuugauggguaccauaucggcagaaaccaguuucccuuugucugccaggcuagacucuggcuguuagggcuggguuucucauuaggauaugggucuauguucacaaaaaucuggugggugcauacugucuuuacgaaaaaggaagaaaagaaggaauggaggaaaacacucgaacccuggaagcuauaugccaccgugggacugcuugucggaauggaugugcugacucuugcaauuuggcagauaguugauccucuccaccguaccaucgaaacauucgcgaaggaagagcccaaagaggauauagauguaagcaucuugccccaacuggaacacuguucuuccagaaagaugaacaccuggcuggguauuuuuuacggauacaaaggacugcugcugcugcuugguaucuuccuugcguacgaaacuaaguccguuucaaccgaaaaaaucaaugaccacagggccgugggaauggccauuuauaauguggcagucuugugccucaucacagccccuguuacuaugauucuguccucccaacaggaugcagcuuucgcuuucgccagcuuagcuaucguguuuuccucuuacauaacucuaguuguuuuguuuguuccuaagaugcgccgccucauuacgcgcggugaguggcaaagugaggcucaagacaccaugaaaacaggcuccucuacaaacaacaaugaggaagaaaagucaagacugcuggagaaggaaaaccgggaacuggaaaaaauuauagcugaaaaggaagaaagagucucugaacucagacaccagcuacaauccaggcaacagcuuagaucuagacgccauccacccacucccccugagcccucuggugggcugccacguggaccuccagagccccccgauagacucucaugugauggaucgagagugcaucuucuuuacaaguag

SEQ ID NO: 14655 - RNA, 537 nt, Artificial Sequence
  Description of Artificial Sequence: Synthetic coding sequence
auggaaacuuucccgcugcuucuccucucccugggguuagugcuggccgaggcuuccgaaucgaccaugaagauuaucaaggaggaguuuacugacgaagagaugcaauaugauauggccaaaucaggacaggagaaacagacaauugaaauacugaugaaccccauuuugcuugugaagaauacaucacugaguaugucaaaggacgauaugucaagcacucuacugaccuuuagaucucuccauuacaacgauccaaaagguaacucaucgggaaaugacaaggaaugcugcaacgauaugacaguuuggcguaaagugagugaggcaaauggcuccugcaaguggucaaacaauuucauacgcuccuccacggaaguuaugaggcggguucaccgggccccgucguguaaguucguucagaauccugguauaagcugcugcgagucucuagaacucgaaaauaccgucugucaguucacaacugggaagcaauuuccccggugucaguaucacucgguaacaucucuugaauag

SEQ ID NO: 14656 - RNA, 2184 nt, Artificial Sequence
  Description of Artificial Sequence: Synthetic coding sequence
augauuuugagccuacuauuuucguugggcggcccgcucggguggggacugcuaggagcuugggcccaggcuagcuccacuucccugucugaucuucagucgucacgcacccccggcguguggaaagcggaagccgaagauaccggcaaagauccagucgguaggaacuggugccccuauccaaugucaaaacuggugacccuguuagcccuguguaagaccgaaaaauuucugauucacucucaacagccuuguccacagggagcgccggacugucagaaagugaaaguaauguaccgcauggcacauaagccugucuaccagguuaaacaaaaggugcugacaucccuagcuuggagauguuguccaggauauacugguccaaauugugaacaucauggacccauggcagugugguguuggccugaaccagauucgcuccaggcuagacucggacaacuccaacgcaaucugucagaacugcacaugaccaccgcccgccgggaagaggaauugcaauauacguuggaagacaugcgcgccacuuugacuaggcauguugaugagauuaaagagcucuauagugaaagcgaugagacauucgaucagauuuccaagguugaacgucaaguggaggagcuccagguuaaucacacugcguuacgggaacuuagagugauccucauggagaaaucuuuaaucauggaagaaaacaaagaagagguggagagacaguuacucgaacugaauuugacucugcaacaucuccagggaggccacgccgaccuaauuaaguacgucaaggauugcaauugccagaagcuauauuuagaccucgaugugauacgcgaaggacaacgggacgcuacccgcgcucucgaagaaacccagguaagccucgaugagagaagacaacuggauggaagcagccugcaagccuuacaaaacgcaguggacgccgugagccucgccgucgacgcacauaaggcugagggagaaagggcacgugcagccaccucucgacugaggagccagguucaggcuuuggaugacgaaguuggagcguugaaggcugcagccgccgaagcaagacaugagguuagacaguugcauucugccuucgcugcgcugcuugaagaugcauugcgccacgaggcaguguuggccgcacuguucggagaggaagugcuagaggagaugagugagcagacaccggguccuuugcccuugagcuacgaacagauccgcguugcccuccaggacgcagcaucggguuugcaagagcaagccuuagggugggacgaauuagccgcaagagugaccgcccuggagcaagccuccgagcccccaagacccgcugaacaucuagagcccucccaugacgcgggaagagaggaggcugccacaacugcacuagccggccuagccagagaauuacaaagcuuaagcaacgacgugaagaacguuggccgauguugcgaagccgaagccggggccggggccgcuucauuaaacgcuagcuuacauggacuccauaaugcccuguucgcuacgcaacggucacuagaacaacaccaaagacuuuuccauucacuguucggcaauuuucagggacugauggaggccaacgucagucuggaccuggggaaacuccaaaccaugcuuuccagaaagggcaagaaacagcagaaggaccucgaagcaccaagaaagcgggacaaaaaagaggccgaacccuuaguggauaucagagucaccggcccagugccaggagcucucggagcugcccucugggaggcugguucuccaguggccuuuuacgccucauucagcgagggaaccgcagcacugcagaccgugaaguucaauacuacauauaucaauauaggcuccucuuacuuucccgaacacggauauuucagggcaccggaaaggggcgucuacuuauucgcugugagugucgaauucggucccgguccugguacagggcaguugguauuuggugggcaccacagaaccccuguuuguacuaccggucagggcucaggcuccacagccaccguuuucgcaauggcagaacuucagaaaggagagagggugugguucgaauugacacaagggucuaucacuaagagaucacuauccggcacggccuuuggaggcuuccugauguuuaagacguag

SEQ ID NO: 14657 - RNA, 828 nt, Artificial Sequence
  Description of Artificial Sequence: Synthetic coding sequence
augggcuccgcaccuugggcaccaguucuguuacucgcuuuaggccuccggggauuacaggccgguggcgaguggcgcagaccacccgcccacucuccugugccagccccaccuuugagauucgccagcccacauuccccucaggguccaggcccccgauugcccggcgcccuccucccugccgcaucaggaccauugcagcucagagcccuccgccagcaggaccuaccuuccgccuugccuggaguaggacaagugcucggccccgggagaggugcccauuugcuucuccauugggaaagagggaggcgcgugggguuacgacagcaacugggauugaggcgcggcgcaggaggacgagcagggggaucuaccggacugaggggcgccccucugcugagggaaguggccgcagugcgaugcgccguccacgccgcaagggcucacggugccgccgauggaggagcaggccccggaagacuccgcagagcugccccuagggcuacgacccggccuagaggaccaggcuguccacgccauagacuacgcuggaaauuguggggugacgcgcagugccugccagaggaugaaguuaguccuccaggcggcggcggcgcaggcggacagagagcccgguccagcuguggccguccuagaagacugcaaccagugcugccaggccgacacgguggaucccucagacauggcccccucggugugagacaccugccugccgccgugcgaagggagggccccgaucccgcacugcaugugagacccgagugucugcauagagcaggacaugauggccucccccugccacauuag

SEQ ID NO: 14658 - RNA, 351 nt, Artificial Sequence
  Description of Artificial Sequence: Synthetic coding sequence
auggcugcaggcuccgcccccaugcaguuacacuuacgagccacaauaagaaugaaagauggucucugugucccuagaaaguggaucuaccaccugaccgaaggcaguacugaucuucgaacggaaggaagaccagacaugaaaacagaauuguuuagcucuagcugcccaggaggaaucaugcucaacgagacuggacagggguaucagcgauuccuucuuuauaaccggucgccccauccaccagagaagugcgucgaggaguuuaaaagccugacaucaugcuuagacaguaaagccuuucuguugaccccccggaaccaagaagcgugugaacugucuaauaacuag

SEQ ID NO: 14659 - RNA, 522 nt, Artificial Sequence; identical to SEQ ID NO: 13020
  Description of Artificial Sequence: Synthetic coding sequence

SEQ ID NO: 14660 - RNA, 1482 nt, Artificial Sequence
  Description of Artificial Sequence: Synthetic coding sequence
agcgaggcuguguaucucaacgauucaaccuacgacggacauacaguugggggucugcaguacggagggcugggacagcucgcagauggcguugugggacuggaugacuuuagaaaaucacaggaacugcgaguguggccgggcuaugauuaugucggguggagcaaccacagcuuuucuucuggguauguggagauggaauucgaauucgacagguugagagccuuucaggcuaugcaggugcacugcaacaacaugcauacauugggcgccagacuuccagggggcguggagugucgguuucgcagagggccugccauggcaugggagggugaaccaaugaggcauaaccugggaggaaaucugggcgauccccgggcucgggcuguuuccgucccuuuagguggcagagucgcuagauuucugcaguguagauuccuuuucgcgggcccuuggcugcuauuuucagaaauuucuuucauuagugacguggugaauaacuccagcccagcacucgguggaaccuuccccccugcccccugguggccacccggccccccuccaacuaauuucuccagccuggaacuugagccccgaggucagcaaccaguggcaaaggcagaaggcagcccuacggcgaucuuaauugggugccuggucgccaucauccugcucuugcugcucauaauagcgcuaaugcuuuggagguugcauuggaggcggcuccucucuaagguacuugaaucucacccucguacaagaagucccggccuugugggaauacgaccaacccuucuuccaguaagcccuauggcucuacguuguugcucuccaauucaacccacugcuuccuuuuggccucuuacucccguuccacucgaggcucgugcuccuccacauccucccgguccaaauccaccuaccccacgcggaguuacaggugggaacacguaugccgucccggcgcuccccccgggggcuguaggagaugguccuccucguguggauuucccgcggucaagacuccgauucaaggaaaaacugggggaaggucaguuuggcgaggugcaccuaugugaaguagacuccccccaagaccuggugucguuggauuucccccugaacgugagaaaaggccacccgcugcucguugccguuaaaauccuaaggccagaugcuaccaagaaugcccgaaaugacuuucugaaagaaguuaagauuaugagcaggcuaaaagauccaaauauuauccgauuacugggaguuuguguacaggacgauccucuuugcaugauuacugauuauauggagaauggggaccugaaccaguuccuaucugcccaucaguuggaggacaaagcugcggaaggggccccaggagacgggcaggcagcucaaggaccaaccaucucguauccuauguuacuucaugucgccgcacagauugccuccggcaugagauaucucgccacgcugaauuag

SEQ ID NO: 14661 - RNA, 639 nt, Artificial Sequence
  Description of Artificial Sequence: Synthetic coding sequence
augggucuucaccuccggcccuaccgagucggccuccucccagauggacugcuauucuuauugcucuuacugaugcugcuugccgaccccgcucugccagccggccgccacccacccguaguucuaggagauaauaaucgcauuccgguuauuggcccuuugaagaucagggagcagcagaggucugccguaaguacgaguugguugcugccuuacaacuacacauggucuccagagaaaguguucgugcaaaccccaaccauaaauuacacucuacgcgacuaccggaaguucuuucaggacauaggcuuugaggacggauggcuaaugcggcaagauacagaaggccuaguggaagccaccaugccaccaggugugcagcuucauugccucuauggaacaggagugccaacgcccgauuccuuuuauuacgaaaguuuuccggacagggaucccaagaucugcuuuggggauggugauggaacagucaauuuaaagagugcauuacagugccaggccuggcaaaguagacaggagcaccaggugcugcugcaggaauugccaggaagugagcauauugaaauguuagcuaaugcgaccacucuggcuuaucugaaacgaguguuacuuggaccauag

SEQ ID NO: 14662 - RNA, 654 nt, Artificial Sequence
  Description of Artificial Sequence: Synthetic coding sequence
augagcgaccugcugcugcuagggcugauuggcggucucacucugcugcuccuguugacccuccucgcuuucgcugguuacucaggucuacuggcgggggucgagguuagcgcggguucccccccuauacguaacgugaccgucgccuacaaguuucacaugggccucuacggagagaccggccggcuguuuacugaguccugcucuauuucaccaaaguuaagauccaucgccguuuauuacgauaauccacacaugguccccccugacaaaugcagaugugccguaggauccauucucucugaaggagaagaaaguccaagucccgagcucaucgaucuuuaccagaaauucggcuuuaagguauucuccuuccccgcuccaagccacguggugaccgccaccuucccauauacuacaaucuuaaguaucuggcuugcgacccggagaguccacccugcucuugacacuuacaucaaagaacggaaauuaugugccuauccccgacuagaaaucuaccaagaggaucagauccauuucauguguccacuggcccgccagggagacuucuacgugccugaaaugaaagaaacagaauggaaguggcgcggacugguggaggcaaucgauacucagguggaugggacaggguag

SEQ ID NO: 14663 - RNA, 345 nt, Artificial Sequence
  Description of Artificial Sequence: Synthetic coding sequence
augaaaacuuucacauggacccuuggcguccuuuucuuucuguuagucgacacugggcacugcagaggcggccaguuuaagaucaagaagauuaaucaaagacgauacccucgagcuacugacggcaaggaggaagcuaagaagugcgcauacacauuucucgugccugagcagcgcauuacggggccaauuugcgugaauaccaagggacaggacgcguccacuaucaaggauaugauuaccagaauggaucuagaaaaucugaaagacguacugagccgccagaagagggaaauugaugugcuucaguuggugguggauguggaugguaauauagucaacuag

SEQ ID NO: 14664 - RNA, 870 nt, Artificial Sequence
  Description of Artificial Sequence: Synthetic coding sequence
auguucgugcugcuguaugugacuaguuuugccaucugugccucagggcagccuaggggaaaccaacuuaaaggagaaaacuauagcccaagguacauuugcucaaucccaggacugcccggcccgccuggcccaccgggcgcaaacggcucaccggguccccauggccgcaucgguuugccuggaagagacggacgggacggaagaaaaggagagaagggggagaaggggacugcaggacugcgcgggaagacaggaccguuaggccuugccggagagaaaggcgaccagggggagaccggaaaaaaaggcccaaucggccccgaaggagaaaagggcgaagugggcccuauugguccaccaggccccaaaggcgaccggggagagcaaggcgacccgggccucccaggcguuugucgauguggauccauaguccugaaaucugcuuuuuccgugggaauuacaacuucauacccagaggagagacuuccuaucaucuucaacaaaguucucuuuaacgagggcgagcacuacaacccugcaacuggcaaguucaucugugcuuuuccaggaauuuauuacuuuucauacgauauuacucuggcaaacaagcaccuugcaauuggauugguucacaauggccaguaucgcauuaaaacuuuugacgcaaacacaggcaaccacgacguggcauccggcagcacaguuaucuaccuucagcccgaagacgagguauggcucgagaucuucuucacagaccagaacggguuguuuuccgauccaggaugggccgauucuuuguucaguggauuccuucuguacguggauacagauuacuuggacagcauuagcgaagacgacgagcuuuag

SEQ ID NO: 14665 - RNA, 1002 nt, Artificial Sequence
  Description of Artificial Sequence: Synthetic coding sequence
augguauccaaaagucgguggaaguuacucgcaaugcuagcauuaguuuuaguggucauggugugguauagcauaagccgggaagacagauauaucgaacucuucuauuuccccauaccagagaaaaaggagccauguuuacagggagaggcagaaucaaaggcuaguaaacuuuucgggaauuacucucgugaccaaccaauuuuccuuagacuagaggauuauuucuggguuaagacuccuuccgccuacgaacugcccuacggcacgaaggggagugaagaccucuuguuacgggugcucgcaaucacauccucaagcauuccaaagaacauacaaucccucaggugucggcguugcgucgucguugggaacggucauagauuaaggaacucuucacuaggggaugccaucaacaaguaugauguaguuauucgacugaacaacgccccagucgcaggauacgagggagauguuggcucgaagaccaccaugcgcuuguuuuaucccgagagugcucauuucgaccccaaaguggagaacaauccagauacucuguuaguccuggucgcuuucaaggcaauggauuuccacuggauagaaaccauccucuccgauaagaaacguguccggaaaggcuuuuggaagcagccaccucucauuugggacgucaauccaaagcaaauuagaauuuugaauccauuuuucauggagauugcggcugauaaacuucucucucuaccuaugcagcagccucgcaagauaaagcagaaaccgacaaccggccuacuugcuaucacacucgcccuccaccugugugaccucgugcacaucgccggguuuggguacccagacgccuauaauaaaaagcagacgauccacuauuaugagcagaucacucugaagaguauggcagguagcggacauaacguaucacaggaagcacuugcgauuaagagaaugcuggagaugggugcaauaaaaaauuuaacuagcuuuuag

SEQ ID NO: 14666 - RNA, 531 nt, Artificial Sequence
  Description of Artificial Sequence: Synthetic coding sequence
augcgucuucugauauugacuugucuuguggcuguagcacuggcucgaccuaaacugccacuccgcuacccugaaagacugcagaacccuucugaaucuagcgaaccaauaccucuagaaucacgggaagaauacaugaaugggaugaaucggagaaacaucuuacgggagaaacagacagacgaaauuaaagauacccggaaugagaguacacagaauugcguugucgcagaaccugagaagauggagaguucuaucucuagcucuuccgaagagcaguuuugucgacugaaugaauacaaucagcuccaacugcaggccgcccacgcccaggaacaaauucgacgcaugaaugaaaauucacaugugcagguuccauuucagcagcucaaccaguuggccgccuaccccuaugcagugugguacuauccucaaaucaugcaguacguaccuuuuccuccauucuccgauauuucuaauccaacugcucacgaaaauuaugagaagaauaacgucaugcuccaaugguag

SEQ ID NO: 14667 - RNA, 279 nt, Artificial Sequence; identical to SEQ ID NO: 13028
  Description of Artificial Sequence: Synthetic coding sequence

SEQ ID NO: 14668 - RNA, 1656 nt, Artificial Sequence
  Description of Artificial Sequence: Synthetic coding sequence
augacguggcgcauggguccuagauucaccaugcuacucgccaugugguuaguuugcggaagugaaccucauccucaugccacaauccguggaucccacgguggaagaaaggucccauuagugucccccgauaguucccgucccgccagauuccuuagacauaccggccgaaguagagguauugagcgcuccacccuggaagaaccgaauuuacaacccuuacagcgaagacgaucuguuccuguacuucgccuggcacguccaucccgauuuagagacaacaggauggacaggagggagcacggccacagggacccuaauguuguaccuggcccacccaaaccugcaaaagaaaaacccccgaaaaagaaagcgcaggauaagauauuaucuaaugaauaugaagaaaaauacgaccugagcagacccaccgccucccaacuagaggacgaacuacaaguagguaacguaccacugaagaaggcaaaagaaaguaaaaagcaugagaagcuggagaagccagaaaaggagaagaagaaaaagaugaagaacgaaaacgcugacaagcugcuuaagucagaaaaacaaaugaaaaagagcgaaaagaaaucuaaacaggagaaagagaagucuaagaagaaaaagggaggaaagacagagcaggacggguaucagaagcccaccaauaaacacuucacccagagcccaaaaaaaucaguagcugaccuguuaggaaguuucgaagguaagagacgccuauugcugaucacagccccuaaagcugaaaacaacauguacgugcagcaacgugacgaguacuuggaaagcuucuguaaaauggccacaagaaaaaucucagucaucacuaucuucggaccuguuaacaauagcaccaugaaaauugaucacuuucaauuggacaaugaaaaaccuaugagaguuguugacgaugaagaucugguggaccagcgccuaauuagcgaacuccggaaagaguacggaaugacuuauaaugacuuuuuuauggugcugacugauguugaccuaagagucaaacaguacuacgaaguccccauuaccaugaagucgguguuugauuugauugacacuuuccagucccgcaucaaagauauggagaagcagaagaaggaagggaucguauguaaggaagauaagaagcaauccuuagaaaacuuucuguccagguuucgguggcgucgacgguuacugguuauaucugcuccuaacgaugaggauugggcguauucacagcagcugagcgcacugagcggacaggcaugcaauuuugguagcucuguggucgagagggaagacgugccugcacaccugguaaaggauauuagaaacuauuuccaaguguccccugaguauuuuucuaugcuacuuguaggaaaggauggcaaugucaagucuugguacccguccccaauguggagcaugguaauaguauacgauuugauagauucuaugcagcugcgcagacaggagauggcaauccaacagagucugggaaugagaugcccugaagacgaauaugcugguuauggcuaccacaguuaccaccaggguuaccaggauggauaucaggaugacuaccgacaccaugaaucauaccaucacggauauccuuacuag

SEQ ID NO: 14669 - RNA, 1245 nt, Artificial Sequence
  Description of Artificial Sequence: Synthetic coding sequence
augggagugagcaaguuagauauucucuaccgaagauuauuauugaccaaauuguuuauacgaggauggggaagaccagaagaucugaaacgucuguucgaauuccgcaaaaugaucggcaacagagaacggugucaaaaucugguaucuuccgauuaccccguccauauugacaagaucgaagaacaaucagauugcaaaauccucgauggacauuucgugaguccuauggcacauuacguucccgauauaaugcccauugagagugugauugcucgguuucaguucauugugccuaaagaauggaauaguaaauaccgcccugucuguauucaccuagccggaacaggggaucaccauuauuggagaaggaggacuuuaauggcaagaccaaugaucaaagaagcgcgcauggccagccuucuguuagagaauccuuacuacgggugucggaaaccuaaggaccaagugcguaguucucugaaaaauguuucugacuuguucgugauggguggagccuugguccuggaaagcgccgccuugcugcauuggcuagaacgagagggcuacgggccacucggcaugaccggaaucagcauggggggucacauggccucgcucgcugucucgaacuggccaaagcccaugccacugauuccaugccucuccuggucaaccgcuucuggcguguuuaccaccacugacucuuuuaaaaugggacaggaguucguuaaacacuucaccucaucugccgauaagcuaacuaaccugaacuuggugagccgcacccucaaccuggacaucucuaaccaggucgugucacagaaaccggccgacugucacaauuccagcaagaccagcguaucugccacuucugaaggccuguuguugcaggauacgaguaaaaugaagcgguucaaccagacucuuucuacuaacaaaagcggauacaccucucgcaacccccagagcuaucaccuauuaagcaaagaacaaucccgcaauucucucaggaaagaaagccuaauuuucaugaagggugugauggaugaauguacccacguagcaaauuucucuguacccgucgaucccucgcugauuaucguuguucaggcuaaagaagacgccuauauuccuagaaccggcgugcggaguuugcaggagaucuggcccggaugugaaauuagguaucuggaagguggucauauaagcgcauaucuuuuuaaacagggacuguucagguag

SEQ ID NO: 14670 - RNA, 912 nt, Artificial Sequence
  Description of Artificial Sequence: Synthetic coding sequence
augagugaaccacagccugaucuggaaccgccucaacacggccucuacaugcuuuuucuuuuagugcugguguucuuuuugaugggauuagugggcuuuaugaucugucaugugcugaagaaaaaggguuacagaugcaggacgucuaggggauccgaaccggaugacgcucaacuucaaccuccugaggacgaugacaugaaugaggauacugucgagaggauagugcgauguauuauucagaacgaagcaaaugcagaggcacuuaaggagaugcucggagacucggaaggggagggcacaguacaguuaaguuccguggacgcuacaucuucacuucaggauggugccccuucccaucaccacaccguucaucucggcagugcugcucccuguuugcacugcucccgguccaaaagaccgccauuagugcgccagggcaggucuaaggaagguaaaucucgcccgaggaccggugagacaacaguuuuuuccguagggcgguuccgagugacacauauugaaaagagguacggacugcaugagcaucgcgacggaagccccaccgauagaaguugggguucugguggcggacaagacccuggcggugggcaaggaucuggcggcggacagccuaaggcuggcaugcccgccauggaacgcuuacccccugaacgcccccagccccaagucuuagcgucuccacccguccaaaaugggggccucagagauaguagcuugacacccagggccuuggaggggaacccacgcgcuuccgccgagcccacucuccgcgccggcggccgaggacccuccccaggacuacccacacaggaggcuaauggacagccuucuaaaccagauacgagcgaccaccaagugucuuugccucaaggggcggguaguauguag

SEQ ID NO: 14671 - RNA, 444 nt, Artificial Sequence
  Description of Artificial Sequence: Synthetic coding sequence
augggaccagaagcccucucuucacuucuguugcuucugcuggucgcgagcggggacgcagacaugaaaggccacuucgaccccgcaaaguguagauaugcucuaggaaugcaagauaggacgauucccgacucugauauuucugccaguagcuccuggagcgacaguaccgcugcgcgucacucuagacuagaguccagcgauggcgacggcgcgugguguccugccggaagcguauucccaaaggaagaagaguaccuccaagucgaucuccagcgccuucaucuagucgcucugguggguacucaggggcgccacgcaggcggcuuagguaaggaauuuagucggucuuacaggcucagauauucuagggacggcaggcgguggaugggauggaaggaucggugggggcaagaaguaaucagugguaaugaggauccauag

SEQ ID NO: 14672 - RNA, 1173 nt, Artificial Sequence
  Description of Artificial Sequence: Synthetic coding sequence
augggcgcaacgacuauggaccagaagucccugugggcggguguagucgugcuucugcugcuccagggaggaucagccuauaaacugguguguuacuucacuaauuggucccaagacaggcaagaaccuggcaaguucacccccgaaaauauugauccauuucugugcucccaccugaucuacucuuuugccuccauugaaaacaauaaaguaauuauaaaagacaaguccgaagugaugcuguaccaaaccauuaauucccuaaagaccaaaaauccaaaguugaagauuuuguugagcauagguggcuacuuguucggcucuaaaggcuuucacccgaugguggauucaaguacuucgcgucuggaauuuauaaauucgauaauccuguuccugcggaaccauaauuuugauggacuggacgucaguuggauauacccagaucaaaaggaaaacacacauuuuacaguguuaauucacgaacuggccgaggcauuucagaaagacuuuacaaaguccaccaaagaaaggcugcuuuugaccgcagguguuucugccgguaggcaaaugaucgacaauucauaccaggucgaaaagcucgccaaggaccucgacuucauaaaucugcugucuuucgauuuccaugggucaugggagaagccauuaauuaccggacacaacucgccacucucuaaggguuggcaggaccgcggccccuccuccuacuauaauguugaguacgcugugggauauuggauucauaagggaaugccaucugaaaaaguaguuaugggcaucccuacuuacgggcacagcuucacacuugcauccgcagagacaacuguuggagcaccagcuagcggccccggcgcagccggaccgaucacugaaagcuccggauuucuagcguacuaugagauuugccaauuucugaaaggugcuaagauaacucgccuccaggaucagcaggucccuuacgccguaaaggguaaccaauggguuggguacgaugaugucaaaagcauggagacaaagguacaguuccucaagaaccucaaccucgggggagccaugauuuggaguaucgauauggaugacuuuacuggaaaauccugcaaccagggccccuauccccuuguccaagcaguuaagcggucuuuaggaagucuauag

SEQ ID NO: 14673 - RNA, 297 nt, Artificial Sequence; identical to SEQ ID NO: 13034
  Description of Artificial Sequence: Synthetic coding sequence

SEQ ID NO: 14674 - RNA, 600 nt, Artificial Sequence
  Description of Artificial Sequence: Synthetic coding sequence
auggcauggggcggaguucacaccugcugcuuccaccugugcuguugcuguuccuggccccagggcgcuguuccugaagagcuccacaagcacccaggacagacucuguuguugcaaugccaguauucuccuaagagagggccauaucagccuaaauccuggugucagcagacuucaccuagcagaugcacacuguuaguuacuucuucaaaaccauggaccgccgugcaaaaaucacauuacacaaucugggauaaaccuaaugcaggguuuuucaacauaacaaugauucagcuaacucaaaaugauucaggcuuuuauugguguggaaucuauaaugccagugagaacauuauaacgguccuucgaaacaucagcuugguugugaguccugcuccuacgacuucuccuauguggacucugcccuggcuuccaacaucgacugcaugggaaccccagauucaagaaauuaaauuucgagccccaacugacucaacgcuuuggaaaucucgcgcaccugcaugccuagggaguggcgggccgagguuucucgugcuugugcugugcggauuguuauuagcuaaaggccugaugcuguag

SEQ ID NO: 14675 - RNA, 2025 nt, Artificial Sequence
  Description of Artificial Sequence: Synthetic coding sequence
augacaacagaugacaccgaaguaccagccaugacucucgcuccuggacacgcagcucucgagacccaaacccuuucggcugaaaccucaucacgggcaucuaccccugcgggaccuaucccagaagcugaaacuaggggcgccaaacgcauaucgccagccagggaaacuagaucuuucaccaagacaucccccaauuucaugguacugauugcuaccuccguggagacaagcgccgcuucagguagcccagagggugcuggaaugacaacuguacagacgaucaccgguuccgacccaagagaagccaucuucgacacacucuguacugaugacagcucugaggaggcaaaaacccucaccauggauauacugacucucgcccacaccuccaccgaggcuaaagguuuaagcagugagagcucagccaguucugacuccccccauccugugauuaccccaucccgagccucugagucuuccgcuucuucugacggcccccacccagucaucaccccuucacgcgccucugagaguagugcuagcagcgaugguccgcacccagugauuacgcccagcagggccuccgaauccucugccaguucagacgguccucauccuguuauaaccccuucaagagcauccgaauccagugccuccagcgauggaccucauccagugauuacuccuucacgugcaucugagucaagugcaucuucggacggcccucaucccguuauaacuccuaguagagcaagugagucaucugcaucaagcgauggcccccacccugugaucacccccucucgggcuucugaaagcucugccuccucugacgggccacacccuguuaucaccccaucaagagcuucugaaucaucugccucauccgacgggccucacccuguaaucacuccgagucgggccucagaauccucugcaucuagugauggacuccacccagucauuacacccucccgggcuagcgaauccuccgccucuuccgacggaccgcauccaguaauaacucccagccgggccucugaaucuucugcuucaucugauggaccccacccaguaauuacuccuagcuggagcccaggcagugacguaacccuguuagcagaagcccuggugacggugacaaauaucgaggugaucaauuguucaauuaccgagaucgaaacuacuaccucuaguauuccuggagcauccgauaccgaccugaucccuaccgagggagucaaggcuaguuccacgucugaucccccugcacugcccgacagcaccgaagccaagccgcauauuacggaaguuaccgccagugccgaaacacucuccacugcagggacaacagaauccgccgcaccagaugccacuguggguacaccccucccuacgaacucggccaccgaacgcgaagugaccgcccccggcgccacaacacucucaggugcucuagugaccguuagccguaacccccuggaggagacaagcgcccuaucagucgaaacaccauccuaugucaaggucagcggugccgcaccagucagcauugaggccggcuccgccgucggaaaaacaacaaguuuugcugggagcagugcaaguucuuauuccccgucagaggcugccuuaaaaaauuuuacacccagugaaacaccuaccauggacauugccacaaaaggcccauuuccuacuagucgagacccccuaccauccgucccuccaacuaccacuaacagcucgcggggcaccaauucuacacuggcaaaaauaacaacauccgccaaaacaaccaugaagccacccacugcuaccccgacuacugcuaggacccgcccuacaacagacgucagugccggcgagaauggaggauuccugcuacuuaggcuuagcgucgcaucucccgaagacuugacagacccuagaguagccgagagacuaaugcaacagcugcaucgcgagcuccacgcgcacgcaccacacuuucaggugagccuacuccgggugagacgcggcuag

SEQ ID NO: 14676 - RNA, 738 nt, Artificial Sequence
  Description of Artificial Sequence: Synthetic coding sequence
augcaggccgcaugguugcuuggugcacuggucgugccccagcugcugggauuuggacauggcgcacgcggagcugaaagggagugggaaggaggcuggggaggggcucaagaagaggagagggaaagggaagcacucaugcugaaacaccuccaggaggcacucggccugcccgcuggacggggcgaugaaaaccccgccggaacaguugaggguaaggaggauugggagauggaggaagaucagggggaggaagaagaggaagaggcuacaccaacgccaagcuccggaccuucuccuuccccaacaccagaagacauugugacauauauacuagggagacucgcaggccuggaugcuggucugcaccaauuacacguccgacugcaugcccucgacaccagggugguggaauugacccaaggccuccgacagcuucgaaacgcagccggcgauacaagagacgcugugcaagcucuucaggaggcccagggacgcgccgagagagaacacggaagguuggaaggaugcuugaagggccugcgucugggacacaaaugcuuccugcucagcagagacuucgaagcucagccaagcgcuagcccccauccacuuucaccugaucagccaaacggcggaacucucgaaaauuguguggcacaggccagugaugauggcuccuggugggaucacgacugucagcgcagauuguauuacgugugugaguuuccuuuuuag

SEQ ID NO: 14677 - RNA, 279 nt, Artificial Sequence; identical to SEQ ID NO: 13038
  Description of Artificial Sequence: Synthetic coding sequence

SEQ ID NO: 14678 - RNA, 177 nt, Artificial Sequence; identical to SEQ ID NO: 13039
  Description of Artificial Sequence: Synthetic coding sequence

SEQ ID NO: 14679 - RNA, 732 nt, Artificial Sequence
  Description of Artificial Sequence: Synthetic coding sequence
augggaccugaagcccugucuagccugcugcucuuauugcucgucgcuagcggcgacgcugauaugaaggggcacuuugaccccgccaaaugcagauaugcucucggaaugcaagacaggacuauccccgacucugauauuagcgccuccucaagcuggagcgacaguaccgcggccagacacucaagacuggaguccuccgauggagauggagcaugguguccagcagguaguguguuuccuaaggaagaagaauaucuucaaguggauuugcagcgacuccaucugguggccuuggugggcacccagggacggcacgccggaggucucgggaaggaauuuagcaggaguuauaggcugcgcuauuccagagacggaagacguuggaugggcuggaaagacagguggggacaagaggugaucuccgggaaugaggauccugaaggugugguauuaaaagauuuggggcccccuauggucgcgcgcuuaguaagguucuauccgagggccgaucgggucaugagcgugugccugcgggucgaacuguauggaugcuuguggagggacuguaguaugggcguaugggcuuccuggcagaugguaugguggggguggaugacuuuggguagggugagguccuguggcagcggccaggcuaugacuaugugggacggggcgacgaccgcauccccagucgcaauguggagguggagccuuagucugaccggguag

SEQ ID NO: 14680 - RNA, 2535 nt, Artificial Sequence
  Description of Artificial Sequence: Synthetic coding sequence
augggaccuggagccccguucgcccguguuggcuggccucuaccucugcuggucguaauggcugcaggcguugccccugucugggccagccacagcccucaucucccaagaccucacuccagagugccaccucacccuuccuccgaaaggcgugccgucuacaucggugcucuguuccccaugucaggcggcuggcccggcggucaggcuugccaaccagccgucgagauggcucuggaggacgugaauucaagacgcgauauucugccagauuacgaacucaagcugauucaucacgacaguaaaugcgaucccggucaagcgacgaaauauuuguaugaacugcuuuacaaugaucccauuaagaucauucugaugccggguuguucuucaguaucaacucugguugcagaagccgcgcggauguggaacuuaauuguccucucuuacgguucauccuccccugcucugaguaaucgacaacgguuuccuacuuucuuuagaacgcacccuucagccacucuccacaacccuacuagaguaaagcuguuugagaaguggggauggaagaagaucgcaacaauucagcagacaacagagguuuucacuucaacauuagacgaccuggaggagagagucaaagaggcgggaauugaaauuaccuuuagacagucauucuuuagcgaccccgcugucccugugaagaaccugaaaaggcaagacgcuagaaucaucgucggcuuguuuuacgaaaccgaagcuagaaagguauuuugugaagucuacaaggagcgguuguuuggaaaaaaguacguuugguuucugauuggaugguacgcugacaauugguuuaagaucuacgacccauccaucaauuguacgguagacgagaugacagaggcaguagagggucauauaaccacagaaauugugauguugaauccggcaaacacuagaaguaucucuaacaugacuagucaggaguucgucgaaaaacucaccaaaaggcuuaagcggcaccccgaggaaaccggaggcuuccaggaagccccuuuggcauacgaugcaauuugggcccuggcacucgcucucaacaagacuuccgguggcgguggucgguccggcgucagacucgaggauuuuaacuacaauaaccagacaauaacagaucagauuuaccgggcuaugaacagcuccagcuuugagggaguaucagggcacgucguuuuugacgcgucagguagccgcauggcuuggacccugaucgaacaguuacaaggaggcucuuauaagaaaaucgguuacuaugauagcaccaaagaugacuugucaugguccaagacagacaaguggauaggaggcucaccaccugcugaccagacucucgugaucaaaacauuuagauucuuaucccaaaaauuguuuauaucugugucggucuuguccucccugggcauugugcuugccguggugugucuuagcuuuaauaucuacaacagccacguacguuauauccaaaauucccagcccaaccucaauaaucuaaccgcaguagguugcagucuggcacucgccgcagucuuuccccugggucuggacggcuaucauauuggaagaaaucaguuccccuuugugugucaagcccgucuguggcuuuugggccuugguuuuucucuggguuacgguuccauguucacaaagauauggugggugcauacgguguuuacuaaaaaggaagagaagaaagaauggcguaagacccuggagccuuggaagcucuacgcaacagucggucuguuggucggcauggacgugcuuacucucgcuauauggcaaauaguugacccucugcacaggaccaucgaaaccuuugcaaaagaagagcccaaagaagauaucgauguguccauccuuccucaguuggaacacugcaguucucgcaaaaugaacacuuggcucggcaucuuuuaugguuacaagggucuauuacugcuuuuaggaauuuuccuggcuuaugaaacuaaaucaguuagcacagaaaaaauuaacgaccauagagcagucggcauggcaauuuacaaugucgcaguucuuugucugauuacggcucccgucacuaugauucugucgucucagcaggaugcagcguucgcuuucgccagccuggcuaucguguuuaguuccuacaucacguuggucguuuuguucgugccuaagaugagacguuugauuacccggggcgaguggcaaucagaagcacaagacacaaugaaaaccggaaguuccacgaacaacaaugaagaagagaagagucgacugcuggaaaaagaaaauagagaguuggaaaagaucaucgcugaaaaggaggaaaggguguccgagcugcggcaucaguuacaaagccgccaacagcuaagaucuagacgccauccaccuaccccuccugaaccuagcggcggauuacccagaggaccaccagagcccccugauagacugucuugcgaugggaguagagugcauuuacuguacaaauag

SEQ ID NO: 14681 - RNA, 921 nt, Artificial Sequence
  Description of Artificial Sequence: Synthetic coding sequence
agacgaacuugugcuggaccuggcagagcaggaggagcacgaucagccuccuggaugucaagacucagggcccugcuuggacucggccuuuuaguagccgggagccgggugccacgaaucaagucgcagacuaucgcuugucgcucuggaccaacuuggugggggccccagcguuugaacuccggcggucgaugggauucggagguaauggccagcacaguggugaaauaucuaucacaagaagaagcacaggcugucgaccaggaacuguucaaugaguaucaauuuucagucgaucagcucauggaacucgccggccucucgugugccaccgccaucgcaaaggccuauccaccgacuaguaugucucgcuccccaccuacgguucuggucauauguggcccuggaaauaauggcggcgacgggcucgugugcgccagacaucugaaauuauucgguuaugaacccaccauauauuaucccaaacgaccuaacaaacccuuguucaccgccuuaguaacucagugccagaagauggauauuccguuucuuggugaaaugccagcagagccuaugacuaucgacgaacuguacgagcuuguaguggaugcuaucuucggcuucagcuucaaaggagauguccgcgaacccuuccauucgauccuaucuguucucaagggccugacugucccaauagcgaguaucgacauaccuucuggcugggacgucgagaagggaaaugccggaggaauacagccugaucuguugaucucgcuuacggcucccaaaaaguccgccacccaauucaccggacgcuaccauuaccuaggggggagauucguaccaccugcccucgaaaagaaguaccaauuaaaccugccgccuuauccggacaccgaguguguguacagacuccaguag

SEQ ID NO: 14682 - RNA, 1137 nt, Artificial Sequence
  Description of Artificial Sequence: Synthetic coding sequence
uaguacagcggugacuacauggagcccgagaaaccgggagcgccucuguugccacccccaccucagaauucaguuccgcacuacgccgaagccgacaucgucacacuccaaggcgugacuggcggaaacaccuacgcugucccugccuugccacccggggccgugggcgauggacccccccgcguggacuucccccgauccagguugcgauuuaaggaaaagcuuggcgagggacaauuuggagaagugcacuugugcgaaguugauagcccucaggaucuagugagucucgacuuuccauugaacguacgcaaaggacauccgcucuuagucgcugugaagauucugcgcccggacgcaaccaaaaacgcaucuuuuagucuuuuuucucgcaacgauuuccucaaggaagugaagaucaugagccgacuuaaggaccccaauauaauccgccucuuaggaguguguguccaagaugacccgcuuuguaugaucacagacuacauggaaaacggagaccugaaucaguuccuguccgcgcaucagcucgaggacaaagcugccgagggggcuccaggggauggccaggcggcucaggggccgacgaucucguauccaauguuacuucacguggccgcccagaucgcaagcgggaugagauaccuugcuacccugaauuuuguacacagagaccuggcuacccgcaacuguuugguuggcgagaauuucacgaucaagauugcugacuucggcaugucaagaaaccuauaugcaggcgacuauuaucgcguacaaggcagagcagugcugccuauacgguggauggcaugggaaugcauccugauggggaaauucacuacugcuucagaugugugggcuuuugguguuacccuuugggaaguccugauguuauguagagcacagcccuucggacaacucaccgaugagcaaguaauugagaaugcaggggaguucuuuagagaccagggaagacaagucuaccucucuaggccaccagcgugcccccagggacuguacgagcugaugcuucguugcuggaguagagaaucugagcaaagaccacccuucucacaacugcaccguuuccuagcagaggaugcccucaacaccguguag

SEQ ID NO: 14683 - RNA, 762 nt, Artificial Sequence
  Description of Artificial Sequence: Synthetic coding sequence
auggcuccuuggucccacccaucagcucaacuccagcccgucggcggugacgcugucucucccgcccucaugguucuuuugugucucggcaaucucagcaaggcaacccugugggcagagcccgguucaguuaucagcaggggaaauagcguaacuauaagaugucagggcaccuuagaggcgcaagaguacaggcuggucaaggaaggaagucccgagcccugggacacucagaacccucucgagcccaagaauaaggcgagauuuagcaucccauccaugacugaacaucaugccggaagguaccgguguuacuacuacagccccgcuggcugguccgagcccagugacccacuugaacuggucguuaccgguuucuacaauaaaccuacccuaucugcccugccgagucccgugguuacaagcggcgaaaauguaacucugcaaugugggagccguuuacgauuugaccgauuuauucuaaccgaggaaggcgaucauaaacugucauggacacucgacucacagcuuacaccauccggucaguuccaggcacuuuucccuguaggcccagucacaccgagccaucgcuggauguugcggugcuauggaagccgcagacacaucuuacaaguauggagcgaacccuccgaucuuuuagaaauuccaguaagcggagaagaagcuaccgucuuuucaucuacaauacagggcucucagaccggauguggcgagcucuaucgccagggaagcccaugcuag

SEQ ID NO: 14684 - RNA, 288 nt, Artificial Sequence; identical to SEQ ID NO: 13045
  Description of Artificial Sequence: Synthetic coding sequence

SEQ ID NO: 14685 - RNA, 1311 nt, Artificial Sequence
  Description of Artificial Sequence: Synthetic coding sequence
augaaguuccagggcccuuuagcuugucuccuccuagcacuuugccuggggaguggggaggccgggccccuccaguccggcgaggagagcacuggcacaaacauuggcgaagccuugggccaugguuuaggcgaugcuuugagugagggagugggcaaggcaauuggcaaggaagcugggggggccgccggaucuaaagugagcgaagcacugggccaagguacccgagaagcaguuggaacaggugugcgccaaguucccggguuugggguugcagacgcuuuagguaacagaguaggcgaagcugcacaugcccucgguaauacgggccacgagaucggccggcaggcagaagacgucauuagacauggggcagacgcugugagaggaaguuggcagggugugccaggacacaauggagcgugggaaacgucaggcggccacggcauuuucggaucacaaggaggccucgguggacagggucagggcaacccaggaggccuaggcacgccgugggugcauggcuaccccggaaacuccgcagguucuuuugguaugaauccacaaggugccccuuggggucagggggggaacggcggcccgccaaacuucggcacaaacacccagggugcaguagcucagccuggauacggcuccgugcgggcaucuaaucagaaugaaggcugcacaaauccucccccgucugguucagguggcggaucaagcaauucaggaggcggaucaggcucccagucggguaguagugggucgggcaguaauggggauaauaauaacggcucuagcuccggggguucuaguuccggaucaagcucaggagguaguucaggagguucauccggggggucuagcgguaauagcggcggcuccaggggcgauucuggaagcgaguccaguugggggucuagcaccggaucaucuaguggcaaucauggaggcucugguggggggaauggacacaaaccuggaugcgaaaagccaggaaaugaagcaagggguucuggagaaaguggaauacaggguuuuagagggcagggagugucguccaauaugagggaaauuuccaaggaggguaaucgucugcugggcggcaguggcgauaacuacagaggacaggguuccucuugggggaguggaggaggagaugcagugggcggcgucaacaccgugaauucagagaccagccccgggauguuuaauuuugacaccuucuggaaaaacuuuaagucaaaacuuggauuuaucaauugggaugcuauuaacaaagaucagcgaucaucuagaauuccuuag

SEQ ID NO: 14686 - RNA, 240 nt, Artificial Sequence; identical to SEQ ID NO: 13047
  Description of Artificial Sequence: Synthetic coding sequence

SEQ ID NO: 14687 - RNA, 2130 nt, Artificial Sequence
  Description of Artificial Sequence: Synthetic coding sequence
auggggugccugugggggcuggcucugccauuauucuuuuucugcugggaggucggcguauccggcucuagcgcaggaccuuccaccagacgagccgauacagcuaugacuacagacgacacagaagucccugcaaugacacucgcacccggccaugccgcucuagagacgcagacacuuucugccgagacaucuucucgugcuagcaccccagccgguccgaucccugaagcugagacaagaggagcaaaaagaauuucgccugcacgugaaaccaggagcuuuacgaaaacuucccccaauuucauggugcucauugccaccagcguggaaacaucagccgcuagcggcucuccugaaggcgccgggaugaccacaguccagacgauuaccgggagugauccccgagaggcaauauucgauacccuuugcaccgacgacagcucagaggaggccaaaacccuaacgauggauauucugacccuggcucacacuucuaccgaggcuaaaggccugucuuccgaaagcuccgcaucgagcgauaguccacaccccguuauuacaccuucuagggccagcgaaucaucugcuaguucugauggcccccauccagucauuaccccaucgcgcgcaucagaaucuagugccuccucagacgguccacacccagugauuacccccucuagagcgagcgagaguucagccaguuccgauggaccccacccagugaucaccccuagccgagccagcgaaagcuccgccaguucagaugguccacauccaguaauuacaccuucccgggcauccgaaucaagcgcgucuuccgacggcccccauccaguuauuacuccuaguagagcgagcgaguccagcgcgucgagcgacggcccucaccccgugaucacaccaagccgagcuucugagucaagcgcguccagcgacggcccccacccugucauuacaccaucccgugcaagcgaauccagugcaucuagcgauggaccucacccugugauuacaccgagucgugccagcgagagcucugcuuccucugauggccugcaucccguuauuacuccuucucgcgccucagagagcucagccagcagcgaugguccccauccugugauuacaccuucuagagccagcgaaucuagugcaucauccgauggcccacacccuguuauuaccccgagcuggucaccuggguccgacgugacauuguuggccgaggcacuggugaccguuacaaacauugaagucaucaauuguuccauuacugagaucgaaacgacuacuuccagcauaccuggugcgucagacaccgaccugauaccuaccgaaggaguaaaagcgaguuccacaucugacccuccugcccugccagauuccacagaagccaagccacacaucacagaggugaccgcuuccgccgagaccuuguccaccgccggaaccacagagucugccgcccccgaugcuaccguuggcacaccguuaccaacaaacuccgcaaccgagagagaagucaccgcgccuggagcuacaacucugagcggggcacuggucaccgucucgcgcaacccuuuagaagagaccucugcucuuuccguagagacacccaguuaugucaagguuuccggagccgccccugugagcaucgaagcggguagugcagucgggaaaaccacauccuuugccgggucguccgcuuccagcuacaguccaagugaggccgcgcugaagaacuuuaccccauccgaaacacccaccauggauaucgccacaaagggccccuuucccacaucccgggacccucugccaucugugcccccaaccacaaccaacucgucuagggguaccaacucaacacucgccaagaucaccacaagcgccaagaccacuaugaaaccaccuacagcuacucccacuacagccagaacuagacccaccaccgauguuagugcaggcgagaacgggggcuuuuuacuucuccgauugagugucgccucuccugaggaucugaccgacccaaggguggcugaacgacugaugcagcaauuacauagagaacuccacgcccacgcuccacacuuccaggugucuuuauuacguguucgcagaggcuag

SEQ ID NO: 14688 - RNA, 2067 nt, Artificial Sequence
  Description of Artificial Sequence: Synthetic coding sequence
auguugccaacugaaguaccccagagccacccugguccauccgcccuccuguuguugcaguugcugcuucccccuaccagugccuucuuccccaacauuuggucacugcuugcugcuccaggaucaaucacucaucaggauuugaccgaggaagccgcccucaacguaacacugcaacucuuucuggaacagcccccccccggccggccaccuuuacgguuagaggacuuuuuaggacggacucucuuagccgaugaucuguucgccgcguacuucggucccggaucuagucgucguuuccgggcugcccuaggugaagucagucgcgccaacgcagcacaggacuuucuucccacuagccguaacgacccugauuugcauuuugacgcugaacgccucggacaggggcgcgcaagacucgugggcgcacuucgagagacagucguggcagcacgagcacuggaucacacucucgcccgccaacgccugggagccgcucuccaugcacugcaggacuucuacucucacagcaacuggguagaacucggcgagcaacagccacacccucaccuguuauggccuagacaagaacuccagaaucuggcacagguggcugacccuaccugcucugacugugaggaguugucauguccccgaaauuggcucggauucaccuugcuuaccaguggcuacuucggcacccauccaccaaagccacccggcaaaugcucucacggcggccacuuugaucgaucuuccagucaacccccuaggggcgguaucaacaaagauucuacuucaccgggguucucuccacaccacaugcugcaccuccaggccgccaaauuagcacuauuagcuaguauccaggcuuucucucugcucagaucuagauugggcgaucgcgauuucucccgacuccucgacaucacaccagcuucuaguuuaucauucgugcuagacaccacgggcuccaugggugaagaaauuaacgcagcuaagauccaggcaagacauuugguggagcagagacgcggcucgccaauggaaccagugcacuacguacuuguaccuuuucacgacccuggcuucggaccgguuuuuaccacuucugauccugacuccuuuuggcaacagcucaacgagauccacgcgcugggcggcggagaugagccagagaugugucuuagugcucugcagcuggcauuacugcacacaccaccucuuucagacauauucgucuucaccgaugccucuccaaaagacgccuucuugaccaaccaggucgaaucccugacccaggaacguagaugcagagucaccuuuuugguaacggaagauaccucccguguucaggggagagccaggagggaaauacugaguccacuaagguuugagcccuacaaagccgucgcacuugcuuccggcggugaagugauauuuacuaaagaccagcauauccgcgacgucgcagcaaucgugggagaguccauggcagccuuaguuacauugccucucgacccacccguagucguuccaggccagccuuuaguuuuuucuguggacgggcugcugcagaagauaacagugagaauacauggcgauauuucaucuuucuggaucaaaaauccugcgggugucagccaaggacaagaggaggguggaggcccguuaggccacaccagaagguuuggacaguuuuggauggugacgauggaugauccuccacagacugggacuugggaaauucaggucacugccgaggacacuccuggugugcggguucaggcccagacaucccucgacuuccuuuuccauuucgggauccccauggaggacgguccucacccugguuuauacccucucacucagccugucgcaggucugcagacucaguuguugguugaaucccagucuuggggcagcagcgcggccuuucuacccagacacccaucccgcggcccaagaggaugcaggacacguccaggagcacucggagcucguggcacaucuggagcucggucgccccggucucuggcuguggcucacgccgccguacaucccuag

SEQ ID NO: 14689 - RNA, 1257 nt, Artificial Sequence
  Description of Artificial Sequence: Synthetic coding sequence
aauaaccuuaaugucgggucugacacuaccagugaaacaagcuuuucucuaagcaaagaggccccucgugaacaccuggaccaccaagccgcucaccaacccuuuccgcgcccaagauuuaggcaggagaccggacauccaucacuccaacgagacuuuccccgcuccuuuuugcucgaucuuccaaauuuuccagaccucuccaaagcugacaucaacggccagaaccccaauauucagguuacaaucgagguggucgaugggccagacagcgaggcugauaaagaucagcacccagagaauaaaccaucguggagcgugccuuccccagacuggagagcaugguggcagcgauccuugucucuggcuagggcgaacaguggagaucaagauuacaaauaugauucuacuucugacgauuccaacuuccuuaacccuccccgcggcugggaccauacugcgccgggacaucguaccuucgaaaccaaagaccaaccugaguaugacuccacagauggcgaaggagacuggucgcuuuggagcgucugcaguguaacaugugggaacgguaaucagaaacgcacacgauccuguggguaugccugcaccgcuacugagucucgcaccugugauaggcccaauugcccaggaauugaggauacuuuccgaacagccgcuaccgaaguaaguuuacucgcugguagcgaagaauucaaugccaccaaacuguuugaagucgauacugauucuugcgagagauggaugagcugcaaauccgaguuccugaagaaguauaugcacaaaguuaugaaugaccucccuagcugucccugcucauauccuaccgaaguagccuauucuacagccgacauauucgaccggaucaagagaaaagauuucagauggaaagacgccagcggcccaaaggaaaaacuggagaucuauaagccuacugcccguuauugcaucagaucaaugcugucacuugaaaguacaaccuuggccgcccaacacugcuguuauggggauaauaugcagcugaucacuagagggaaaggggccggaacaccaaaucugauaagcaccgaguuuucagcagaguugcacuauaagguagauguguuaccuuggauaaucugcaagggggauugguccagguauaacgaagcacgccccccaaacaauggccagaaaugcaccgagagcccauccgaugaagacuauaucaagcaguuccaagaagcacgugaauauuag

SEQ ID NO: 14690 - RNA, 693 nt, Artificial Sequence
  Description of Artificial Sequence: Synthetic coding sequence
augcgccucgccggcccuuugaggauuguggugcuggucguaagugugggagucacauggauugucgucucuauucuguuaggagggcccggcucuggcuucccaagaauacagcaauuguucacaucccccgagucuagcgugaccgccgccccccgggcccggaaauauaaaugcggcuuaccacagccuugucccgaagagcaccucgcuuuuagaguugugagcggcgcugcaaacguaaucggccccaagaucugccuugaagauaaaaugcucaugaguucagucaaggacaaugucgggagaggguuaaauauugccuuggucaacggagugagcggcgagcugaucgaggccagggcauucgacaugugggcuggugaugugaaugaccuauuaaaauuuauuaggccauugcacgaagguacuuugguuuucgucgcuucguaugacgaccccgcaacuaaaaugaaugaggaaaccaggaaauuguucucggaguugggaagccgcaacgcuaaagaacuugccuuccgagacaguuggguauucgucggagcaaagggcguccagaauaagucuccauuugagcagcacgugaagaacagcaaacacucuaacaaguaugaaggguggccagaagcacucgaaauggaaggauguauaccacguagaucaaccgccagcuag

SEQ ID NO: 14691 - RNA, 192 nt, Artificial Sequence; identical to SEQ ID NO: 13052
  Description of Artificial Sequence: Synthetic coding sequence

SEQ ID NO: 14692 - RNA, 1014 nt, Artificial Sequence
  Description of Artificial Sequence: Synthetic coding sequence
augcugagccucggcgcucauuccguaacgaagacccaaauucuucagggucucggcuuuaaccucacccacacccccgaguccgcaauucaccaaggcuuccaacaucuaguucacucucuuaccgugcccucuaaggaucuaacccuaaaaaugggcucagcccuauuuguuaagaaagaacuccaguugcaggcuaacuuccuggggaacgugaagcgccuauacgaagcagaggucuuuucuaccgacuuuuccaacccgucuaucgcccaggcccgaauuaauagucaugugaagaaaaaaacucagggaaaaguggucgauauuauucagggccuggaccugcugaccgcuaugguacuuguuaaucauaucuucuuuaaggcaaagugggagaaaccuuuccaucccgaauacacacgaaagaacuucccauuucuggugggcgaacaaguuacugugcacgugccaaugaugcaucagaaagagcaguucgccuuugggguugauacagaauugaauuguuuugucuuacaaauggauuacaagggcgacgccguggccuucuuuguccucccuucgaaaggaaaaaugcgccagcuggagcaggcccugagcgcccguacacugcgaaaauggucccauucauuacaaaaacgcuggauugaaguauucauuccacgauucaguauuucagcuucuuacaaccuugagacaauucuuccaaaaauggggauccagaacguuuucgacaaaaaugcagauuucuccgggaucgcaaaacgggacucccugcagguuucaaaggcuacucauaaagcagugcucgaugugagugaggaagggaccgaggcaaccgccgcuacgacuacuaaguuuauuguuagaagcaaggacgguccuucauauuucacaguuuccuuuaauagaacuuuccucaugaugauuacaaauaaagccaccgacgggauauuguuucugggcaaggucgaaaauccaaccaagagcuag

SEQ ID NO: 14693 - RNA, 336 nt, Artificial Sequence
  Description of Artificial Sequence: Synthetic coding sequence
auguuuuuuaccauuucucgaaagaacaugucccagaaguugucucugcugcuuuuaguguuuggccugaucuggggucuaaugcuacuccacuauacuuuccaacaaccaagacaucagagcucaguuaagcucagggagcagauuuuggauuuaucuaagagguacgucaaagcacucgcugaggagaacaaaaacacagucgaugucgaaaauggcgccucgauggcaggcuacgccgaucuaaagcggacaaucgcuguucuucucgaugacauucuccaaagacugguuaaacuggaaaauaagguagauuauauugugguaaacggauag

SEQ ID NO: 14694 - RNA, 498 nt, Artificial Sequence
  Description of Artificial Sequence: Synthetic coding sequence
auggaaauguuucaaggccuguuacugcugcuguuacuaucgaugggugguacuugggcaucaaaagagccccugcgcccuagaugccguccaauuaacgcuacucuggccgucgaaaaagagggcuguccuguauguaucaccgugaauaccacaaucugcgccggauacugucccaccaugacgcgaguccugcagggcguuuuaccugcuuuaccacaaguggugugcaacuaucgagauguacgguuugaaagcauaagacuccccggaugcccaagaggcguuaauccuguuguaucuuaugcaguggcuuuaaguugccagugugcucuuugucgccgauccacaacugacugcggcggaccaaaagaucauccucucaccugcgaugacccacgguuccaggacaguuccucaucuaaagccccucccccaaguuuacccucgccaagccgacucccaggcccauccgacacgccgauccuuccccaguag

SEQ ID NO: 14695 - RNA, 699 nt, Artificial Sequence
  Description of Artificial Sequence: Synthetic coding sequence
auggugcuccugcuuguaauucucauaccugugcugguaucuucugcuggcacuagcgcccacuacgaaauguugggcacaugcagaaugguuugcgacccauauggcggcaccaaggcaccuucuacagccgcgaccccugaucgaggucugaugcaaucccucccaacauuuauucagggaccuccgaugggcccaccuggagaaaagggcgagccaggaaggcagggacucccaggcccccccggugcaccgggccuuaacgccgccggcgccaucuccgccgccacauacaguacagucccuaagaucgcuuuuuacgcuggacugaaacggcagcaugagggauaugaagugcucaaauucgacgauguugucaccaaccuuggcaaccacuacgaucccacaaccggaaaguucacauguaguauacccgggauauauuuuuuuacauaccacguuuuaaugagaggaggugaugguacgaguaugugggcugaucuguguaaaaauaaucaaguuagagcgagcgccauagcacaggacgcggaccaaaacuacgauuaugcgagcaacagcguagucuugcaccuggagcccggcgacgagguuuauaucaaauuagauggcggcaaagcccacggcggcaacaauaacaaauacagcacuuuuuccggcuucauuaucuacgcagauuag

SEQ ID NO: 14696 - RNA, 501 nt, Artificial Sequence
  Description of Artificial Sequence: Synthetic coding sequence
augggcccugaggcacuuucuagccuucuguuguugcuccucgucgccagcggcgaugcugacaugaaaggacauuucgacccugcuaaaugucgauaugcgcucggaaugcaggacaggacuauucccgacagcgacaucagugccucguccaguuggagugauuccaccgcugccagacacuccagacucgagaguagcgacggcgauggggccugguguccugcuggcuccguguuuccuaaagaagaagaguaucugcaaguagaccugcaacggcugcaccugguggcucuuguugggacucaagggagacacgcugguggguuaggcaaggaauuuagcagguccuacaggcuaagguauagcagggacggucggagauggaugggauggaaggacagguggggccaagaagucaucagugguaaugaagaucccgaaggcguuguguugaaggaucugggacccccuaugguggcuagauuggugagguucuag

SEQ ID NO: 14697 - RNA, 627 nt, Artificial Sequence
  Description of Artificial Sequence: Synthetic coding sequence
augauaauuaaacacuuuuucggaacagugcugguucuccucgcauccaccaccaucuucagccucgaccugaagcucaucaucuuucaacaacgccagguaaaccaagaaucccuuaaguuguuaaauaagcugcaaacucugucuauucagcaauguuugccucaucgcaaaaacuuccuguugccacagaagucacucucgccucaacaguaccagaaaggacacacacuugccauccuccacgaaaugcuccagcagauuuuuucgcuauuccgggcaaauauaucucuagacgguugggaggagaaucauacagaaaaguuccugauacaacuccaucagcaacuggaauacuuggaagcccugaugggccuggaagccgagaagcugagugguacgcuuggaucagacaaccuucgccugcaagugaaaauguauuucagacggauacaugacuaucucgagaaucaggauuacuccacaugcgcaugggcuauuguacaaguagagauuucuagaugucuauucuucguguucagcuugacugaaaaacuuucuaaacaaggcagaccguuaaacgauaugaagcaggagcuaacaacugaguuucgaucaccccgcuag

SEQ ID NO: 14698 - RNA, 2241 nt, Artificial Sequence
  Description of Artificial Sequence: Synthetic coding sequence
augcccuucagacacaagccugggagugucuucagcguugagggggagaacuuggaucucgcaaugucaaaggaggaggucguugcaaugaucggcgaugggccaugugugguaaagacccugacccggcaccaccuguacugugagcccccaguugaacaaccccucccgaggcaucaugcauuacgagaggcacccgacuccuuacccgaguuuacagugcagauggguaaccugcguuucagucuaggacaugugcaauacgacggggagucccccggagcuuucccgguggccgcucaagucgggcugggcgugggcacaucuuuacuggcccucgggguaaucaucaucgugcugauguacagacggaaaucaaagcaggccuugcgagacuauaagaagguccagauacaacuggagaaucucgagucgagugugcgcgacagguguaagaaggaguuuacagaccuuaugaccgaaaugaccgaccucacgucugaucugcuagguucugguauccccuuucuggauuacaaaguauaugcugaaaggaucuuuuucccagggcauagagaaucuccucuccauagggauuugggcguacccgagucgcgcagaccuaccgucgaacaggggcugggccagcucucaaaccugcuaaacucgaagcucuuucugacaaaauucauucauacacuggagagccaacggacauucagcgccagagaucgagcuuacguggccucucugcugacuguggcauugcauggcaaacucgaauauuucacugacaucuuacgaacccugcucuccgauuuaguggcucaguauguugccaaaaaccccaaacucaugcugcgaagaacugagacaguuguggagaagcugcuuacuaauuggauguccauuugccuguauaccuucgugcgagacuccgugggggagccccuuuauaugcuguuccgaggcauuaaacaccagguggauaaaggacccguugacagcgugaccggaaaagcaaaauauacacuuaaugauaaccgacuguugcgagaggauguggaauauagaccacucacucugaaugcucuguuagcugugggucccggggccggagaagcccagggcgugccagugaaggucuuagauugcgauacaauuucccaggccaaggagaagaugcuggaucaacuuuacaaaggagucccacugacgcaacgcccugacccccggacccuugacguugaauggagaagcggugucgcagggcacuugauccugucugacgaggauguaacuagcgaagugcaggggcuguggcggcgacuaaauaccuuacaacauuacaaagucccagauggcgcaaccguggccuuggugccgugucuaaccaagcacguucuaagggaaaaucaggauuacguuccuggagagcggacucccauguuagaagacguggacgagggugguauuaggcccuggcauuuagugaaaccaucugacgaacccgagccaccuagaccccgccggggcaguuuacgcggaggggaaagagaacgcgccaaggcgauucccgagaucuaucucaccagguuauuguccaugaagggcacuuugcagaaguucguagaugaccuauuccaagucauccugucuacaucuagacccguuccacuggcuguuaaguacuuuuucgaucuucuggacgagcaggcccagcaacacggaauuucugaucaagacacaauucacauauggaagaccaacucacugccauugagauucuggauuaauauuaucaaaaauccacaguucguguucgacgugcagaccucugauaauauggacgccguuuuacucguuaucgcacaaacuuuuauggacgcauguacccuggcagaucacaaacucggacgagacucacccaucaauaagcuccuauaugcuagggacauuccucgcuacaagagaaugguggagagauacuaugcagauauucgccaaacaguuccugccagugaucaggaaaugaauucaguguuggccgaacucagcuggaacuauuccggggaucuuggcgcgcgaguggcccuucaugagcuguauaaauacauuaacaaauacuaugaccagauaaucacagcccuggaggaagacggaacggcacagaaaaugcaguuaggcuaucgguuacaacaaaucgccgcugcuguggagaacaaggugacagacuuauag

SEQ ID NO: 14699 - RNA, 603 nt, Artificial Sequence
  Description of Artificial Sequence: Synthetic coding sequence
auggcuuggggcggcguucauaccuguugcuuccaccuguguugcugcugcucguggccucagggggccguuccagaagagcugcacaaacacccugggcaaacacuucugcuucaaugucaauacagcccaaagagaggaccuuaucaaccgaaaucauggugccaacagacaucaccuucucgcuguacucuccuggugaccaguuccaagcccuggaccgcugugcagaaaucucacuacacaaucugggauaagcccaacgccggauucuuuaacaucacuaugauacaacugacucagaacgauucagguuuuuauuggugcggcauuuacaacgcuucugagaauaucauaacagugcuucgcaacaucucccucgugguuaguccugcucccacgaccucucccauguggacccugccuuggcuuccaacauccacagugcugauuacuagcccagagggcacaaguggacauccuaguaucaauggcagugagacaagaaaaagucgcgcucccgccugucugggcagcgguggccccagguuccucguccuggugcuuuguggcuugcuucucgccaaaggucuaaugcuauag

SEQ ID NO: 14700 - RNA, 114 nt, Artificial Sequence; identical to SEQ ID NO: 13061
  Description of Artificial Sequence: Synthetic coding sequence

SEQ ID NO: 14701 - RNA, 525 nt, Artificial Sequence
  Description of Artificial Sequence: Synthetic coding sequence
augagacuccucgcguuucugucucuccuugcccuggugcuccaggaaaccgggacugcgagccuuccgagaaaagaacgaaagagaagagaagaacagaugccaagagagggagacucguuugaagugcugccuuuacggaaugacguccugaacccugacaauuauggugaaguaauugaccuuuccaauuaugaggagcucacagacuauggcgaccaauugcccgaggugaagguaaccucccuggcaccggccaccagcaucucgccugcuaaaucgaccacagcuccuggaacucccucaagcaacccuaccaugacccgccccacgacugcaggccuguuacugagcucucaaccuaaccacgaggauauuccgccacugccaaggcgcaccgcauaccuguacgccagauuuaacagaauuucuaggauccgcgccgaagauuuuaaaggccuuacaaagcugaaaagaauugacuuguccaacaaccucaucuccucaauugauaacgacgccuag

SEQ ID NO: 14702 - RNA, 657 nt, Artificial Sequence
  Description of Artificial Sequence: Synthetic coding sequence
auggggcgcguguuuuuaaccggcgaaaaagcaaacaguauccugaagcgguauccacgagccaacgguuuuuucgaagagauucggcagggcaacauugagagagagugcaaggaggaguuuuguacauucgaagaggcuagggaggcuuucgagaacaacgagaaaacuaaggaauucuggucaacguauacuaaagcucaacagggcgaauccaauagagguagcgacugguuucaguuuuauuuaacauuuccacucauuuuuggacucuucauuauccuguuagugauuuuccugauauggcgcugcuuuuuacgcaauaaaacacggcggcaaacagugacggaaggucacauuccuuuuccccagcaucucaacaucaucacuccccccccaccgcccgaugagguuuuugauagcucuggguugucucccggauuccugggcuaugugguuggucgauccgauucagucaguacacgacuaagcaauugcgacccccccccaacuuaugaggaggcuacaggccaggugaaccuccagcgcagugaaacagaaccccacuuagaucccccuccagaguaugaagacauaguuaacucuaacucagcauccgcuauacccaugguuccugucgugacaacaauuaaguag

SEQ ID NO: 14703 - RNA, 2535 nt, Artificial Sequence
  Description of Artificial Sequence: Synthetic coding sequence
augggacccggcgccccauucgcacgcguuggauggccccucccacuucugguggucauggcugcuggaguggcucccguuugggccucucacuccccccaccuaccucgcccacauucuaggguccccccccauccuucgagcgaaagaagggcugucuacauaggcgcucuguucccaaugucuggcggcuggccuggcgggcaggcuugccaaccugcagucgaaauggcucucgaggaugucaacucccggcgcgauauccucccagauuaugaacuuaaacugauacaucaugauucuaagugugaccccggccaagccacuaaguaucuuuaugaacuacuuuacaaugacccuaucaagaucauccugaugcccggauguaguuccgucagcacacuugucgccgaagcugcacgcauguggaaccuuauaguacucagcuacgguuccucuuccccugcccucuccaaucgacaacgguuuccaacuuucuuucgaacucaccccuccgccacccugcacaacccaaccagagucaaguuguucgaaaagugggguuggaagaaaauagccaccauucagcaaacuaccgaaguauucacaagcaccuuagaugaucuggaggaacgggugaaggaggccggaauagagaucacauucagacaaagcuuuuuuagcgacccggccgugcccgugaaaaaccugaaaagacaagacgccagaauuauaguuggacuuuucuaugagacugaggcucgcaaagucuucugugaaguguauaaagagagacucuucggcaaaaaguacgugugguuccugauaggcugguaugccgauaacugguucaaaaucuacgaucccuccaucaacugcaccgucgacgaaaugaccgaggcugucgagggacacauuaccacugagauagugaugcugaaccccgccaacacucgaagcauuaguaauaugacaucacaggaguuuguggaaaaacuaacuaaacgacuaaagagacaccccgaagagacaggcggcuuucaagaagccccccuggcauaugacgcuaucugggcucuggcauuggccuugaacaagaccuccgggggcgguggccggagcggcgugcggcuagaagacuuuaacuacaacaaucaaaccaucaccgaccagauuuacagagcaaugaacucaucaagcuucgagggagugagcggucauguuguuuuugacgcuagugguucccggauggccuggaccuugauugaacagcuccagggcggaucauacaaaaagaucggguauuacgauuccacuaaagacgaccucaguugguccaagacggacaaauggaucggaggauccccacccgcggaucagacacuuguuauaaaaaccuucagauuucucucccaaaagcucuucaucagcgugagugugcugucaucccucggcauuguccucgccgucguuugccugucuuuuaauauuuauaacucccauguucgcuacauccaaaauucacaaccaaaucuuaauaaucuaacugcagucggcugcucccuggcucucgcugcuguguuuccacugggacuggaugguuaccacauuggacggaaucaguucccauucgugugucaggcucgccuaugguuacuggggcucggcuuuagccugggcuacgggucuauguucacaaaaaucugguggguucauacaguuuucacuaaaaaggaggagaaaaaagaauggcguaaaacacuagaacccuggaaacucuacgcuacggucggccuacucgugggcauggacguucugacacuggcuauauggcagauugucgacccccuccaccgcacaauugaaacauuugccaaagaggaaccaaaagaggauauagacgucuccauucuuccccaguuagaacacugcucuaguagaaaaaugaauacauggcuagguauuuucuacggauacaagggacuuuuacugcucuuagguauuuuccuggccuaugaaacuaaaucuguuucaacggagaagauaaaugaucaucgcgcagugggcauggcgaucuacaacguggcugucuugugccugauaacagcccccguuacaaugauccucagcagccaacaagacgccgcauucgcauucgcuucccuggccauuguuuucucuuccuauauuacacucgugguguuguuuguccccaagaugcggcgcuuaauuacccgcggcgaguggcagagugaggcucaggacaccaugaagacaggcucgaguacuaacaacaacgaggaagagaagucgcgauuacucgaaaaagaaaacagagaacuggagaaaauuauugccgaaaaggaggaaagaguuuccgaacugagacaccaguugcagagcagacagcaguugagaaguagacggcaccccccaacuccuccagaaccuaguggagggcugccuagaggcccacccgaaccacccgauagauugucuugcgauggaagucgugugcaucuuuuguacaaguag

SEQ ID NO: 14704 - RNA, 2007 nt, Artificial Sequence
  Description of Artificial Sequence: Synthetic coding sequence
auggaucucguauugaaacgcugcuugcugcacuuggccguaauuggugccuuacuugcagucggagcuacuaaaguaccgcggaaucaggauuggcuugggguuucuagacagcuccgaacaaaggccuggaaucggcaguuguacccagaauggaccgaggcacaacgccuugacuguuggcgcggcggacaggugucgcugaaggucucuaaugacggaccgacacucauuggggcgaacgcuucguuuucuaucgcucucaauuucccgggcagccagaaaguucugccugacggccaaguaauuuggguaaacaauaccaucauuaacggaucucagguuuggggcggacaaccuguuuauccccaggaaacagaugacgcuugcaucuuuccugaugggggcccuuguccaagcggguccuggucucagaagcguuccuucgucuacguguggaagacuuggggacaguauuggcagguuuugggagguccagucagugggcugucaaucggaacuggaagagcaaugcugggaacccauacuauggaagucaccguguaucacagacgugggagucgcucuuacgugccucuggcucacucguccuccgccuucaccauuacggaccaagugcccuucagcguaagcgucucccagcuccgugcucucgaugggggaaauaaacacuuccucaggaaccagccacuuaccuuugcccuucagcugcaugaucccucuggcuauuuagccgaagccgaccugucuuacacgugggacuuuggugacucuagcgguacucucauuucaagagcucugguagugacucauacauaucuggaaccagggccugucacugcccaaguggugcugcaggccgccaucccccugacauccugcggcagcaguccaguuccuggaacaaccgauggccaucgaccuaccgcagaggccccaaauacuacugccgggcaggugccaacaacagaggucgucggaacaacucccggccaagccccaacagcugagcccucugguaccaccuccgugcaaguuccaacuacagaggugaucucuacagcucccguucaaaugccaaccgcggaaucuaccgggaugacuccagaaaagguccccgugucugaggugaugggcaccacucuggcagaaaugucuacccccgaagccacuggcaugaccccagccgaggugucuaucguggugcuguccggaacgacugcagcccaagugaccacgacagaguggguggagacuacagcucgcgaguuaccuauuccagaaccagaaggcccugacgcguccucuauuaugaguacagagagcaucacuggguccuugggaccucuguuagacggcacugcuacauuaagauuggucaaacgucaggugccccucgacuguguccuguaucgauaugguuccuucucaguaacccuggauauagugcaaggaaucgaguccgcugaaauccuccaggcggucccuucuggcgaaggcgaugccuucgagcucacuguuagcugucaaggcggccucccuaaagaggcuuguauggagauaagcucuccaggaugucagccucccgcccagagacugugccaaccuguccuccccagccccgccugucagcucguuuugcaccaaauucucaaagggggcagugggacuuauuguuugaaugugagccuugccgauaccaacaguuuggccguuguguccacccaauugauuaugcccguacccggaauccuccucaccggacaggaagcugguuugggacaagugccucuuauuguagguauccuacucgugcucauggccguagugcucgccucauuaauuuaucgcagaagacuaaugaaacaggacuuuuccgugccgcaguugccccacucaagcucccauuggcuacgcuuaccucgaauuuucugcaguuguccuaucggcgagaacuccccgcuuuuaucgggacagcaggucuag

SEQ ID NO: 14705 - RNA, 525 nt, Artificial Sequence
  Description of Artificial Sequence: Synthetic coding sequence
auggcagauaugcaaaauuugguugagaggcuggaacgcgccgugggcagacuggaagccguaucucacacaucagacaugcaccgaggcuaugcagauucccccuccaaagcaggcgccgccccauacgugcaggcuuucgauucacuauuggccgguccagucgcagaauauuuaaagauaagcaaagagaucgguggcgacgugcagaagcacgcagagaugguucauacgggucugaaacuugagagagcccugcucgugacagcuucccagugucagcagcccgcggagaacaaguugagcgaccuccucgccccaauuucugaacagauuaaggaggugauuacauucagagaaaaaaaccguggaucuaagcuguuuaaucacuugagcgcugugagcgaaucuauacaggcauuaggcuggguugcuauggcuccgaagcccggcccuuacguaaaggaaaugaaugaugcagcaauguuuuacaccaacagaguucuuaaagaauauaaggacuag

SEQ ID NO: 14706 - RNA, 1368 nt, Artificial Sequence
  Description of Artificial Sequence: Synthetic coding sequence
auguuacaccccgaaaccuccccuggacguggucaccuacuggcgguccuacucgcccugcuaggcacagcaugggccgaaguguggcccccacagcuccaggagcaagcuccaauggccggcgcguuaaaccgaaaagagucuuuuuuauugcugucccugcauaaccggcuuaggucuuggguccaaccucccgcagcagacaugaggaggcuugacuggucggauucucuagcccagcuugcucaagcucgugcagcccugugcgggacacccacaccuucccucgcuucgggccucuggcgcacccuccagguuggcuggaauaugcaguugcuacccgccggguuggugucuuuugucgaagucguuagccucugguucgcggaaggacagcgcuacucucaugcagcaggagaaugcgcccggaacgcaacgugcacccacuacacucagcugguuugggccacaucuucacagcuggggugcggacggcaccugugcucagcaggccaggcagccauugaggccuucguaugugcuuacuccccacgcgguaacugggaagugaauggaaagacaauaguccccuacaaaaaaggugccuggugcagucugugcacagcaagcguuagcggaugcuucaaagccugggaucaugccggcggccugugugaggugccacgaaauccuuguagaauguccugccagaaccacggaaggcuaaauaucuccacuugucauugccauuguccuccuggauacaccggccguuauugucaaguucguugcucacuccaguguguccacggucguuuucgggaggaagaaugcaguugugugugcgauaucggguauggaggugcacagugugcaaccaaaguccacuuuccauuccauacgugcgauuuacgaauagauggggacuguuucaugguguccucggaggcagauaccuauuacagagcuagaaugaagugccagaggaaagggggcguguuagcccagauuaaaucucagaagguccaggauaucuuagcuuuuuaccucggcagacuagaaaccacaaaugaagugaucgacucugauuucgaaacuaggaauuucuggaucggacuaacuuauaaaacugccaaagacucuuuccgaugggccacgggagaacaccaggccuuuacaagcuucgcauucggacagccggacaaucauggucuggugugguugucagcugcuauggguuuuggaaauugcguugaacuacaggccucugccgccuuuaauuggaaugaucagagauguaaaacuaggaacagauacauaugccaauuugcccaggagcacauaucuagauggggcccagggucauag

SEQ ID NO: 14707 - RNA, 297 nt, Artificial Sequence; identical to SEQ ID NO: 13068
  Description of Artificial Sequence: Synthetic coding sequence

SEQ ID NO: 14708 - RNA, 2742 nt, Artificial Sequence
  Description of Artificial Sequence: Synthetic coding sequence
auggguccagaagccuugucgucacuucugcuccugcuuuuaguggcguccggagaugccgauaugaaaggacacuuugauccugccaagugcagauaugcccugggaaugcaagacaggacaauucccgauuccgacaucucugccuccuccaguuggucagauagcacugccgcaagacacagccggcucgagaguucggauggcgacggcgcuuggugucccgccgguucagucuuuccuaaggaagaagaauaccugcaaguugaccugcagcgccugcauuugguugcacuggugggaacgcaaggacggcaugcagggggacucggaaaggaguuuucacggucauauagacuacgguauucaagggauggccgccgguggaugggguggaaagaccgguggggccaagaaguaaucuccgguaaugaggauccugagggggucguccugaaggaucucgggccacccauggucgccaggcucgucagguucuacccacgcgcagacagagugaugagcguaugccuuagaguagagcuguacggauguuuauggcgcgacggacuccugagcuauaccgccccaguggggcagacaauguaccugagcgaagccguguaucugaacgauagcacauaugauggacauacugugggcggacuacaauacgggggccuagggcaacuggcagacggaguggugggauuagacgacuuuagaaaaagccaagaacuaagagucuggccuggauaugacuacguuggguggucaaaucauagcuucagcagcggcuaugucgaaauggaguucgaauuugacaggcuacgcgcguuucaagcuaugcaaguacauugcaauaacaugcacaccuugggcgcacggcuaccugggggaguagaaugucgguuucgccgggguccugcuauggcuugggagggagagccaaugcgacauaaccugggcgggaauuuaggggacccaagagcaagagccguaagcguaccccuuggaggccggguugcucgcuuccugcaaugccgcuuccuuuucgccggaccguggcuucuguuuuccgaaaucaguuuuaucuccgauguagugaauaacucuaguccugcccuuggugguaccuucccgcccgcccccugguggccacccgguccucccccuacaaacuuuucuagcuuagaauuagagcccaggggacagcagccaguagccaaggcggagggaucccccacugcaauacucauaggaugcuugguggcaauaaucuuguugcuguuacugauuaucgcccucauguuauggaggcuccacuggcgaaggcuuuuaucuaaggcugaacguagaguacuggaagaagaacuuaccguccaccuuuccguucccggggauacaaucuugauuaacaaccggccaggacccagagagcccccccccuaccaggaaccaagaccacgagguaaccccccacauucagccccaugcguucccaauggaucagccuugcuccugucuaaucccgccuacaggcuccugcuugcaacauaugcccgaccaccacgcggcccaggaccuccuacccccgcgugggcgaagccaacuaauacgcaggccuauagcggggauuacauggaacccgaaaagccaggugcaccacuucugccuccccccccucagaacuccgugccucauuaugcugaagcagacauuguuacucuccaaggcguuacagguggcaacacguacgcagugcccgcucugccaccaggcgcaguaggagacggaccaccaaggguagauuuuccccgauccagguuaagguuuaaggagaagcugggugaaggccaauuuggcgaaguucauuugugugagguggacagcccccaggaccuuguuagucuagacuucccacugaaugugcgcaaagggcauccacuccuuguagccguuaagauacuucgcccagacgcuacgaagaacgcccggaacgacuuucugaaggaggugaagauuaugagucgacugaaggacccaaauaucauucguuugcuuggcguuugcgugcaggaugauccccucuguaugauaacugauuacauggagaacggagaccuuaaccaguucuuauccgcucaccagcuggaagacaaagcugcugagggugcaccgggggacggacaggcggcacaaggcccuacuauuucuuauccgauguuacuucauguggcggcccagaucgccuccgguaugcgauaccuggccacucugaauuucguccaccgggacuuagcuacaaggaauugccucgugggagaaaauuucacuauaaaaaucgcugacuuuggcauguccaggaacuuauacgcaggagauuacuaucguguucaaggaagagcaguucugccgauuagauggauggccugggaauguauucucauggggaaauucaccaccgccucugacgucugggcauucggagugacucuuugggaaguacuaauguuguguagagcccagccauucggccagcugaccgaugaacaagucauagagaaugcuggagaguucuuccgagaccaggggcgccagguauaucucagucgucccccagccuguccccagggucuuuacgaacuuaugcugcgguguuggagccgcgagagcgaacagagaccuccguuuucccagcuccaccguuuccucgcugaagacgcacugaacacugucuag

SEQ ID NO: 14709 - RNA, 678 nt, Artificial Sequence
  Description of Artificial Sequence: Synthetic coding sequence
uaagcugauuugccuuccuguuggggagcggggcccugcuacacuggacacaaagucggagcccugagacgugacacugugauauguuguugcaggcacggagauuacuccacgcccugucuguucaccccuggcaaacccuccagaaacccuucaccguggaaaagaacucucuggacuuuaagugccccuugggccgggccugcuggcuggaccggcgaagagcagaaugcgaccaagaccggauugauuacucggcguccgaggccuuuacgacggagaccucauccugcgcccgcaagcccacuaccugagauuaucagagguaauauccccagaaugcugggcaaauucguuccugucaacugggaaccuccucagccauugccauuccccaaguaccugcgguguuaccggugccuccucgagacaaaggaauuagguugucuguugggaucugacauaugccucacaccugccggcucuuccuguaucacccuucauaaaaaaaacucuagcggaucagacgugaugguaucagacugccgcuccaaagaacagaugucagauuguagcaauacacgcaccucaccagucucugguuuuuggauauucucucaguauuguuuucuggacuucuguaacgacccucaaaaucgcggcuuauauacaccauag

SEQ ID NO: 14710 - RNA, 405 nt, Artificial Sequence
  Description of Artificial Sequence: Synthetic coding sequence
augccacggugcagaugguuaucucuuauccuccugacaauaccacuggcucugguagcccgaaaagacccuaaaaagaaugagaccggcguucuucgcaagcugaagccaguuaaugccucaaaugccaaugugaagcaguguuugugguucgccaugcaggaauacaacaaggaaagugaagacaaguaugucuuccucgucgugaagaccuuacaggcacagcugcaaguuacaaaucuccuggaguacuugauagacguugaaaucgcccgcucagauugcagaaaaccucuuucuacgaacgaaauaugcgccauccaagagaacuccaagcugaagagaaaguugucauguagcuuccuggucggagcauugccguggaauggagaauucaccgucuag

SEQ ID NO: 14711 - RNA, 1182 nt, Artificial Sequence
  Description of Artificial Sequence: Synthetic coding sequence
augcgaacccuauucaacuugcucuggcuugcgcuggcaugcagccccguacauacaacccuuuccaaaucagaugcaaaaaaagcggccagcaaaacucuccuggaaaagucucaauucucugacaagccgguccaagaucgcggccucguggucacugaucucaaggccgaauccguugucuuggaacaccggaguuacuguagugcuaaagcgcgcgauaggcauuucgccggugauguccuuggcuauguaacuccauggaacucucacggauacgauguaacuaaagucuucggaagcaaauucacccagaucucaccaguguggcugcagcugaaaagacgagggcgagagauguuugaggucacuggacuccaugauguggaucaaggauggaugagagcugugcguaaacacgccaagggccuccauauaguuccgcggcugcuguucgaggauuggaccuacgacgauuuccggaacguucuggauucugaagaugaaauagaagaacucucaaagacuguagugcagguggccaagaaucaacacuucgacggguucgugguggagguauggaaucaacuccugucucagaaaaggguggguuuaauccauaugcuuacucaucuggcagaggcuuuacaccaagcuagacugcucgccuugcuuguuauuccacccgcaaucacucccggcacugaucaguugggcauguucacccauaaagaguuugaacaacuugcccccguucuggacggcuuuagccugaugaccuaugacuauucaaccgcucaccagcccgggccgaacgcuccccugucuugggugagagcuuguguucaggugcuggacccaaagucaaaauggcgaucaaaaauucuccugggucucaacuucuauggaauggacuaugcuacauccaaagacgcucgggaaccagucgugggagcgcgguauauucaaacauuaaaggaucaucggccuaggaugguaugggacucucaagcuuccgaacacuucuuugaauacaaaaaaucacgaagcgggaggcacguuguuuuuuacccuacccugaaguccuugcaggugaggcuagaguuggcccgugagcucggagugggcgugucaaucugggagcugggacagggacuugacuauuucuacgaucuucucuag

SEQ ID NO: 14712 - RNA, 678 nt, Artificial Sequence
  Description of Artificial Sequence: Synthetic coding sequence
uaagccgaucugcccagcuguuggggugccggaccuuguuacacaggccauaaagugggcgcauugaggagggacacggugauauguugcugccgucacggugacuauagcacaccuuguuuauucacgccuggaaagcccucaagaaauccgucucccuggaaacgaaccuuguggacguugagugcucccugggcgggaccugcaggauggaccggagaagagcagaacgcaaccaagaccggucugaucacacggaggcccagaccucuccgaagaagaccccaucccgcuccugcuaguccccuuccagaaauuauuagaggaaacauuccccgcauguuaggaaaguuugugccaguuaauugggagcccccucagccacugccguucccuaaguaucucagaugcuaccggugucuccuggagaccaaggaacugggguguuugcucggaucugauauaugccugacuccagccggcucguccuguaucacccugcauaagaaaaauagcucaggguccgacgucaugguuagcgacugucgcagcaaggagcagaugagugacugcucuaauacucgaacaaguccagugaguggcuuuuggauuuucucucaauacugcuuccucgacuucugcaaugauccacaaaaccgcggacuguauaccccauag

SEQ ID NO: 14713 - RNA, 1410 nt, Artificial Sequence
  Description of Artificial Sequence: Synthetic coding sequence
augaugagacucggggguagguugguucugaauacuaaagaagagcucgccaacgaaaggcugaugacccucaagauagcagagaugaaagaagcaaugcguacacugauuuucccaccauccaugcacuucuuccaagcaaaacauuugaucgaacguucucagguauucaacauauugcgaaugaugccuaaaggugccgcccuccaccugcaugauaucggaauugugacuauggacuggcuagucagaaacgugacauauaggccccauugucauaucugcuuuaccccacgcggcauuaugcaauuuagauucgcccauccaacaccuaggccaagcgaaaagugcagcaaauggauccuccuugaagacuauagaaagagagugcaaaacgugaccgaauuugaugacucccugcucagaaacuuuacucuggugacacagcacccagaggucaucuauacgaaccagaacgucgucugguccaaguuugagaccauuuuuuucaccauuagcggccucauucacuacgcacccguauuuagagacuacguguucaggucuaugcaggaauucuacgaagacaauguucuauauauggagauucgggcuaggcugcuucccguuuacgagcuaucaggggaacaucacgaugaggaauggucugugaaaaccuaucaagaggucgcccagaaguucgucgagacccacccagaauuuaucgguauuaagauuaucuacucugaucacagaaguaaagacguggcagugaucgcugaguccauuaggauggcuaugggauuacggauaaaguuuccgaccguugucgcuggauuugaccuaguuggacacgaagacacaggccacucccuccaugauuauaaagaggcacugaugauuccagcuaaggauggugugaaacucccuuauuucuuccacgccggagaaaccgacuggcaaggaacaucaaucgacaggaacauacuagaugcccuuaugcugaacacuacccgcauaggacacggguucgcccucagcaaacacccugcaguccgcacuuacucuuggaagaaggacauacccaucgaaguuuguccaaucagcaaucaagugcucaaacuggucagcgaucuaagaaaccaucccgucgccacccuaauggcaacuggacauccgaugguuauuuccucagacgauccugcgauguucggcgcaaagggucucagcuacgauuuuuacgaaguguuuaugggcauuggaggcaugaaggcugaucugaggacucugaaacaacucgcaaugaacagcaucaaauauagcaccuuguuggagagugaaaaaaacacauuuauggaaauuuggaaaaagagaugggauaaguuuauugccgauguggccaccaaguag

SEQ ID NO: 14714 - RNA, 1137 nt, Artificial Sequence
  Description of Artificial Sequence: Synthetic coding sequence
uaauauucuggggauuacauggaaccggagaagccaggcgcaccccuccugcccccacccccacagaacucugugccccacuacgcugaagccgauaucguuacacuacagggaguaacggguggaaauaccuaugccgugccagcccugcccccuggagcuguuggcgaugggcccccgagaguggacuuuccaagaagucgccugcgcuuuaaggagaaacugggagagggacaauuuggcgagguucaccuuugugagguagacuccccacaggacuugguaucccuugauuucccucuuaacguacgaaagggucacccacugcugguugcuguuaaaauccuuaggccugaugcuaccaaaaacgcuucuuuuucucucuucucacggaaugauuuccugaaagaggugaaaauaaugagccgucugaaagaucccaauauuauaaggcugcuagggguguguguucaggaugacccgcuguguaugaucaccgauuacauggagaauggcgaccuuaaucaguuucucagcgcucaccagcuugaagacaaggcagcagagggcgcuccuggagaugggcaggcugcucaaggaccaaccauuuccuauccuauguuacuccacguggcugcccaaaucgcaucaggaaugagauaccucgcaacacuaaacuucguucacagagauuuagcaacacguaauugucugguuggggagaacuucacaauuaagaucgcggauuucgguaugucucggaacuuauacgcuggggauuauuaccgcguacaggggcgugcaguucuaccuauuagauggauggccugggaguguauccugaugggcaaauuuacuacugcaagugacgucugggcguuuggcgugacgcucugggaggucuuaaugcugugccgcgcacaaccauucggccaacucaccgaugagcagguaauagagaaugcaggagaauucuuuagagaucagggucggcaaguguaccuguccaggccucccgcgugcccacaagguuuguaugagcuuauguuaagauguuggagucgggaguccgaacagagacccccauuuagccaacugcaccgauucuuagccgaggacgcccucaauacuguguag

SEQ ID NO: 14715 - RNA, 678 nt, Artificial Sequence
  Description of Artificial Sequence: Synthetic coding sequence
ugagcugaucuuccauccuguuggggggcaggaccauguuacacagggcacaaggugggagcucucaggcgggacaccgugauuugcugcugucggcacggggauuauagcacaccaugccuauuuacaccuggaaaaccaagcagaaaccccucuccauggaagagaacccuguggacccugagugcccccugggcugggcccgcuggauggacaggagaagaacaaaacgccacgaaaaccggccucauaacccgaaggcccagaccuuugagaaggagaccucauccagcaccagccagcccacugccagaaauuauacguggcaauauuccaagaauguuaggaaaauuuguucccgugaauugggaaccaccucaaccacuccccuucccaaaauaucuccguuguuaucgcugccuccuugagacaaaggaacuugguugucuccucggaucugacaucugccucaccccugcaggauccaguuguauuacuuugcacaaaaagaauagcagugggagugacgugaugguguccgauugucgaaguaaggaacagaugagugauuguucuaauacgaggaccuccccaguguccggauucuggauuuucucucaauacugcuuccuugacuuuuguaaugacccacaaaaccggggccuguauaccccuuag

SEQ ID NO: 14716 - RNA, 846 nt, Artificial Sequence
  Description of Artificial Sequence: Synthetic coding sequence
augcuuccaaagucuagacgugcacugacaauacaggaaaucgcagcgcucgcucgcucaucacuccacggaaucagccagguugugaaggaccacgucacaaagccgacagcaauggcucagggucgcguggcacaucucauugaauggaagggaugguccaaaccaucagauucuccagcagcucucgaaagcgcuuuuaguaguuauagcgaucugagcgagggcgaacaggaggcacgcuucgcagccggaguugcagaacaauucgcaaucgccgaggcuaaacugcgcgccuggagcucagucgauggugaagauucuacagaugacucuuaugacgaagauuucgcaggggggauggauaccgacauggcaggccaacucccucucgggccacaccuucaagaccuguuuacuggacaucgcuucucucgcccaguccggcaagggagcgucgagcccgaauccgacuguucucaaacuguaucgcccgauaccuuguguagcucucuaugcucccuggaagauggucugcugggaucccccgccagacuggccucucagcuacucggagaugagcuguuacucgccaaacuuccuccuagccgugaaucagcauuccgcaguuuagguccccuggaggcucaagacucacuuuauaacucaccccucaccgaaaguuguuugucccccgcggaagaggagcccgcaccaugcaaagacugucaaccacugugucccccccucaccggcaguugggagcgccagcgccaggcaagcgaccuggcuucaagcggaguggucagccucgaugaggacgaggccgaaccagaagaacaguag

SEQ ID NO: 14717 - RNA, 1110 nt, Artificial Sequence
  Description of Artificial Sequence: Synthetic coding sequence
augaaguuucaggggccacuggcaugucugcugcuugcucugugccucggaucuggggaagcuggaccuuuacaauccggggaagaaucuacgggaacaaauauaggagaggcacugggccacggauuaggcgacgcauuaagcgaggguguggggaaggcuauugguaaggaggcggggggagcugcaggaaguaaggugagcgaagcccugggucaggggaccagggaagcugucggaaccggcguccgacaggugcccggauuuggaguggccgaugcccucggcaaucgugugggagaggcugcgcaugcucucggcaauacggggcaugaaauagguaggcaggcagaggaugugauuaggcauggggcugaugcuguucggggguccuggcagggagugccuggccacaacggcgccugggagacuucaggaggucaugguauuuuuggcucccaagguggccuaggcgggcaaggacaggggaauccaggcggacucgguaccccaugggugcacggcuauccagggaauagcgccgggagcuuuggaaugaauccacagggugcucccuggggacaaggugguaacgguggcccacccaacuucgguacuaacacucagggagcgguggcccaaccuggauacgguucaguuagagccucaaaucaaaaugagggcuguaccaaucccccuccaagcggaucuggcggcggaucgucuaauucagggggaggaucuggcucucagucugguucaaguggcuccgguucuaauggggacaauaacaacgguagcagcagugguggguccaguagcgggaguaguagcggcggaucuagcggugggagcagugguggcucuucugguaacucaggaggcagucguggugauucgggcagugaaagcuccuggggaucaaguacaggaaguagcaguggcaaccacgguggcucaggaggggggaauggccauaaaccugggaacagcgagacaucaccaggcauguuuaauuucgauacauuuuggaagaauuucaaauccaaacucgguuucauuaacugggaugcuauuaacaaggaccagcgaaguuccagaaucccuuag

SEQ ID NO: 14718 - RNA, 420 nt, Artificial Sequence
  Description of Artificial Sequence: Synthetic coding sequence
augggcccagaagcucuaucaucacugcugcuguuacugcuuguugcaaguggcgacgcggacaugaaaggacacuucgacccugccaaauguagguacgccuugggaaugcaagauagaaccaucccagauagugacauaucugcuucaucuaguuggucagauaguacugccgcucggcauucccggcuagagucaucagauggggauggcgcuuggugucccgcaggaaguguguucccuaaggaagaggaguaccuucaaguugauuugcaacgccugcaucuggucgcgcuggucggaacgcaggggcgacacgcuggggggcuagggaaagaguuuagccgcucauaucggcucagguacaguagagacggacgaagauggaugggauggaaggaucgguggggacaggaguag

SEQ ID NO: 14719 - RNA, 516 nt, Artificial Sequence
  Description of Artificial Sequence: Synthetic coding sequence
augcggcacaaccuuggagguaacuugggcgaucccagagcccgcgcuguuucugugccacuugguggaagagucgccagauucuuacaaugcagauuucuguuugcgggcccuuggcuccucuuuucugaaauuagcuuuauuagugacguggugaauaacucaaguccagcucugggcggcacuuuucccccagcuccuugguggccccccggcccuccccccacgaauuuuuccucccuggaacucgaaccuagagggcagcagccaguagccaaagccgaaggcaguccuacugccauuuuaauuggcugucuuguugccauaauucuacuucuucuccuaaucauugcccucaugcuguggagacugcauuggcgacggcugcuauccaagguccucgaaucacacccacguacccguaguccgggucucguugguauuaggcccacuccgcucccagucucgcccauggcccucgugcauuugugugaagucgauuccccccaagauuag

SEQ ID NO: 14720 - RNA, 192 nt, Artificial Sequence; identical to SEQ ID NO: 13081
  Description of Artificial Sequence: Synthetic coding sequence

SEQ ID NO: 14721 - RNA, 1137 nt, Artificial Sequence
  Description of Artificial Sequence: Synthetic coding sequence
ugauacaguggggauuauauggaacccgagaaacccggcgcgccacuacuuccccccccaccacaaaauucgguuccacacuacgccgaagccgacaucgugacccuacagggugugaccggagggaauacguaugccgugccagcacugcccccgggagcugucggggaugggccuccuagaguugacuucccuagaagcaggcuccguuuuaaagaaaaacucggcgaaggacaguuuggcgaggugcacuugugcgagguggacuccccccaggaccuagugucacucgauuucccauugaaugugaggaaaggccacccauugcuggucgccgugaagauacuacguccagacgcaacuaaaaaugcuuccuucucgcuuuucucacggaacgauuuccuaaaggaggugaagaucaugaguagacuaaaagauccuaacaucauucgcuuacucggcgugugcgugcaggacgauccacuuugcaugauuaccgacuacauggagaacggagacuuaaaccaguuucugucagcccaccagcucgaagauaaggcugcagagggggcuccaggugacggacaagcggcacaaggcccuacuauuucauauccaaugcugcuucacgucgcugcacagauugcuagugggaugagguaucuggcaacacucaacuucgugcauagagaccuggcaacucgcaacugucuggugggcgaaaacuuuaccauuaagaucgcggacuucgguaugagcagaaaucuuuaugcgggcgacuauuauaggguccagggacgggccgugcuuccaaucagauggauggccugggaguguauucucaugggaaaguuuacaaccgcuuccgauguaugggccuucggcgugacccucugggaagugcugauguugugcagggcacagccuuuuggccaacugacagaugagcaagugauugagaacgcaggcgaauucuuucgcgaucaaggccgccaaguguaucuaucccggcccccagccuguccacagggacucuaugaauugaugcuccgaugcuggucccgcgaauccgaacagcgccccccauucagccagcugcaucgauuucucgcagaagacgcgcugaacacuguguag

SEQ ID NO: 14722 - RNA, 2535 nt, Artificial Sequence
  Description of Artificial Sequence: Synthetic coding sequence
auggggcccggcgcuccuuuugcccgagugggauggccacuuccccuauuagucgugauggcugcuggagucgcccccgugugggccucccacucaccgcacuuaccucgcccccacucccgaguucccccacacccuuccucggagaggcgcgcaguuuacaucggcgcuuuguuccccauguccggggguuggcccgggggccaagccugccaaccggcugucgaaauggcauuggaagacgucaauucucgucgugacauccugccugacuaugaacuaaaacucauccaccacgacuccaaaugugacccaggacaagccaccaaguaucucuaugaauuacuguacaaugaucccauuaaaauaauacuaaugccaggaugcagcucugucucgacucuuguggcugaagccgcuagaauguggaaucuaaucguccugucuuauggauccagcagcccagcccuauccaaccgacaaagauucccuacauuuuucagaacacaucccuccgcaacacugcacaauccuacccgcguuaagcuuuucgagaaguggggauggaaaaagaucgccaccauccagcaaacuaccgagguguucacuaguacccuggacgaucuggaggagagggugaaggaagccgggaucgaaauuacuuuuagacagucauucuucagcgaccccgcuguacccguuaagaaucucaagaggcaggacgcucgaauuauaguaggucuuuucuaugaaacugaagcgaggaaaguuuuuugcgaggucuauaaagaacgucucuucggaaagaaauaugucugguuccugauagguugguaugccgauaauugguucaagaucuacgaccccucuauaaauuguaccgucgaugagaugaccgaagccguggaggggcacauuacgaccgaaauugucaugcucaauccagccaacacacguuccauuaguaacaugacuagccaggaguucgucgaaaaacuuacuaagagacugaagcggcacccugaagagaccggcggguuccaagaagcuccccucgcuuacgaugcuaucugggccuuagcucuagccuugaauaagacuagcgguggcggugguaggaguggagugcgccuugaggauuuuaauuauaacaaccagacaaucacagaucagaucuaucgcgccaugaauagcucgucauucgaaggcguuuccggccacgugguguuugacgccaguggcucacgaauggcauggacacugauugagcagcuucagggcggcaguuacaaaaagaucgguuacuacgacuccacuaaggacgauuuaucuuggucaaagaccgacaaguggaucggaggaagccccccagcagaucagacccuugugauuaaaaccuuuagauucuugagccaaaaguuauuuauauccguguccguacuuucaucucucggcauuguccucgcuguggugugucuguccuuuaauaucuacaauucccacgugcgcuacauucagaauucccaaccuaacuuaaacaaucugacugcgguggguuguagccuggcgcuggccgcaguguuuccccuugggcucgacggcuaccacauaggcaggaaccaguuucccuuuguaugccaagcgcgucucuggcuucuuggccuaggauuuucauugggguauggaucaauguucacaaaaaucuggugggugcacaccguguucacuaagaaagaagaaaaaaaggaguggagaaagacacuggaacccuggaaacucuacgcuacaguaggguuauuggugggcauggauguguugacccuggcaauauggcagaucguagacccccugcaccgaacaauugagacauucgccaaggaagaacccaaagaagauaucgacgugucaauacugccccaacuugaacacuguucuagcaggaaaaugaauacuuggcuaggaauuuuuuauggauacaaaggguuauuauuguugcugggcauuuuucuggccuaugagacaaaaagcgugaguaccgagaagauuaaugaucaccgcgcaguggggauggccauuuacaacguagcuguccuguguuugaucaccgcuccaguaacuaugauccuuucuagccagcaagacgccgcuuucgccuucgcaucccuggcuaucguguucucuaguuacaucacucugguuguacuguuuguacccaaaaugcggcgacuuauaacucgaggagaguggcagagugaggcccaagacaccaugaagacagggagcaguaccaacaacaacgaagaagagaaaagucgccuguuagagaaagagaaucgagagcuggaaaagauuauugcagagaaggaagaacgagugucagaacucaggcaucaguuacagucuagacaacaacuacgaucccgaagacauccuccaacuccacccgaaccaagugggggacugccucgaggcccuccagagcccccagauagacucuccugcgaugguucccgcgugcaucuccuauacaaguag

SEQ ID NO: 14723 - RNA, 339 nt, Artificial Sequence
  Description of Artificial Sequence: Synthetic coding sequence
augcugacugcugcccuggcaccuggagccgcaaacucuccaacaacgaacccugugaucuuaaucguggacaaggugcucgagacgcaagaccuuaauggcgauggacugaugacgcccgccgaacugauaaauuucccaggcguggcgcugcgaccauauccaccauauaucggagugggucccaauucuaauaugugcagccgcucugacuugcccgaagauaguaauacccuguacccugguucucacuuguggcuucgacacgcauugaacuccaaaggaaaucuggaugcccgacuggacgggggggagaaggcaaugcaaccgcaaugguag

SEQ ID NO: 14724 - RNA, 2676 nt, Artificial Sequence
  Description of Artificial Sequence: Synthetic coding sequence
augcucccaacagaaguuccccagucucaucccggcccaagcgcgcugcugcuccugcaacuucuucugccacccacaucggcuuucuuccccaauaucugguccuuguuggcagccccaggaucuauuacacaucaagaccuuacggaagaggcagcacugaauguuacacugcaacuguuccuugagcaacccccuccuggccggccaccccugagauuagaggacuuucucggccgcacguugcucgccgaugaccucuucgccgcuuauuucggccccggcucaucacgacgguuuagggcagcucugggugaaguuucaagggcaaaugcugcucaggacuuucucccuacuagcaggaacgauccagaucuacacuuugaugcugaacggcugggucagggucgcgcacgucuugucggcgcuuuaagagagaccguuguagcugcccgggcacuggaccacacacucgcuagacaaaggcugggggcagcccugcacgcccuacaggacuuuuacagucauaguaacugggucgaguuaggagagcagcaaccucacccucaucugcuuuggcccagacaagaauuacagaaccuggcacaggucgccgauccaacauguucagauugcgaggaauugucuuguccucgaaacuggcugggauucacgcuacugacuuccggauauuucggcacacauccuccuaaacccccaggcaaguguucccauggaggccacuucgaccgcucaagcucccagccaccccgcgggggaauaaacaaggauagcacaagcccuggguucucaccucaucacaugcugcauuuacaggcugcuaaguuggcacugcuggcaucuauccaagcuuucucucuccugcgcuccagacugggcgaccgcgauuuuucccggcugcuggauaucaccccagcaucuucacuaagcuucgugcucgauaccacaggcuccaugggcgaagaaaucaaugcggcaaagauccaggcccgccaucuuguugaacagcggcgagguaguccuauggaacccguucauuacguacuggucccuuuccaugacccuggcuuuggccccguguuuacuacaagcgauccggauuccuuuuggcagcagcugaacgagauucacgcucuggguggcggagaugaacccgaaaugugccuaagugccuuacagcuggcccuacuacacaccccuccucuauccgauauuuuugucuucaccgacgccagucccaaggacgcuuucuuaacaaaucaagucgaaucccucacucaagagcguagaugucgggugaccuuucucguuacagaggauaccagcagagugcaaggccgagcccgccgagagaucuugagcccacugcgauucgaaccuuacaaagcuguggcccucgccucuggaggcgaaguaaucuuuacaaaagaucagcacauccgcgacguggcugccaucgugggggaguccauggcagcgcuggucacuuugccccuugauccuccaguuguagugccgggccagccauugguuuuuucuguggauggucuccugcaaaaaauaacagugcgcauccacggcgacauuucaaguuucuggaucaaaaacccugccggaguaucacagggucaagaggaaggaggaggaccucugggacacacaagaagauucggucaguucuggauggugacuauggaugauccuccacaaaccggcacaugggagauucaggugacggcugaggacacacccggagucaggguucaagcacagaccucucucgauuuccuuuuucacuucggcauccccauggaagaugguccacaucccggccuuuacccuuuaacgcagcccguggcggguuugcagacacagcugcucguagagguuacggggcucggguccagagcaaauccaggagauccccaaccucauuuuucucaugugauccugcgcggagugccugaaggugccgaacugggucaggucccucuugagcccguugggccacccgaacggggcuuguuagccgccucucugagccccacauugcugucuacaccccggccuuucucccuggaacugaucgggcaggacgccgcagggcguagacuccaccgcgcagccccucagccauccaccgugguaccuguccuguuggaacuuagcggcccaucuggcuuuuuggcuccaggaucaaaaguaccucucagucugaggauugccucauucagcggcccccaagaccuggaccucagaaccuuugugaacccaagcuucucuuugacuucuaaccucuccagagcucaccuggaauugaaugaauccgcuuggggacgacuuuggcuugaagugccugauuccgcagccccugauuccgugguuaugguuacagucacagcuggaggccgcgaagccaaccccguuccccccacucaugcauuucugagacuccucgucagcgcccccgccccgcaagaucggcauaccacaccuacaggcucaucagacccuauucuuaccaccgcuacacccgcauuuucacccuucacccuggugacucagggccgcgcgggcgcaggacuggcugcuggaucaccuugguggggaaccgucggcggcguucuguuguugcugggucucgccagcugguag

SEQ ID NO: 14725 - RNA, 2742 nt, Artificial Sequence
  Description of Artificial Sequence: Synthetic coding sequence
auggguccugaagcgcucucguccuuacuucuccucuuacugguggccaguggggacgcugauaugaagggccauuuugauccugcaaaaugcagauacgcccucggaaugcaagacagaacuaucccagauucugacauuagcgccucaagcucuuggagugacuccacugcggcuaggcauuccagguuagagucgucugauggagacggugcuugguguccugcagggagcguguuuccuaaagaagaggaauaccuucaagucgaccugcaacgccugcaucugguagcuuugguaggaacacaagggcgacacgccggcggccuaggcaaggaauucucuagaucguacaggcucagauauaguagggauggccggagauggaugggauggaaagauagauggggucaggaggugaucagcggcaaugaagauccagagggcguggugcuuaaagauuuggguccccccaugguggcaagauuggucagauucuauccccgagccgauagagugaugaguguuugucuucggguagaauuguauggcugucuguggagagacgguuuguuguccuacaccgcccccguugggcagaccauguaucuaagugaggcaguguaucugaacgauucaacuuaugacggacacacgguuggaggccugcaauaugggggacuaggucagcuugcugauggagugguuggguuagaugauuuuaggaagucucaagagcugcgcgucuggccuggcuacgacuaugugggauggagcaaucacucauuuucuaguggcuacguugagauggaguucgaguucgacagauuaagggcuuuucaggcuaugcaaguacauuguaacaauaugcauacacugggugcccgucuucccggcgguguugagugcagguuuagacgaggcccagccauggcuugggaaggcgagcccaugaggcacaaucuaggaggcaaucugggggaccccagagcaagggccgugucggugccuuuagggggccggguugcccgguuucugcaaugcagguuucuguuugcuggaccuuggcuauuauuuucagaaaucuccuucauuagugacgucguuaacaauucuucuccugcuuuaggcggcacuuuucccccugcuccuugguggcccccuggacccccuccaacaaauuuuaguagucuggaacucgagccucggggucaacagccaguugcaaaggcugaggggucucccacugcuauccuaauugguugucuuguggcuauuauccuuuuacugcugcugauuaucgcacuuaugcuuuggcgucugcauuggcgacgacugcucucuaaggcagaacgaaggguccuggaagaagagcugacuguucaucuuagcgugcccggagauacgauccuuauaaauaaccgcccuggaccuagagaacccccaccauaccaggagccccguccccgaggaaacccuccucauucugcaccuugcgugccaaacggaucugcuuuauuacucaguaaccccgccuaccgauuacuccucgcuacauaugcgcgcccacccagaggccccggccccccgacucccgcuugggcuaagcccaccaauacucaggcuuauaguggugauuacauggagccugaaaagccaggagcaccucuuuuaccaccuccuccucagaauagcguuccucacuacgccgaggcugauaucgucacucugcaagggguuaccgguggcaauaccuaugccgugccugcacuccccccaggagccguuggcgauggcccaccccgcguggacuucccaaggucucgccucagauucaaagaaaaguuaggggagggccaauuuggcgagguucaucugugugagguggacagcccccaagaccuugucucgcuugauuucccccuaaaugugcgaaagggccaucccuuacucguggcaguuaagauucuaagaccggaugcuacaaaaaaugccagaaaugauuuucucaaagaaguaaagaucaugucgagacucaaggacccuaauauaauccgccuucuugggguuugcguacaagacgauccucuguguaugauaacugacuauauggaaaacggggaccuuaaccaguuccucagugcgcaucagcucgaggauaaagccgcagagggcgcgcccggcgacggacaggcggcccaagguccaacuauauccuaccccauguuacuacacgucgccgcucaaauugcauccgggaugcgcuauuuggccacauugaacuuugugcaucgggaccuagcuacucgcaauugcuuagugggugagaacuuuacuauuaagauagcugauuuuggaaugucccgcaaucucuacgccggcgacuauuaccgagugcaggguagagccgugcuuccuauucgguggauggcaugggaauguauccucaugggaaaauuuacuaccgccucugaugucugggccuuuggcguaacuuugugggaaguucugaugcugugccgggcucagcccuucggacaacuaacagacgaacaagugaucgagaaugccggagaauucuuccgagaccaaggucgucagguuuauuuauccagaccaccugccugcccccaaggccuguacgaacuaaugcugcgcuguuggaguagggagucugaacagcgaccccccuucucccagcuacaucgauuucuugccgaggaugcucuaaauaccgucuag

SEQ ID NO: 14726 - RNA, 390 nt, Artificial Sequence
  Description of Artificial Sequence: Synthetic coding sequence
auggccgccggaucagcaccaaugcaacugcaccugagggcgacaauacgcaugaaagacggccuguguguuccaaggaaauggauuuaucaccugacagaggggaguaccgaccugaggacggagggaagaccggacaugaaaacagaauuguuuucaagcucaugucccggugguaucaugcugaaugagacgggacaaggguaucaacgcuuucuccuguacaaccgaucaccgcacccaccugagaaauguguggaggaguuuaaaucacucacuuccugccuagauucuaaagcuuuuuuacugacuccaagaaaccaagggaaaggauugaagagccacaaaacugggcugggccucacuaagucaucuggcgucaccggcuag

SEQ ID NO: 14727 - RNA, 846 nt, Artificial Sequence
  Description of Artificial Sequence: Synthetic coding sequence
augcugcccaaauccagaagagcccuuaccauccaggaaauagcugcacuggcccgaucaucgcugcacggaaucucucaagucguaaaggaucauguuacaaagcccaccgccauggcucaaggucggguggcacaccugauugaauggaagggcuggucuaagccuuccgacagcccugcugcccucgaaucagccuuuagcagcuacuccgaccucucagagggagagcaggaagcaagauuugcugcagguguagccgaacaguuugcuauugcugaggcaaaauuacgagcaugguccagcguggacggagaggacaguacugacgacagcuaugaugaagacuucgcugguggaauggauacugacauggcaggacagcuuccccugggaccucacuugcaggauuuguucacaggacaucgcuucucccgaccagugcgacagggaagcguggaaccugaauccgacuguucacagacgguuuccccugacacucuguguuccuccuuguguagccuugaagacgggcuccucggcucaccugcacgccucgcaagucaauugcugggggacgagcugcugcuggcuaaacugccccccucccgcgagucagccuucagaucacuaggccccuuggaagcacaggacucccuguacaacuccccucugaccgaguccugcuugucccccgcugaagaagagccagccccuuguaaagacugucaaccccugugccccccacucacugguagcugggagagacagagacaggcuagcgaccuggcaagcaguggcguaguuuccuuggacgaagacgaggcugaacccgaagaacaguag

SEQ ID NO: 14728 - RNA, 444 nt, Artificial Sequence
  Description of Artificial Sequence: Synthetic coding sequence
augggcccugaagcgcugagcagccuguuauugcuacuacucgucgccucuggcgacgcagauaugaagggccauuuugaccccgcuaaauguagauaugcucugggaaugcaggacagaacaauuccugacucagauaucagcgcuuccuccagcuggagugauaguacugccgcacgacacuccagacucgaaaguagcgacggcgauggugccuggugcccagccggcucaguguucccaaaagaggaagaguaccuacagguggacuuacaaagacugcaucugguugcccuagugggaacgcaaggaagacacgccgggggcuuaggaaaagaauucagcagaaguuauagauugagguauagcagggaugggagaagauggauggguuggaaggaccgcuggggacaggaggugauuaguggaaacgaagacccguag

SEQ ID NO: 14729 - RNA, 2631 nt, Artificial Sequence
  Description of Artificial Sequence: Synthetic coding sequence
augggacccgaggcccuguccagcuugcuuuugcuccugcuuguggccucaggagacgccgauaugaagggccauuuugacccugccaaaugccgcuaugcauuaggaaugcaggacaggacuauccccgauucugacaucucagcgagcuccagcuggucugauucuacggcugcaagacacucucgccucgaauccucagacggagauggagccuggugcccugcuggcagcguauucccaaaggaagaagaauaccuucaaguggacuuacagcgcuugcaucucguggcacucguuggaacacaggggagacacgcgggggggcucgggaaggaauucucuagguccuauagacugagguacagcagagacggccggagauggaugggauggaaagaccgcuggggucaagaagugauuagugguaacgaagaucccgaggggguugugcucaaagaucucggcccaccuaugguggcuagacucguuagauuuuauccucgagccgauagagugaugucuguguguuuaagaguugagcuguauggaugucuuuggcgcgacggucuuuugaguuacacugcccccguuggucaaacgauguaccucucugaagcaguguaucugaacgauucuacguacgaugggcauacgguugggggccuacaguaugguggacugggacagcuugccgauggcgugguuggauuggaugauuuuagaaagucucaggagcuccgcguguggccugguuacgauuaugucgguuggagcaaucauucauuuucuuccggcuauguggagauggaguuugaauucgauagacuaagagcauuucaagcuaugcagguucauugcaacaauaugcacacacugggagcccgacugcccggggggguugaaugccgauuucgaagagggccagcuauggcuugggaaggggagcccaugagacauaaccugggaggaaauuugggggauccucgggcaagagcggucaguguuccucugggaggacggguggccagauuccuucagugcagauucuuauucgcagggccauggcuucuguuuagcgagauuucguuuaucuccgacguagucaacaacucaucaccggcacuggguggaacuuucccuccugccccaugguggccucccggaccuccacccacaaacuuuucaucucuggaacuagaaccuagggggcagcaaccugucgcaaaagccgagggcuccccuacugcaauucuuaucgguugcuugguagccaucauccuucugcucuuguugauaauugcccucauguuguggcggcuacauuggagacgguuguuaagcaaggcugagcguagaguccuugaggaggaacugacgguucauuugagcguacccggggauacaauucugaucaauaaccggccuggaccacgcgagcccccucccuaccaggaaccccggccccgcggaaauccaccccauuccgcgccaugcgugcccaacggaucagcuuacuccggagacuacauggagccagagaaaccaggcgcuccucuucugcccccaccuccucaaaauuccgugccacauuaugccgaggcugacauugucacauugcagggcguaacuggcgggaacacuuacgcagucccggcccugccaccuggugcagucggagaugguccuccccggguggauuucccucggagccggcuccgcuuuaaagaaaaacugggagagggucaguuuggagaaguacaccugugugaggucgacucuccccaagaucuugugucuuuggacuuuccacucaauguaagaaaagggcacccacugcuaguggcaguaaaaauccugaggccugacgcuacuaaaaacgcuaggaacgacuuucuaaaagaagugaagauaaugucaagacuuaaggacccaaacaucauuagauuacugggcguuuguguucaggaugauccucuauguaugaucacagacuacauggaaaauggcgaccugaaucaguuccucucugcgcaccaauuagaggacaaggcugccgaaggggcucccggagauggccaggccgcucagggaccaaccaucucuuauccuaugcuacuacacguagccgcacagauugccagcggaaugagauauuuagcaacacugaacuucguacaccgggaccuugccacucgaaauugcuuggugggagagaacuucacaaucaaaauagccgauuuuggaaugucccgaaaucuauacgcgggcgauuacuaucggguacagggaagagccgugcuaccgauuagauggauggcgugggaauguauucuaaugggaaaguuuacaacugcuagcgacgugugggccuucggggucacucugugggagguacugaugcuuugucgagcacagccauucggccagcugaccgacgagcaagucauugaaaaugcaggcgaauuuuuccgagaccaagguagacagguguacuugagcagacccccagcuugcccucagggccucuacgaauuaauguugagaugcugguccagagagucugaacaacgcccaccuuucucccaauugcacagauuuuuggcugaggacgcauugaauaccguauag

SEQ ID NO: 14730 - RNA, 1749 nt, Artificial Sequence
  Description of Artificial Sequence: Synthetic coding sequence
auggauuucuugcucgcccuaguguuggucucaucacuguaucuucaagccgcugccgaauuugacggaagauggccuagacagaucgugucgagcaucggacuuugucgauauggggguagaauagauuguuguuggggaugggcucgacagaguuggggacagugccagccauucuacguauuacgucagcguaucgcucgcauaaggugccaacuaaaggcagugugucagccaagauguaaacacggugaaugcauuggaccaaauaagugcaagugccacccagguuacgcuggcaaaacuugcaaccaggaucugaacgaguguggccucaaaccucgcccaugcaaacaccguugcaugaauaccuacgggaguuauaagugcuauugucuuaacggauauaugcugaugccagacggaaguuguucauccgcgcuaacaugcucaauggcgaauugccaauacggcugcgacguggucaaaggacagauaagaugccaaugcccaucacccggauugcagcucgcuccagauggucgcacgugcguggacgucgaugaaugugcaacaggacgcgccuccugcccacgguuucgccaaugcguuaacacuuuugguagcuacaucuguaaaugucacaaaggcuucgaccuuauguauauaggcggcaaauaccagugucacgauauugacgaguguagucugggccaauaccagugcucuuccuuugcccggugcuauaacauaagaggcagcuacaaauguaaguguaaagaagguuaucagggcgacggccugacuugcguguacaucccaaaaguuaugaucgaaccaagcggcccaauucacgugccaaagggaaacggcacuauuuugaaaggugacaccggcaacaauaacuggauuccagacguggggucuacgugguggccccccaaaacuccuuacaucccuccgauaauuacgaaccguccaacuucuaaaccaacaacccgcccuacuccuaaaccuacgccuauuccuacucccccaccucccccuccauuacccacugaacucaggaccccccugcccccaaccacccccgaaagaccuaccacaggacugacaacgauagccccagcagccagcacaccaccaggaggaauaacuguugacaauagggugcagaccgacccucagaagccaagaggugacguguucauuccccggcagccaaguaaugauuuguucgagaucuuugaaauugagagaggaguguccgcugacgaugaagcuaaagacgaccccggcguauugguccacagcugcaacuuugaucacggcuuguguggcuggauccgggaaaaagauaaugaucugcacugggaaccuaucagagacccugccggcggacaguaccuaaccguuuccgcugccaaagccccugguggaaaggcagcccgcuugguucucccgcugggacgcuuaaugcauucaggagaccucugccucagcuuccggcacaagguaacuggauuacacagcggaacccuucagguguuugugcgaaaacacggggcccauggagcugcacuguggggcagaaauggcggacacggcuggagacaaacccagauuacacuuaggggcgcugauauuaagagcguggucuucaagggcgaaaaaaggaggggccacacgggcgagauugggcuggaugacgugucacugaaaaaggggcauugcagcgaggagcgcuag

SEQ ID NO: 14731 - RNA, 1602 nt, Artificial Sequence
  Description of Artificial Sequence: Synthetic coding sequence
augggguccagucggcuggcagcauugcuccucccacugcuguugaucguuaucgaccugucugacuccgcggggaucggauuccgccaucucccucacuggaacacccgauguccccucgccucucacaccgacgacaguuucaccggaaguagcgcuuacaucccuugcaggacuuggugggcccucuuuucuacuaagccuuggugcguuagaguauggcacugcucacgcugucugugucagcacuuauuaucaggcggcucagguuuacaacguggacuuuuucaucuauuagugcaaaaaagcaagaaaagcucuaccuucaaguuuuauagaaggcauaagaugcccgcccccgcacagcgaaagcuucuucccagacggcaccuaagcgagaagucacaccacauaucuauacccagucccgacauuucacauaaaggauugcgcucaaagcggacacagcccagugacccugaaacuugggaaucccuucccagacuagacucacaaaggcauggcggcccugaauuuagcuucgaucugcuccccgaggcucgagccauacgaguuacaauaucuagcgguccagagguuuccgucagauuaugccaccagugggcccucgaaugcgaagaacuaaguagcccauacgacguacagaagauugugagcgguggacacacgguugagcuuccuuacgaguuucugcucccuugucugugcauugaggccagcuaccuccaggaggacaccguccgccggaaaaaauguccauuucaaagcuggcccgaagccuauggcuccgauuuuuggaaauccgugcauuuuacagauuauucccagcauacacaaaugguaauggcucuuacauuacggugccccuugaaacuggaggccgcucuuugucagcggcacgacuggcauacacuguguaaagaccucccuaaugccaccgcacgcgaaucugauggcugguacguccuggaaaaagucgaccugcauccucaacuaugcuuuaaauuuucauucggcaacucaagucauguugaguguccucaccagacggggucccucacaagcuggaauguuuccauggauacacaggcgcagcaacucauucugcauuucuccucgcgcaugcaugccaccuucagcgcugccuggucucuuccaggccuggggcaagacacccugguuccaccaguuuauaccgucucccaggcucgcggcucuucucccgucucccuugaucucaucauaccuuuucugcggcccggaugcuguguuuugcuacacgccagccuuagcucacccggaggagaagacgcauggcugaucggcguggggggaaguguucccagcggcguggccguccgcugccccgucugccuggaagccccccucgucuccgguugucugcuccagacucccggcgcccuggacccaggcacagcaggucccccgcauccuacuggcugcugcaguggcccccaucugccagcuccaacuguaaggccuggaccaucugcggcaucagcacccccugcgcggggcggauuggggggagcagccgccccuggagguagcgcugguuag

SEQ ID NO: 14732 - RNA, 1293 nt, Artificial Sequence
  Description of Artificial Sequence: Synthetic coding sequence
augggcguaaguaagcuugacauacuuuaucgacggcuucuacucacaaagcuauuuauccggggcuggggaaggcccgaagacuugaaaaggcuguucgaauucagaaaaaugauaggcaauagggagcgaugccagaacuugguaaguuccgacuauccgguucauauagacaagauugaggagcagagugauuguaagauucuugauggccacuuuguguccccgauggcccacuacgugccagacaucaugcccauugaguccguuauugcaagguuucaauucaucguccccaaggaguggaacuccaaguaucgcccagucuguauucaccucgcugggacuggggaccaucauuauuggaggagaagaacuuugauggcaaggccaaugauaaaagaagcucgcauggccucucugcuucuugaaaaccccuacuacggcugucggaagcccaaagaucaggugcggucuaguuuaaaaaacguuuccgaucucuuugucaugggcggggcacugguccuggaaagcgcugcucuguugcacuggcucgaacgcgaagguuauggaccacuagguaugacuggaauuagcaugggaggccauauggcaucacuggcugucagcaacuggccaaaaccuaugccacugauccccugccuuucuuggucuacagcgaguggcguguuuacaacuaccgacagcuuuaagaugggacaggaauucgucaaacauuucacuucuuccgccgacaaacugacaaaucuuaaucuggugagccggacacugaacuuggacauuucuaaccagguggugagccaaaagccugccgacugucacaacucuagcaaaacuagcgugucagccaccuccgagggccugcuccugcaagacacuagcaaaaugaaaagguucaaccaaacguuaucuacaaauaaaagcggguacaccucaagaaacccccagagcuaccaccucuugaguaaggaacaguccagaaacagucugagaaaagagucucugaucuuuaugaaaggaguuauggaugagugcacucaugucgcaaacuuuucugugccaguggauccuagccucaucaucgugguccaagccaaggaagacgcuuacauccccagaacuggugugcguagucugcaggagauuuggccuggcugcgaaaucagauaccucgaagguggacacauuuccgcauaccuguucaaacaaggccucuuccgccaagccaucuaugacgcuuucgauagauuuuugcacaaauacgccaacuag

SEQ ID NO: 14733 - RNA, 2631 nt, Artificial Sequence
  Description of Artificial Sequence: Synthetic coding sequence
auggggcccgaggcgcucucaucucuuuuacuccugcuccuggucgccuccggugaugcugauaugaaaggacacuucgauccggccaaguguagauacgcccuggguaugcaagacagaacaaucccagacucugauauuagcgcaaguuccucuuggagcgacaguaccgccgcuagacauucuaggcucgaauccagugacggcgauggggcguggugccccgccggcagcguguucccuaaggaggaagaauaucuccaaguagaccuucaacggcuccaucuggucgcauuaguggguacacagggcagacaugccggaggccuggguaaggaauuuaguaggucuuaucgacuccgguacagcagagacggacgaagauggaugggauggaaagacagguggggccaggaggugaucagcgggaaugaggauccugagggcgugguguugaaggaucuggggccgcccaugguggcucggcuggugcgguucuauccgagagcugauagagucaugagugugugcuugagaguggaguuauauggauguuuguggagggacggacuucugucauacacagcuccuguugggcagacuauguaccuguccgaggcagucuaccuuaacgauucaacauaugacggacacacaguaggcggguuacaguacggagggcuuggccagcuugcagauggagugguaggacuugacgacuuucgcaaaagucaggaguugcgcguguggccagguuaugauuaugugggauggucaaaccacaguuuuucuagcggcuacgucgagauggaguuugaguuugauaggcuucgagccuuucaggcuaugcaagugcauuguaacaauaugcacacccugggagcaagauugccaggaggaguugagugucgcuuccgaagaggccccgcaauggcuugggagggugaacccaugagacauaaccuggguggcaauuugggagauccucgugcccgggcagucucugucccucugggcgguaggguggcacgcuucuuacagugucgguucuuguucgccggccccugguugcuguucucggagauuucauuuauaagcgacguggucaacaacagcuccccagcguugggcggaaccuuuccgccggcuccgugguggccuccaggacccccucccacaaacuuuagcagucuggaauuggaaccucggggucagcagccuguugccaaagccgaggguucacccaccgcuauccugaucggauguuugguugccaucauuuuacuguugcuuuugauuauugcccugaugcuauggagacuccauuggaggcgccuccucucgaaggcagaacgacgggugcuggaagaagagcugaccgugcacuuaaguguaccuggcgauacaauccuuauaaacaaccgcccugggccucgggagccucccccuuaccaagaaccaagaccuagaggcaauccuccacacucugcucccugcguacccaacggcucagccuacagcggagacuauauggaaccugagaaaccuggcgcaccccugcugcccccucccccccaaaacucgguaccacacuacgcggaagccgauaucgucacacuucaaggaguaacgggaggaaauaccuaugcuguacccgcuuugccacccggcgcugucggcgaugggccaccacggguugauuuuccaagguccaggcuuagguuuaaggaaaaauuaggcgaggggcaguuuggggagguccaucugugugagguugacaguccacaagaccuuguuucucuagacuuuccccugaacguuagaaaaggucauccgcuuuuggucgccgugaagauucuaaggccagacgcuaccaagaaugcccggaacgauuuccucaaagaagugaagaucaugucacgccuuaaagauccgaacauuaucagauugcugggcguaugugugcaggaugacccauugugcaugauuacugauuacauggaaaacggagaccugaaccaguuucugucagcgcaucagcucgaagauaaggccgcagagggggcaccuggagauggccaagcagcucaaggaccgacuaucucguauccgaugcugcugcacgucgcugcucaaauagccaguggaaugagguaccuggcuacacuaaauuuugugcacagggaucuggcgacgagaaauugucuggugggagaaaacuucacaauaaagaucgcugauuucgggaugucucgcaauuuauacgccggggauuauuaccgcguacagggccgugcuguucugccuauuagguggauggccugggaaugcauacuaaugggaaaguuuacuacugcaucagacgucugggcauuuggcguaacgcuaugggagguucuuauguugugucgcgcccagccauuuggucaacuuacagacgaacaggugaucgaaaacgcaggagaguuuuucagagaucaagguaggcaaguguaucuuaguaggccaccggccuguccucaaggacuauacgagcugaugcugcguuguuggucacgggaaucugagcagcgcccaccuuucagccaacugcaccgcuuccuugccgaagacgcucugaauaccguauag

SEQ ID NO: 14734 - RNA, 237 nt, Artificial Sequence; identical to SEQ ID NO: 13095
  Description of Artificial Sequence: Synthetic coding sequence

SEQ ID NO: 14735 - RNA, 2631 nt, Artificial Sequence
  Description of Artificial Sequence: Synthetic coding sequence
auggguccugaagcccuaucuucccugcuccuucugcuucugguggcuaguggugacgccgacaugaaaggacauuuugauccagccaaauguagguaugcguuagguaugcaagacagaacuauacccgacuccgauaucucagcaucuucaucuuggagcgauaguaccgcugcccgccauagucgucucgagucaucugacggggauggugcuuggugccccgcggguucuguguuuccuaaggaggaagaauaucuccaaguggaucuucaacguuugcacuuaguggcacuuguugggacacagggcagacaugcugggggcuugggcaaagaauuuucuaggucuuauagguugagguauucuagagauggcaggcgguggaugggguggaaggaucgguggggacaggaagugaucagcgggaaugaggacccagaaggaguggugcuaaaggaccuaggacccccuaugguggcucggcucguuagauucuauccaagagcagauagagugaugucggugugccugcgcguugagcuguauggcuguuuauggcgggauggguugcucucguauaccgccccagugggucaaacuauguaucugagugaggcaguauaucuuaacgacagcacauaugauggucacacagucggcggccuucaauauggcgggcucggacagcuggccgacggaguggugggccuggaugacuuucguaaaucccaggagcuaagaguauggccgggauacgauuacgucggguggucuaaucauagcuucucguccggauaugucgaaauggaauuugaauucgaucgucugagagcuuuucaagcaaugcaaguccauugcaauaacaugcacacccuuggagcucgccucccaggcggagucgaguguagauucagacggggaccugcaauggcaugggagggggaaccaaugcgacauaaccucggcgguaaucugggcgauccacgggcucgcgcugugucuguuccgcucggcggacguguagcucgcuuucuucaaugcagguuccuauuugcuggcccuuggcuccuguuuagugaaauuaguuuuauauccgacgugguaaacaacagcagcccagcacugggcggcacguuuccuccagcuccuugguggccaccggggccuccccccacuaacuuuucuagccuggaacuggagccaagaggucagcaaccggucgccaaagcugaaggcagccccaccgcuauucuaauugggugccuggucgcuaucauacuacucuugcuucugauaauugcccugauguuguggagauugcauuggcgccggcuguugagcaaggcagaacggcggguucuggaggaagaacugacaguacaccucagugucccaggcgacaccauccuuaucaacaaucggccaggaccuagagagccacccccauaucaagaaccacguccucgaggaaaccccccacacucagcuccauguguucccaacggcucggccuauagcggagauuacauggaaccagagaagccaggugccccacuucuuccccccccaccccaaaacucaguaccccacuaugccgaagcggauaucgugacucuucagggugugacaggcggcaauaccuacgcugugccugccuugccuccuggugcaguaggugacggaccuccccgcguggauuuuccucgcucucgguugagguuuaaagagaaguuaggcgagggccaguucggcgagguucaucuuugcgaagucgacucaccccaagacuugguuucccucgacuuuccucugaacgugagaaaagggcauccccugcuuguggcuguaaagauacuaaggccugacgcaacaaagaacgccaggaaugauuucuuaaaagaggugaagaucaugucccgacugaaagacccaaauaucauccggcuccugggagugugugugcaggaugacccgcuguguaugaucaccgacuauauggaaaauggagaccucaaccaguuccuguccgcucaucaauuggaagauaaagccgcugagggcgcuccaggcgauggccaggcugcgcaaggucccaccauuuccuauccuauguuacuacaugucgcugcucagauugcuaguggcaugcgauaccuggcuacgcuuaacuuugugcacagagaucuagcgacgcguaacugccucgugggcgaaaacuucacuaucaaaauagccgauuuuggaaugucacgcaacuuauacgccggcgacuacuacagggugcaagggagagcaguccuuccaauuagguggauggcaugggaguguaucuuaauggggaaauuuacaacagccagcgauguuugggcuuuuggagucacacuuugggagguucuuaugcugugucgcgcucagccauucggacagcuuaccgacgaacaggucaucgagaaugcaggggaauuuuuuagagaucaaggcaggcaagucuaccuuucaagaccacccgcuugcccccaaggauuauacgaacucaugcuucgcuguuggucuagggagagcgaacagagaccgccauuuucccaacugcaccgguuucuggcugaagaugccuugaauacagucuag

SEQ ID NO: 14736 - RNA, 1257 nt, Artificial Sequence
  Description of Artificial Sequence: Synthetic coding sequence
augagaacucucuucaacuugcuguggcucgcacucgcuugcuccccugugcacacuaccuugaguaagagcgaugcaaagaaggcugccagcaaaacacugcuagagaaggugaaguuuugcuccuguugccccgguuggucugcaauggcucgguccuggcuuacagcuacuucugcgacacagagccaauucagcgauaagccuguucaagaccgaggacugguaguuaccgaucuaaaggcagaguccguggugcucgagcaucgaucuuauuguucagcuaaagcucgcgaucggcacuuugcuggagacgugcugggcuacgugacgccuuggaacucccauggauacgacgugaccaaggucuuuggcagcaaguuuacacagauuagccccguguggcugcaauugaaacggcgagggagggagauguuugaggugacagggcuacaugauguggaucaaggguggaugagagcugugaggaaacaugcuaagggacugcacaucgugccuagacucuuguuugaggacuggaccuaugacgacuuccguaaugugcucgacucugaagacgaaaucgaggaacuguccaaaaccguuguucaggucgccaaaaaccagcacuuugauggcuuugugguagaaguuuggaaccagcuguugagccaaaagcggguaggccugauucauaugcugacacaccuugcagaggcccugcaccaagcacguuugcuggccuuacuaguaaucccuccugccauuacucccgguacugaucagcuggggauguuuacacauaaagaauucgagcagcuugcgccuguguuagacgguuucagccucaugaccuacgacuacuccaccgcgcaccagcccgggcccaacgcacccuugucuugggugcgugcaugugugcaaguccuugacccaaaaagcaaguggaggagcaagaucuuacuugggcugaauuuuuacgggauggacuaugcaacuagcaaggacgcccgcgaacccguaguuggagcccgauacauccagacacugaaggaccaucgcccccguauggugugggauucgcaggcaagcgagcauuuuuuugaauauaaaaaaucccgcucaggaagacaugugguguucuauccaacucucaaaagucuccaggugcggcucgaacucgcucgggaacuuggcguuggaguuaguaucugggagcuggggcagggacuggauuauuuuuaugaccucuuguag

SEQ ID NO: 14737 - RNA, 390 nt, Artificial Sequence
  Description of Artificial Sequence: Synthetic coding sequence
augcgcaagcccaggaggaagucccggcagaacgcggaggguagaagaaguccuucuccuuacagccucaaaugcucuccaacucgcgaaacucugacuuaugcacaggcacagcgcaucguagaaguagauauugauggcagguuacaccgaauuucgaucuacgauccucucaagaucauaacagaagacgaacucaccgcgcaggacaucacagagugcaacagcaacaaggaaaauucagaacagccacaguuccccgguaagucuaagaaacccucaaguaaaggaaagaaaaaggagucuugcuccaaacacgcguccggcacuucauuucaccucccccaacccucuuuucguaugguggacucaggaauucaaccugaauag

SEQ ID NO: 14738 - RNA, 315 nt, Artificial Sequence
  Description of Artificial Sequence: Synthetic coding sequence
augcgaguagugacuauagucauccuccugugcuuuugcaaagcagcagaauuaagaaaagcuagccccgguagcgugcgaucucgaguaaaucauggacgggccggugggggaaggaggggaucaaauccagugaaacgauaugcucccggacugcccugcgacguuuauacguaccuccacgagaaguaccucgauugccaggaacggaaacuaguauauguguuaccaggguggccccaggaccuacugcacaugcuccuugccagaaauaagaucaggacacucaagaauaauauguucucuaaguucuag

SEQ ID NO: 14739 - RNA, 639 nt, Artificial Sequence
  Description of Artificial Sequence: Synthetic coding sequence
gacuucggguacuguccccgaguguauugcgaaaaccaacccaugcuaccaaucggaguucucguaauggucggguucacugugggcaaaguccccgugccagauauuagaaccugucauuuuugucuaguugaagacccaucgguggggugcauaucuggauccgaaaaguguaccaucucuucuuccagcuuaugcaugguuauaaccauauacuacgacgucaaagugcgguuuaucguuagaggcugcggccaguauauuuccuaucgaugccaagaaaaacgaaacacauauuuugcagaauauugguaucaggcacagugcugucaauaugauuauugcaacaguuggucuagcccgcagcuacagucuagccuccccgagccccacgaucgacccuuggcucucccuuugucugacucccagauucaaugguuuuaucaagcccuaaaccucagucuuccccugcccaacuuucaugccgggacugagccugauggacuggaucccauggucacgcucucacucaacuugggccuuucauuugcagaguugcgcaggauguauuuguuccucaauuccuccggccugcucguccucccccaggccggauuacucacuccucaccccucuuag

SEQ ID NO: 14740 - RNA, 1005 nt, Artificial Sequence
  Description of Artificial Sequence: Synthetic coding sequence
augcuggcuuuagcuaaaauccugcucaucucuacccuauucuacucccuguugagcgguucucacggaaaagaaaaucaggacauuaauacuacacagaacaucgcagaagucuucaaaaccauggaaaauaaacccauaagucucgaaagugaagccaaucucaacucagauaaggaaaacauaacaacaucgaaucugaaggccucucauucccccccccuaaacuuacccaacaacucacacggcauaaccgacuucucuagcaacuccuccgccgaacacucgcugggaucccugaaaccaaccaguacaauaucuacgucuccgccacugauccauaguuuugucagcaaagugcccuggaaugccccuaucgcugacgaagaucuccuucccauuuccgcgcacccuaaugccacaccggcccucaguucugagaacuuuacaugguccuuagucaacgacacuguuaagacacccgacaacucauccauaacgguuucaauucuguccuccgagccgacaucucccucugucacaccauugaucguagagccaaguggauggcucaccacuaacuccgacagcuucacaggguuuaccccuuaucaagaaaaaacaacucugcagccaacucuuaaauucacaaacaacuccaagcuuuucccaaacaccagugauccccaaaaggaaaaucggaauacaggaauaguuuucggugccaucuugggugcaauccuuggugugucccuguugacccuggugggauauuugcucugcggcaaaaggaagaccgauagcuuuucccauagacgauuguaugacgauaggaaugaaccaguccugcgccuggauaacgccccugaaccuuaugacguguccuuugguaacagcagcuacuauaauccgacacugaacgauagcgcaaugccagagagcgaggagaaugcaagagacggaauuccuauggaugacauaccuccccugagaaccuccguguag

SEQ ID NO: 14741 - RNA, 987 nt, Artificial Sequence
  Description of Artificial Sequence: Synthetic coding sequence
auggggccugcaggaugcgcuuuuacucuccugcuccuccucggaaucagugugugcggacagccggucuacucuaguagggucgugggcggccaagacgcagcugcaggaagauggccauggcaagucagucugcauuucgaucauaauuuuauuuguggcgguucucuaguuagugaaaggcucauacucaccgcugcucauuguauccagccgacuuggaccacauuuucuuauacuguguggcugggaucuauuacaguuggugacagucgaaaaagagugaaguauuacgucuccaagaucgucauccacccaaaauaucaggacacuaccgcagacgucgcacuccugaaacucucuucccaggucaccuuuacaucggccauuuuaccgauaugucuucccucaguaacaaagcagcucgcuauaccccccuucugcugggucacaggguggggaaagguaaaagaaucaucagaccgggauuaucauagcgcucuccaggaagcagaagugccaaucauagacaggcaagcaugugaacagcuguauaacccaaucggcauuuuucucccagcuuuggaaccggugauuaaggaagauaagaucugugcuggcgauacacaaaacaugaaggauagcuguaaaggugauucugguggcccacuaucaugccacauugacgguguuuggauacagacuggggucgugaguuggggucucgaaugcgggaaauccuugccgggcguguacaccaacgugauuuacuaccaaaaauggaucaaugcaacuaucucgcgagcaaauaaccuagacuucucugacuuucuguucccuauuguccuuuugucucucgcccugcugaggccauccugugcauucgguccuaacaccauccacagagucgggaccguagcagaagcaguugccuguauucaagggugggaagaaaacgccuggagauuuucaccuagaggccgguag

SEQ ID NO: 14742 - RNA, 453 nt, Artificial Sequence
  Description of Artificial Sequence: Synthetic coding sequence
augcgcuuuauggccggccccgccgggucccaaagcuuagguccccucuguuuucauucuaguccccaggcacuguauaccgugcugcugauugugcucguuaugaugucacugguguucggaaaguuugugccagucaauugggagccuccccagccucugcccuucccaaaauaccuucgcuguuaucgcugucugcuggagacaaaagaacuuggcugccuccuuggcagcgacauuugccugacccccgccggaucaagcugcauuacucuccacaagaagaauuccucuggcuccgaugugauggucagcgacugucguuccaaagaacaaauguccgauugcagcaauacaagaaccuccccaguuagcgguuuuuggaucuucucucaauacugcuuuuuggauuucuguaaugauccccaaaaccgcggguuguauacacccuag

SEQ ID NO: 14743 - RNA, 234 nt, Artificial Sequence; identical to SEQ ID NO: 13104
  Description of Artificial Sequence: Synthetic coding sequence

SEQ ID NO: 14744 - RNA, 1143 nt, Artificial Sequence
  Description of Artificial Sequence: Synthetic coding sequence
auggcccucacucccggcuggggaaguagcgccggccccguucgcccugagcugugguugcuccugugggcugcugccuggaggcugggagccagugcaugcccagcacugugcacuugcaccggcacuaccgucgauugccauggaacgggcuuacaagcuaucccuaaaaacauaccaagaaacaccgagcgacuagaacugaaugguaauaauaucaccaggauccauaagaaugauuucgccgggcuaaagcaacuccgaguauugcagcugauggaaaaucagauuggcgcgguugaaagaggcgcauuugaugauaugaaagaacucgagcguuuagaccugagcgagaaugcaauccaggccauccccaggaaggcuuuuagaggggcaaccgaccugaaaaaucuucaacuugacaagaaccaaaucaguuguaucgaagaaggggcguuccgggcucugcgaggacuggagguacugacucuuaacaacaauaauaucacaacuauaccaguuucuucguuuaaccacaugcccaaacugcguaccuuccgacuucacuccaaucaucucuucugugauugucaccucgccugguuaucacaguggcuccgucaacgaccaaccauuggccuuuuuacacagugcucuggacccgccagucugcgagggcucaauguugccgaggugcagaaauccgaauucucuuguagcgggcaaggggaggccggucgcguccccacuuguacuuugucuaguggaucauguccagccaugugcacauguagcaacgggaucgucgauugucggggaaaaggacugacugcuauuccagcuaaucugcccgagaccaugacggaaauccggcuugaacugaacggcaucaagaguaucccuccuggggcuuuuucaccauaccggaagcugcgaagaauagaucucucaaauaaccagaucgcugagaucgccccugacgcauuccaaggacugagaucuuugaauucuuugguccuguacggaaauaaaauuaccgacuugccuagagggguuuuugguggccuuuauacacugcaacugcuguuacuuaacgccaauaagaucaauuguauacgcccagacgcuuuccaagaccuguag

SEQ ID NO: 14745 - RNA, 558 nt, Artificial Sequence
  Description of Artificial Sequence: Synthetic coding sequence
augccugguuggcuuacacuuccuacccuaugccgcuuucucuugugggcuuuuacaaucuuccacaaagcacaaggagacccagcaucccaccccggcccucacuaccuccucccaccaauccacgagguuauacauucgcacaggggagcaacagccaccuuaccaugcguguuggggacgacaccaccaaguuacaagguuagauggagcaaagucgaaccuggggaacuuagggagacacugauccucauuaccaacggcuugcacgccagaggcuauggaccauuaggcgggagagcaagaaugaggcguggucaccgucuugacgcgucucuagugauugccgggguccggcucgaagacgagggaagauaucgcugugaacugauaaacgguaucgaggaugaaucgguggcccugacccucagucucgaaggaguuguguuccccuaucaaccgucaagaggcagauaccaguucaauuacuacgaagcgaagcaggcgugcgaagagcaagauggucgucuggcaacauauucucaacuguaucaguag

SEQ ID NO: 14746 - RNA, 375 nt, Artificial Sequence
  Description of Artificial Sequence: Synthetic coding sequence
auguuaaugcuguucguuuucggcguucuucuucacgaagugucccuaagcggucagaaugaggccccaccaaauacacacagcaucccuggggaaccacucuauaauuaugccagcauuagacucccagaagaacacaucccuuuuuuccuccacaacaauagacacaucgcaacugucugucggaaggacagucuuuguccuuacaagaaacaucucgagaagcugaaguacuguuggggcuaugaaaaaucuuguaagccugaguuccguuuuggcuacccgguauguuccuacguagacaugggauggacugacacucuugaaagcgcugaagacaucuuuuggaagcaggccgauuuuggauaugcauag

SEQ ID NO: 14747 - RNA, 5859 nt, Artificial Sequence
  Description of Artificial Sequence: Synthetic coding sequence
augccugcucuuggaccugcccugcuacaggccuugugggcaggcuggguacuuacacugcagccccuccccccuacggcguucacuccuaauggaacauaucuucagcaucucgcacgggacccaacaagugguacauuguaucuaggagccaccaauuuucuuuuccaacuuagccccggccuucagcuggaagcuaccgucucuacuggcccaguucuugacucucgggacuguuugccuccugucaugccugacgagugcccucaggcccagcccacuaacaacccuaaucagcuucugcuggucucgcccggcgcccucguuguguguggaucaguucaucaggguguuugugagcaacggcgacugggacaauuggaacagcuccuucugcgcccggaacgcccuggagacacacaauaugucgcagcgaaugaucccgccgucucgaccguuggccuaguugcucagggacuggcgggggaaccauuguuguucguuggucgcggcuauacuucucgaggggucggcggagguaucccuccaaucacuaccagagcauuguggccaccugauccccaagcggccuucucuuaugaagagacagcuaaacuugcuguuggccggcugucagaguacagccaucacuucguuagugcuuuugcucgcggagcuuccgccuacuuccuguuccugcgccgagaucugcaggcccaaucccgugcguuuagagcauacguaucaagagucugccuccgcgaccaacauuacuauucauacguagagcuaccacucgcuugcgagggagggcguuaugggcucauccaagccgcugcuguggccacaucacgagagguugcccauggggaagugcuguucgcagccuucaguagugcagcccccccaacuguggguaggccaccuuccgccgcagcuggcgcuuccggagcuagcgcccucugugcuuucccacuagacgagguugaucgacuugccaauagaacucgcgacgccugcuacacaagagaagggagagcugaggauggaacugaaguagcuuauaucgaauacgacguaaacucugauugugcucaguugcccguggacacacuggacgccuauccauguggauccgaucauacaccgucuccuauggcgucacgcgugccuuuagaagccaccccgaucuuagaguggcccggcauccagcugacugcugucgccgugacuauggaagacggccacaccauugcauuuuugggagauagucagggccaacuucaccgcguuuaccuaggucccggcagugaugggcauccauauucaacccaguccauucagcagggcucagcuguguccagggacuuaacuuuugaugggacauuugagcaucuguacgucaugacucaauccacccugcucaaagugccuguugcaucaugcgcucagcaccuugauugcgcuucauguuuagcacaucgggauccuuacugcggauggugcgugcuccugggacgcugcucaaggagaagcgagugcuccagaggacaaggaccugagcagugguugugguccuuccaacccgaacuugguugucuccaggucgcagccauguccccugcaaauaucucaagggaagagacuagggagguguuccuaagcgucccagaccucccuccauuauggccuggcgagucauacucuugccauuucggcgaacaccagucccccgccuugcuuacgggcuccggcgucaugugucccagcccugacccaucugaggcucccguucuaccccguggugcagacuaugucucaguaucuguggaacuccgguuuggggcugugguuauugcaaagacuucccucucguuuuaugauuguguugccgucacugaacuccgucccucugcccagugccaggccugcguaucgagucgcuggggguguaauuggugcgucuggcagcaucuguguacacacaaggccuccugcgaugcgggacccaugguagccagucaucaaaguccccugguuagcccagauccaccggcacggggugacggugauucagccgaauuagaaggacccccugccccucugauccucccuucuagccuugacuaccaguaugacacuccuggccuuugggagcucgaagaagccacauugggugcuucuuccuguccaugcguugaaaguguccaaggaaguacuuugaugcccgugcacguggaaagagagauuagacuauugggcagaaaucuccaucuuuuccaggacggccccggagauaacgagugugugauggagcuagaaggacuugaggucgucguggaggcaagaguagaaugugagccaccaccugacacacagugccacgugacaugucaacagcaccaguuguccuacgaagcccuccagccagaacuucguguuggcuuguuccuacgccgggcaggaagacugcgaguggauucugcugagggacugcaugugguucuuuacgacuguagcgugggccacggcgauuguucacgaugucaaaccgcuaugccgcaauaugggugcguauggugugaaggcgaacgcccuagaugcguuaccagggaagcuugcggggaggccgaagcuguggcaacccaaugccccgcucccuugauccacagcgucgagccauuaacagguccuguggacggcggcacaaggguuacgauuaggggaagcaaccugggucagcacgugcaggauguguuagguauggugacggucgcagggguaccuugcgcaguagacgcacaagaauaugaggucucuagcucucuagucugcaucacaggggccaguggagaagagguggcaggugcuacugcgguagagguaccagguagaggacgaggggucagugaacacgauuuugcuuaucaggaucccaagguccacagcauuuuccccgcccgggggccaagagcaggcgggacaaggcugaccuugaauggauccaaacuguuaaccgggagauuagaagauauucgaguaguggucggagaucaacccugccaucuguuaccugagcagcaaagcgagcagcugaggugugaaacaagcccccgccccacaccggccacucucccaguugccguuugguucggugcaacggagcggcggcugcagcgaggccaguucaaauacacucuggacccaaauauuaccagugcgggcccuacaaagaguuuuuuaagugggggaagagaaaucugcguucgaggucaaaaucuugauguggugcagaccccccgaauucgugugacaguugucucuaggaugcuccagcccucacagggccucggaaggaggagaagagucgugccugagacugccugcucccuuggaccuucuuguagcucccaacaguucgaggaacccugccacgugaacagcucacaguuaauaaccugccguacgcccgcauugcccgggcuucccgaagaccccugggugagaguggaguuuauucuggacaaucucguguuugauuuugccaccuugaacccaacacccuucaguuacgaggcugauccuacacugcagccacuaaauccugaagaccccaccaugccuuuuagacauaaaccagguucuguuuucagcguugagggggagaaucuugaccucgcuaugaguaaggaagaaguagucgccaugauuggagacggccccuguguggugaaaacccuuacccggcaccacuuguacugugaaccaccuguggaacagccccugccccgucaccaugcacugagagaggcaccagauucucugcccgaguucacugugcagauggguaacuugcgauuuucccucggacaugugcaauacgauggcgagagcccaggagccuucccagucgccgcucagguaggccugggaguuggaacaagcuuacuggcacugggcguuauaauuauuguucuuauguauaggagaaaguccaaacaggcuuugagggauuacaagaaaguccaaauucaguuggaaaaccuggagucaagugugcgugaccgaugcaagaaggaguuuaccgaccucaugacagagaugacagaucugacuuccgaucuacuaggcucagguaucccguuucuugacuauaaaguuuaugcggagaggaucuuuuuuccgggccaucgcgaaaguccauuacaccgugaucuaggaguccccgagucuagacggccgacaguggaacaaggccugggccagcuaucaaaucuguugaacucaaagcucuuucugaccaaguuuauccacacccuugagucucagcgcaccuuuuccgcccgugaucgcgccuauguggcaucccuucuuacggucgcccuucacggcaaacuggaauauuucacugauauauuacggacccuucucucugaucuugucgcgcaguauguagcaaaaaacccaaaacucauguuacgucgaaccgaaacagugguagagaaacuacugacaaauuggaugaguauuugucuauacaccuuuguaagggauuccguuggagagccucuauauauguuguuccggggaaucaagcaucagguggauaagggcccaguugacucaguuacuggaaaagcgaaguacacucuaaacgacaaccggcugcuucgagaagaugucgaguauaggccccucaccuugaacgcacuacuggccgugggcccuggagcgggugaagcgcagggggugcccgucaaaguccucgacugugauacgauuagucaggcuaaagaaaaaaugcucgaccaauuguacaaaggggugccucucacucagcgcccagauccaagaacucuagacguggaguggagaaguggcguugcuggacacuuaauucucucugacgaggaugucacaagugagguccagggccuguggcgccgccugaauacccuacagcacuauaagguucccgauggcgcgacuguagcccuagugccaugccuuaccaaacacguauugcgggagaaucaggauuacguacccggcgaacgaacccccaugcucgaggacguggaugaagggggaaucagaccguggcaucuggugaaaccuagcgacgagcccgaacccccuaggcccagacgcggaagccuucgcgggggagaaagagagagagccaaagcuaucccagaaaucuacuuaacuagacuucugagcaugaaaggaacucuucagaaauucguggacgaucucuuucaagugauacugucaaccucucgacccguaccccuggcuguuaaguauuucuucgacuuacucgaugaacaggcccaacaacauggaaucuccgaccaggacaccauucacauuuggaagaccaauucccuaccauugagguucuggaucaauauuauuaagaacccacaguucguauucgauguccagacuuccgacaacauggacgccguccuucuagucauugcacagacauucauggaugccugcaccuuagcugaucacaaacuaggacgagauagcccgaucaauaaacugcucuaugcccgcgauaucccaagguacaaacggaugguggagcgcuacuaugccgacauucgccaaacgguaccggccucagaucaagagaugaauaguguccucgccgaauuguccuggaacuacaguggagaccugggcgcgagaguugcccugcaugaauuauauaaguauauuaauaaguauuaugaccagauuauuacagccuuggaggaggacggaacagcacaaaaaaugcagcugggauacagauugcagcagauugcggcagccguggagaauaaagugacagacuuauag

SEQ ID NO: 14748 - RNA, 612 nt, Artificial Sequence
  Description of Artificial Sequence: Synthetic coding sequence
augcgcacuguaguguuaaccaugaaggcaagcguaaucgaaauguuucugguucuccuugugaccggggugcauagcaauaaagagacugccaagaaaaucaaaaggccuaaguuuacugugccacaaauuaauugcgacguuaaggccgguaagauuauugaccccgaauucauugugaaauguccagcaggcugccaagacccgaaauaccauguguaugguaccgaugucuaugcuagcuacucaaguguguguggagcugccguucauuccggcguuuuagacaauagcggcgggaagauucugguucggaaaguagccggucaaaguggauacaaaggaucuuauucaaauggugugcagucucugagccugccaagguggcgggaaucauuuaucguccuggaaaguaagccuaaaaaaggaguuacauacccgagugcucuaaccuauagcucuucaaagaguccugcagcacaagccggcaaguguagccgggucauugagucuaaacccuccgagagcaugaacacgcgcagagugcugggagauaguggagaaauuaacauucugacuggccaagcgccacuggccuuagccauuuucuag

SEQ ID NO: 14749 - RNA, 2511 nt, Artificial Sequence
  Description of Artificial Sequence: Synthetic coding sequence
auggaaacucaagaacuccgcggugcuuuggcuuuacuguugcugugcuucuucacaucugccagucaggaccuucaagugauagacuuacuuacuguuggugaaucaaggcagaugguggcagucgcugaaaaaauuaggacagcacugcuaacugccggggauaucuaccugcuuuccaccuuuagauugccccccaaacagggcggagugcuguucggcuuauauagucgucaggauaauacacguugguuggaagccucagucgucgggaaaauuaauaaagugacaaacgcccugcauaguauccugggagaacaaacgaaagcauuaguuacucaguugacacuguucaaccagauucucgucgaguuacgggaugacaucagggaucaaguuaaggagaugagucuuauccgaaauacaauuauggagugucaagucuguggcuuucaugagcagcgaagucauugcagccccaacccuuguuucaggggaguggauugcauggaaguauaugaauauccuggcuauagaugcggucccuguccacccggucuacaagguaaugggacacauugcucugauauaaacgagugugcucacgcagauccaugcuucccaggcuccagcugcauaaacacaaugccugguuuucacugugaagccuguccucgaggauacaaagguacucaggugucaggagugggaauugacuaugcccgcgcaaguaagcaaguaugcaaugauauugacgaaugcaaugacgguaauaauggcgguugugaccccaacucuaucuguacaaacacugucgggucguuuaagugcggaccaugcaggcucggcuuuuuaggcaaucaaagccagggcugccuuccggcuagaacuugccauagccccgcccacucgcccugucauauucaugcacacuguuuguucgagagaaauggcgcugugucaugucaguguaauguuggcugggcaggcaaugggaaugugugcgguacagacaccgacaucgauggcuauccagaucaggcccugccuuguauggacaauaacaagcacugcaagcaggauaauugucuccucacacccaacucaggccaagaggaugcagauaacgacggaguaggugaccagugcgacgacgacgccgauggcgacggaauuaagaauguggaagauaacugccgguuauuuccaaauaaagaccagcagaauuccgauacugauagcuucggcgacgccugugacaacugucccaauguacccaacaaugaccagaaggacacagacgguaacggagaaggggacgcuugugacaaugacguggacggugacgggauccccaauggcuuagacaacugcccaaagguacccaacccccuacaaacggaccgagaugaagacgggguaggcgaugcaugcgauuccugcccagaaauguccaacccaacacagacugaugccgacuccgauuuggugggcgacgugugugacacaaacgaagauuccgacggugaugggcaccaggauaccaaagauaauuguccccaacuucccaauagcucgcaguuggauagcgacaaugacgguuugggcgacgaaugcgauggcgaugacgacaacgauggaauuccagacuauguaccuccaggaccagacaacugccgccuugucccaaauccaaaucagaaggauagcgacgguaacggcgugggagauguuugugaagacgacuuugacaacgacgcuguaguagacccuuuggauguaugccccgaaucugccgaagugacguugacggacuuuagagcauaccagacugugguuuuggaucccgaaggagaugcccagaucgauccaaauugggugguucuuaaucaaggaauggaaauaguacagaccaugaauagugaucccggccuggcggugggcuauacagcuuucaauggcguugacuucgaggguaccuuccacgugaacacagugaccgaugacgacuacgcaggauuucucuuuagcuaucaggacucaggacgauuuuaugucgugauguggaaacagacagagcagaccuacuggcaggcaacaccguuccgugcgguugcucaacccgggcugcaacugaaagcugucacuucugucucaggaccgggugaacaucuucgaaacgcauuauggcauaccggacacacuccagaccaggugagacuucuguggacugauccccgaaaugugggcuggagggauaagacuuccuaccgauggcagcuucuucaucgaccacaagugggauauauccgggucaagcuuuacgaagggccucaguugguagccgauucugguguaauuauugauaccucaaugaggggaggcagguuaggagucuuuuguuuuagucaggagaacauaaucuggagcaacuugcaauauagaugcaacgacacagugcccgaggauuucgaaccguuuagaagacaauugcuacaaggacgcgucuag

SEQ ID NO: 14750 - RNA, 1311 nt, Artificial Sequence
  Description of Artificial Sequence: Synthetic coding sequence
auguggagaugcccccucggucuccuacucuuacugccucuagccggccaccucgcauugggagcccagcagggccgcggaagaagggaguuagcccccggacugcaucugcgggguaucagagaugccggcgggcgcuacugccaagaacaggacuuguguugccggggccgggccgaugacugugcacugcccuaucugggagccauuugcuauugugacuuauuuuguaaccggacggugagugauuguuguccugacuuuugggacuucugucuagguguaccuccaccuuucccaccaauccagggcuguaugcaugguggccggaucuacccugugcuuggcacuuacugggauaacugcaauagaugcuggcaagccggaaaccacucugcauuuuggggaaugacucuggacgaagggauccgauauagauugggcacaaucaggcccucauccuccgugaugaacaugcacgaaauuuauacuguccugaaucccggugaagugcugccuaccgcguucgaagcgucugaaaaauggccuaaucuuauucacgagccucucgaucagggaaacugcgccgggucaugggcuuuuucuacugccgccgucgcuucugaucggguuuccauccauagucuaggccacaugaccccuguguugagcccacagaauuuacucucaugcgauacucaccagcagcagggauguaggggcggcaggcuggauggcgcuuggugguuuuugagaaggaggggcgucgugucugaccacuguuaccccuuuucagggcgggaaagagaugaggccggcccugcuccucccugcaugaugcauagccgggcaaugggcagagguaaaagacaggccaccgcgcauugcccaaauucauacguaaacaauaaugauauuuaccaggugacccccgucuaccgacuggguucuaaugacaaagagauuaugaaggaacugauggagaacggcccuguccaagcacuuauggagguccacgaggauuucuuucuguacaagggaggcauuuauagucauacacccgucucacucggccgcccagaacgauaucgccgacacggaacccacagcgucaaaauaaccggcuggggagaggaaacauugccagauggccggacucugaaguacuggaccgcagcaaauucuuggggucccgcguggggagagaggggacauuuucgcauaguuaggggcgucaaugagugcgauaucgaaucuuuuguguugggcguuuggggaagggugggaauggaagauaugggucaucacuag

SEQ ID NO: 14751 - RNA, 942 nt, Artificial Sequence
  Description of Artificial Sequence: Synthetic coding sequence
augucugaucuguuacugcugggacuuauugggggccugacucuccugcugcugcugacauuauuggcauuugcaggcuauucugggcuucucgcugggguagaagugucugcugguagcccgccgauuaggaacgugaccguugcauacaaauuucacaugggucuuuauggugagacaggacggcucuuuacggaaucuugcaguauuaguccaaaacuccgcucuaucgcugucuauuaugauaauccccacaugguuccccccgauaaaugcaggugcgccgugggaaguauccugucugaaggcgaagaaucccccucuccugagcuuauugacuuguaucaaaaauucggcuuuaaagucuucuccuucccagcuccuagccauguuguuaccgcuaccuuuccguauaccaccauccucagcaucugguuggccacuaggcgugugcauccugcauuggauacauauauuaaggaacgaaaauugugugccuacccacggcuggagaucuaucaagaagaccagauucauuuuaugugcccgcuagcuagacagggcgacuucuacgucccugaaaugaaggagacagaguggaaguggcggggauugguagaggcaauagauacacagguugacgggaccggagccgacacuauguccgacaccagcagcgucagucuagaggucagcccaggcagcagggagacgucagcagcaacuuugagccccggggcaucaucaagagggugggacgauggagacacacgaagugaacauagcuacagcgaguccggcgccagugguaguuccuucgaggagcuggacuuagaaggugaggggccccugggggaaagccggcucgacccaggcacagagccucucggcacaacuaagugguuaugggaaccaaccgcuccagagaaagggaaagaguag

SEQ ID NO: 14752 - RNA, 213 nt, Artificial Sequence; identical to SEQ ID NO: 13113
  Description of Artificial Sequence: Synthetic coding sequence

SEQ ID NO: 14753 - RNA, 642 nt, Artificial Sequence
  Description of Artificial Sequence: Synthetic coding sequence
auggcucaacucuuccugccucuccuugcagccuuggugcuggcccaagcaccagccgcucucgcugaugugcuggaaggcgacucaagugaagaccgggcauuccgcgugagaaucgccggugacgcuccucugcagggugugcuagggggggcguuaacaauucccugccaugugcacuaucuuagacccccuccuucucgccgagcuguucuuggaucaccacgcgugaaauggacauuucucucccgcggacgugaggccgaggugcugguggcuagaggcgugcgcgugaaaguaaacgaagcguaucgauuuagaguggccuugcccgcuuacccugcaagucuuaccgauguuucacuggcuuuguccgagcuccggcccaaugacucugguaucuaccggugcgagguacagcauggaauugacgauagcagcgaugccguggaggugaaaguuaaagggguuguguuucucuaucgcgaagggagugcucgguacgccuuuaguuuuuccggggcacaggaagcaugugcuagaauuggcgcucauaucgccacaccagagcagcucuacgcagcauaccugggcggauaugaacaaugcgacgcuggcuggcuuucugaucaaaccguuuag

SEQ ID NO: 14754 - RNA, 237 nt, Artificial Sequence; identical to SEQ ID NO: 13115
  Description of Artificial Sequence: Synthetic coding sequence

SEQ ID NO: 14755 - RNA, 651 nt, Artificial Sequence
  Description of Artificial Sequence: Synthetic coding sequence
auguccgaucugcuccuuuugggucucaucgggggucugacccuuuuauugcuccugaccuugcuggccuucgcaggauauucaggccugcucgcuggaguagaaguaucugccggcucuccaccaauccgcaauguuacugucgcguacaaguuccacaugggccuguauggggaaacugggagacuguucacugagucaugcucuauaagcccaaaacugagaucaauagcuguauacuaugauaacccccacauggugccuccagauaaauguaggugugccguagguucaauucuguccgaaggugaggaauccccuuccccggaauugauugaucuuuaccagaaguucggcuuuaagguguucucauuuccagcucccagccacgucgugacugccaccuuuccuuauaccaccauccugaguauuuggcucgcuacccgccgcguucaccccgcucuugacaccuauaucaaagaacgaaagcuuugcgccuacccucgccuggaaaucuaucaggaggaccagauccacuucauguguccauuagcgcgccagggugacuuuuacguuccugagaugaaagagacagaauggaaguggagagggcuaguugaagcgauagauacucagguagauggcacauag

SEQ ID NO: 14756 - RNA, 453 nt, Artificial Sequence
  Description of Artificial Sequence: Synthetic coding sequence
augcgguuuauggcaggaccagcugguucccagagucuuggaccucuguguuuccauucuuccccccaggcucuguauaccgugcuccucauagugcucguuaugaugucacucguguuuggcaaguuugugcccgugaacugggaacccccccagccucugcccuuuccuaaguauuuacgcugcuacagauguuuguuggaaaccaaagagcuaggcugccuucuuggauccgacauauguuuaaccccugccggcagcagcugcauuacacuacacaaaaaaaauucgucaggaucugauguuaugguauccgacugcaggucuaaagaacaaaugagugauugcagcaauacacgaaccucuccuguuucaggcuucuggauuuuuucgcaguacugcuuccuggauuuuuguaaugauccccagaaccgaggauuauauacucccuag

SEQ ID NO: 14757 - RNA, 171 nt, Artificial Sequence; identical to SEQ ID NO: 13118
  Description of Artificial Sequence: Synthetic coding sequence

SEQ ID NO: 14758 - RNA, 2346 nt, Artificial Sequence
  Description of Artificial Sequence: Synthetic coding sequence
auggcagucgccgagguaagcagaacaugucuacuuaccgugcgcguccugcaggcucauagauugccuuccaaagaccucgugacuccuucagauugcuacgucacauuauggcuaccuaccgcuugcucgcauaggcuccaaacaagaacagucaaaaauuccuccucuccuguguggaaucagaguuuucauuuucguauucacagacagcucaagaauguuauggaacuaaagguauucgaccaagacuugguuaccggggacgaccccguacuguccgugcucuuugaugcaggcacccuuagagccggcgaauuucggagagagagcuuuucacuauccccccagggcgaggguaggcuagaagucgaauucagauugcaaucuuuggcugaucguggcgaauggcuggugagcaaugggguucucguagcaagagaacuuaguugucuccacgugcaguuagaagaaacuggggaccaaaagucuagugaacacagagugcagcugguugugccagguagcugugagggcccacaggaggcgaguguugguacagguacuuuucgcuuucauugccccgcauguugggaacaagaauuaagcauucgacuucaggaugcacccgaggagcaacugaaagccccauuaucugcgcugccaagcggucaagucgugcgccuggucuuuccgacuagccaggagccccugaugcggguggagcugaaaaaggaggccggauugcgagaacuugcagugagacuuggauucggcccaugugccgaagagcaagcauuccucagccgucgaaaacagguuguggcagcggcuuuaaggcaggcccuacagcuggauggagauuuacaagaagacgagaucccagugguggccaucauggcuacaggcggcggaauaagagccaugacaagucucuacgggcagcucgcaggcuugaaggaacucgguuugcucgacugugucuccuacaucacgggcgccucaggcucaacuugggcuuuagcgaaccuguaugaagacccagaguggucgcagaaggaucuggccggcccuacugaacuguuaaaaacacaagugacuaaaaauaaacucggaguauuagccccuucucagcugcagagauaccgacaggaacuggccgagcgggccagguuaggcuacccaucaugcuuuaccaaccugugggcucugauuaaugaagcuuugcugcacgaugagccacacgaccacaaacugagugaccaaagggaagcccuaucacacggccaaaacccacuaccaauuuacugcgcgcucaacacaaagggacagucuuuaacaacguuugaguucggggaguggugcgaauuuucacccuacgagguggguuuuccuaaguauggagccuucauuccuucggaguuguuuggaagugaauucuucaugggccaguuaaugaaacgucugccggaaucucggaucugcuuucuggaagguauuuggagcaaucuuuaugcugccaaccuccaggacucacucuauugggccuccgaacccucucaauuuugggaucgcuggguccggaaccaggcuaauuuggacaaggaacagguuccccuguugaagaucgaagagccaccuucuacugccggucgcauagcugaauuuuuuaccgaccuccuuacauggagaccucuggcccaagcuacacauaacuuucuacgaggacugcacuuccacaaagauuacuuucaacauccccauuucagcaccuggaaagcuacaacgcuggaugguuuaccuaaucaguugacaccuagcgaaccccaucuguguuugcucgacgucggauauuugauuaauaccuccugccucccccuauugcagccaaccagagacgucgaccuuauucuuucccucgauuauaaccuucacggcgcuuuucagcagcugcagcugcucggaagauuuugucaagagcagggcaucccuuuucccccuauuucucccuccccagaagagcagcuccagccacgcgaaugccauaccuucagugauccuacauguccaggugcaccggccguucugcauuuuccauuggugucagauaguuucagagaguauuccgcacccggugucagacggaccccugaggaagccgcagcgggagaagugaaucugagcucuagugauuccccguaccauuauaccaaagugacauacagccaggaggauguagauaaacuucugcaccugacccauuacaauguuuguaacaaccaggagcaacuccuagaagccuugaggcaagcuguacaacgacgcagacaaaggagaccccacuag

SEQ ID NO: 14759 - RNA, 219 nt, Artificial Sequence; identical to SEQ ID NO: 13120
  Description of Artificial Sequence: Synthetic coding sequence

SEQ ID NO: 14760 - RNA, 243 nt, Artificial Sequence; identical to SEQ ID NO: 13121
  Description of Artificial Sequence: Synthetic coding sequence

SEQ ID NO: 14761 - RNA, 861 nt, Artificial Sequence
  Description of Artificial Sequence: Synthetic coding sequence
auggggcccgaagcacugagcucauuacuccuuuuacugcucguagccuccggugaugcagacaugaagggccacuucgauccagccaaauguagauacgcccugggaaugcaggauagaacaaucccugacagcgacauuagcgccucaaguucuugguccgauucgacugcagcucggcauucucgccuggaauccagugacggggacggagcguggugcccagcugguucagucuuuccuaaggaagaggaguaucuccaaguugaccugcagagacugcaccucguggcacugguggggacacaggggagacacgcuggaggacuaggaaaggaguuuucgcggucuuaucgcuugcgauauucucgggaugggcggcgcuggaugggauggaaagaucgaugggggcaagaggugaucagcggaaaugaggauccagaaggcguuguacucaaggaccugggacccccuaugguggcaagacuggucagauucuauccucgcgcugaccgcguuaugagcguuugccucagaguggaguuguacgggugccuuuggagggauggacuauuaaguuauacugccccugugggacaaacaauguaucugagugaggcaguauaucucaaugacucuaccuacgacggucauacuguggguggccugcaauauggugguuuaggucagcucgccgauggugugguaggccuggaugacuuucgcaaaucccaggaguuaaggguguggccaggcuaugauuacgucggauggucaaaccacucuuucagcagcggauauguggaaauggaauuugaauuugacagacuuagggcuuuccaggcgaugcaggugcacuag

SEQ ID NO: 14762 - RNA, 858 nt, Artificial Sequence
  Description of Artificial Sequence: Synthetic coding sequence
augagaggacaagggcggaaagagucucucagcgauucucgggaccuugacggcucuuacgaucagcucacuggacauccgccuggccccaccaaaaaagcccuuaagcagagguuccucaaacuguugccuugcugcgguccgcaagcucucccuagcgugucugagauuggucgcguguuuagguuuuugggcgauagcagucugccaucagcccucgcggcccccgcaagccugcguccacauaggccccgucugcuagauccugacucuguugaugaugaauuugaguuaagcaccgucugucaucgcccugaaggccucgaacaacuccaggagcagacaaaguuuacccggaaagagcugcaaguacuuuaucggggauucaaaaacgaaugccccucaggaaucgucaacgaagaaaacuuuaaacaaaucuacagucaauucuucccccagggagacaguucuaccuacgcaaccuuccucuucaaugcauucgacacaaaucacgaugggaguguaaguuucgaagauuuuguugccggguuaagcguuauauugagagguaccguggaugauagguugaauugggccuuuaaccuguaugacuugaauaaagauggauguauaacaaaagaagaaauguuggauaucaugaagagcauuuacgacaugaugggaaaauacaccuacccagcucugagggaggaagccccaagagaacacguugagucauucuuucagaagauggauagaaacaaggauggaguugugacgaucgaggaauuuauagagucaugccagaaggaugaaaauaucaugcggucaaugcaacuguucgacaaugugauuuag

SEQ ID NO: 14763 - RNA, 1311 nt, Artificial Sequence
  Description of Artificial Sequence: Synthetic coding sequence
augcagggcacccccggcgguggaacaaggccagggccaagcccaguggauaggcgcaccuugcucguguucuccuucaucuuggcagcugcccugggacaaaugaacuucacuggagaccagguccugagaguuuuggcaaaagaugaaaaacaguugagucuccuuggagaccuggagggacugaagccccaaaaaguugauuucuggcgaggacccgcuagaccaucuuugccuguggacaugagggucccguucuccgaacucaaagauauuaaagccuaccucgagucgcacggccuugccuacucaauuaugauuaaagauauacagguguugcuggaugaagaacgacaggcuauggcaaagucacgacgauuagaacgcucaacgaacaguuucucauacuccuccuaucacacgcuugaggaaaucuacuccuggauagacaacuuuguuauggagcacucugauauaguuucgaagauccagauugguaauuccuucgagaaccaaagcauucucguacugaaauucucaacaggaggaucuaggcaccccgcaaucuggaucgacaccggaauccacucccgggaguggaucacccacgcuacgggcauuuggacagccaauaagauuguaucugauuacgguaaagaccgcguacugacugacauucuuaacgcaauggacauuuucaucgaacuggugacuaaccccgacggauucgccuuuacccacucaaugaaucgucucuggcgcaaaaacaagagcauacgcccuggcauuuuuuguaucggcguugaucucaacaggaauuggaagucuggcuucgguggcaacggcucaaacucuaauccuuguucagagacauaucacggaccuuccccucaaucagaaccagaggucgccgcuauagucaauuuuauuacagcacacgggaauuuuaaagccuugauuuccauccauucuuacucacagaugcucauguacccauauggccggcuacuggagccagucuccaaucagcgagagcuuuaugaccucgccaaagaugcaguagaagcucucuauaagguucacggcauugaauacauuuucggaucuauuuccacaacacuguacguggcuagcgguauuacaguggauugggcauacgacagugggauuaaguacgcauucuccuucgaacugagggauacagggcaguacggauuccucuuaccagcgacacagauuauaccaacagcucaagagacuuggauggcuuuaagaacaauuauggaacacacucugaaucauccuuacuag

SEQ ID NO: 14764 - RNA, 1218 nt, Artificial Sequence
  Description of Artificial Sequence: Synthetic coding sequence
auggauaccaucuuccuguggagccuccuguugcucuuuuucggaucacaggcgucccgcugcagcgcccagaaaaacaccgaauuugccgucgaucucuaucaggaagugucucucagccauaaggauaacaucauauuuucaccucuaggcaucacgcuagugcuggaaauggugcaacucggagcuaagggaaaggcucagcagcagauuagacagacacugaagcagcaggaaacauccgccggcgaggaauuuuucguccugaaaucuuuuuucucggccauuuccgaaaaaaaacaagaguuuaccuucaaucucgcaaacgcccuguaccuccaggaagguuuuacaguuaaggagcaauaucugcaugguaacaaggaguuuuuccagagugcaauaaaacuaguugauuuucaggacgcgaaggccugugccgaaaugaucucaacgugggucgagagaaaaacugacggcaaaaucaaggacauguuuaguggugaagaauuugguccccucacucgcuugguguuggucaaugccaucuacuucaagggcgauuggaagcagaaguuuagaaaagaggauacacagcugaucaauuucacuaaaaaaaaugguagcaccguaaagauccccaugaugaaagcccuucuuagaacaaaauacgguuauuucagugaguccagcuuaaacuaccaggugcuggagcuuaguuacaaaggcgaugaauucagcuugauuauuauacugcccgcagaagggauggacauugaggagguggagaagcuaauuaccgcucagcaaaucuugaaguggcuguccgaaaugcaggaggaagagguagagauuucccucccgcgauuuaagguggaacagaagguggacuuuaaagacguauuguacaguuugaauaucaccgaaauauucucaggaggaugugaucucagcggcaucaccgauaguucagaaguguauguaucccaggucacgcagaagguguucuuugaaauaaacgaagacgggucugaggccgcaaccucuacuggcauccacauccccguaaucaugucacuggcacaaucucaguucaucgcuaaucauccuuuucuguucauaaugaagcacaacccaaccgaauccauccuuuuuauggggagagucacaaaccccgacacucaggagauuaagggcagagaucuggauagucuguag

SEQ ID NO: 14765 - RNA, 300 nt, Artificial Sequence; identical to SEQ ID NO: 13126
  Description of Artificial Sequence: Synthetic coding sequence

SEQ ID NO: 14766 - RNA, 471 nt, Artificial Sequence
  Description of Artificial Sequence: Synthetic coding sequence
auguuacugcuacuucuccuggcuccucuguuuuuacgacccccuggcgccgguggagcucaaaccccuaaugcaaccuccgagggaugucagaucauucaucccccuugggagggcggaauuagguaucgcggcuugacccgugaccaggugaaagccauuaauuuucugccuguggauuacgaaauugaguauguuugccggggagagcgcgaagucgucgggcccaagguaagaaagugucuagccaauggauccuggacugauauggacacuccuucaagaugugugaggaucugcaguaaauccuacuugacuuuagaaaacggcaaaguuuuucuuacuggcggcgaccucccagcacuagauggcgcucggguagacuucagaugugacccugauuuucaucuugugggcucauccaggagcauauguucccagggccaguggagcacgcccaaaccgcacuag

SEQ ID NO: 14767 - RNA, 249 nt, Artificial Sequence; identical to SEQ ID NO: 13128
  Description of Artificial Sequence: Synthetic coding sequence

SEQ ID NO: 14768 - RNA, 372 nt, Artificial Sequence
  Description of Artificial Sequence: Synthetic coding sequence
augcaagggacccccggaggcgggacccggccaggcccaucccccguggacaggcggacgcugcugguguucuccuuuauuuuagcagcugcuuuggggcaaaugaacuuuacuggcgaucaaguucuucggguccuugcaaaagacgaaaagcagcuuucucuucucggcgaccuagaaggccuuaagccccaaaaaguagauuucuggcggggcccagcccgacccagccugccaguugacaugcgcguuccuuucuccgagcugaaggacauuaaagccuaccuugagucgcauggcuuagcuuauucgauaaugauuaaagacauccaagugcuguuggacgaggaaaggcaggcaauggcaaaauag

SEQ ID NO: 14769 - RNA, 840 nt, Artificial Sequence
  Description of Artificial Sequence: Synthetic coding sequence
augggaagggucuuccuaacaggagaaaaagcuaacucaauacugaaacgguauccccgggccaacggcuuuuucgaggagauuaggcaaggcaauauagagagggagugcaaggaagaauucuguacuuucgaagaagcucgcgaagcuuucgaaaacaacgagaagacaauuaccggcguuauacuccuugcugugggaguuuggggaaagcugacuuugggaacauacauuucacugaucgccgaaaacucgaccaacgccccuuacguccucauugguaccggaaccaccaucguugucuucggacucuucggcuguuuugcaacaugucggggcaguccuuggauguugaagcuguacgccauguuucuaucgcucguuuucuuagccgaacuuguugcagguauuagcggauuuguauuccggcacgaaauuaaggauacuuuucugagaacauacacagaugccaugcagacauauaauggaaacgaugaaagaucccgcgccguugaccaugugcaaaggucccugucauguuguggcgugcaaaauuauacaaauuggaguacaagcccuuauuuccucgaacacgguauuccuccaaguugcugcaugaacgaaacggacugcaauccccaggacuuacauaaucugaccguugccgccacuaaaguuaaucagaagggauguuaugaucucgucaccaguuuuauggagacaaacauggggauuauugccgggguugccuuuggcaucgcauucucacaguugaucgggaugcuacuugcauguuguuuaucuagauuuauuaccgccaaucaguacgagaugguguag

SEQ ID NO: 14770 - RNA, 564 nt, Artificial Sequence
  Description of Artificial Sequence: Synthetic coding sequence
auguggugugccagcccuguggcagucgucgcuuuuugcgcagguuuguugguaucacacccuguguugacccaggggcaggaagccggcgggcgccccggggccgauugugagguguguaaagaguuucugaaucgauucuauaaauccuugauugauaggggcguuaauuuuucacucgauacaauugaaaaggaguugaucucauuuugucuggauaccaaaggcaaggaaaaccgccugugcuacuaccuuggugccacgaaagaugccgcaacaaagauacuaagcgaagugacaagacccaugagcguccauaugccugcuaugaagaucugcgagaagcugaagaaacuggauagucagaucugugagcuuaaguacgaaaagacacuggaucucgcaucuguugaccugagaaaaaugagaguagccgaacugaaacagauauugcacagcuggggagaagaaugccgcgcuugcgcugagaagaccgacuacguaaaucucauucaggaacuggcgcccaaguacgcugcaacccauccuaagaccgagcuuuag

SEQ ID NO: 14771 - RNA, 1311 nt, Artificial Sequence
  Description of Artificial Sequence: Synthetic coding sequence
augcagggcacgccaggcggcggaacccggccaggucccagcccuguagaccgcagaacauugcucguguucucuuuuauacuugcugcagcccucggucagaugaauuuuaccggcgaccagguccugcgcguguuagccaaggaugagaaacaacucagccuccugggugauuuagagggacugaagccccaaaagguagauuuuuggcgcggaccggcuagacccagccucccuguggacaugagaguacccuucuccgaacugaaagauaucaaagcuuaucucgaaucccauggcuuggcauauaguaucaugauuaaggauauccagguauuacuagacgaagagcgucaggcgauggccaaaucuagaagauuggaacggucuaccaacuccuuuucauauucauccuaucacacccuagaggagaucuauagcuggauugauaauuuuguaauggaacauucggauauagugaguaagauacagauaggcaauucauuugaaaaccagaguauccucguccuuaaauuuaguaccggcggcagccgccaucccgcuauuuggaucgacaccgggauucauuccagggaguggaucacccaugcgacuggaaucuggacagccaacaaaauuguguccgauuacggaaaagaccgagugcugaccgacauccugaacgcaauggacauuuuuauugagcuugucacuaacccugauggguuugccuucacucacuccaugaaucgcuuauggcgaaagaacaagaguauacgaccgggcaucuuuuguauuggaguugauuugaaccgaaacuggaaaucuggguuuggcgggaauggcucuaacucuaacccuuguagcgaaacauaucacggcccuucuccucaauccgagccggagguugccgccaucguaaacuucaucacagcacauggcaacuucaaagcucuuaucaguauccacuccuacucccagauguuaauguauccuuauggccgauugcuagaacccgugucuaaucagcgcgaacuguaugaucuggcaaaagaugccguggaagcucuauacaaaguacauggaauagaauacaucuuuggaagcaucucgacaacucucuacgucgcuucuggcauaacaguggacugggccuaugacaguggcaucaaauacgcguucagcuuugaauuaagagacaccggacaauauggauuccuucuccccgcuacccaaauuauuccuaccgcgcaagaaaccuggauggcacuuagaacuauuauggagcauacccugaaucaccccuauuag

SEQ ID NO: 14772 - RNA, 450 nt, Artificial Sequence
  Description of Artificial Sequence: Synthetic coding sequence
augggucgcguguuccucaccggcgagaaagcuaauuccauccucaagagauauccgcgggcaaacggguuuuucgaagaaaucaggcaggggaauauagagagagaaugcaaagaggaauuuuguaccuucgaagaagcaagagaggcauucgaaaacaaugagaagacaaaagaguuuuggucuacguacaccaaggcccagcaaggagaauccaacaggggaagcgacugguuccaauuuuaucucaccuuuccacugauuuuuggucuuuuuaucauuuuacucgugauuuuccugaucuggagaugcuuccugcgaaauaaaacccgaagacagacuguuacagagggccacaucccauucccacaacaucugaacauaaucacccccccuccaccccccgaugaaguguucgauuccuccggacucaguccuggcuuucuuuag

SEQ ID NO: 14773 - RNA, 936 nt, Artificial Sequence
  Description of Artificial Sequence: Synthetic coding sequence
augcuguaucaaaccaucaauucccucaagacuaaaaaccccaaauuaaaaaucuuacugaguaucgggggauaccuauucggcagcaagggauuccacccuaugguagacucauccacaucucgccuggaguuuauuaacucaaucauccuguucuuacgcaaucacaauuuugacggacuagauguaaguuggauuuauccagaccagaaagagaacacacauuuuaccguccugauccacgaacucgccgaagccuuucagaaggacuucacgaaaagcacaaaggaaagacugcuguugacugcaggcgugucagcaggacgccagaugaucgauaacuccuaucagguagaaaaacucgcaaaggaccuugauuucaucaaccuuuuaaguuuugacuuccacggaaguugggagaagccccuuaucacuggccacaacagcccucuuaguaaaggcuggcaggaucgcggccccucuaguuauuacaacgucgaauacgcagugggguauuggauacauaaaggaaugcccuccgaaaaaguggucaugggaauucccacuuauggacacuccuuuacacuugcaagugccgagacaaccgucggcgcacccgccuccggaccgggcgcagcagguccaaucacagaaagcagcggauuuuuagcguacuacgagauuugccaguuuuugaagggcgccaagauaacaagacuccaggaccagcaagugccguaugcagugaaagguaaccagugggugggcuaugacgaugugaaaagcauggaaacuaaggugcaguuucugaagaaucugaauuuggggggcgccaugauuuggaguauugauauggacgacuucaccgggaaaucauguaaccaggguccuuacccucuggugcaggcaguaaaacgaucacugggaagccuuuag

SEQ ID NO: 14774 - RNA, 621 nt, Artificial Sequence
  Description of Artificial Sequence: Synthetic coding sequence
auggauaccaucuuucuguggucccugcuauuacuguuuuuuggcucucaggcuagccgguguucugcacagaaaaacaccgaguucgccguugacuuauaccaagaaguuagccuuucgcauaaagacaacauaaucuucucuccauugggcaucacucucguccuggaaaugguccaacuuggcgcuaaagggaaagcacaacaacagaucagacagacucugaaacagcaggaaacguccgcuggagaagaguucuuugugcuuaaaaguuuuuuuucagccaucucggaaaaaaagcaggaguuuacauuuaaucuugcaaaugcacucuaccugcaggaaggcuucacugugaaagagcaauaccuccaugguaauaaagaguuuuuucagagcgcuauuaagcuaguggauuuucaggacgcgaaagccugcgcagaaaugauuucgacauggguggaaaggaagacagacggaaaaauuaaggacauguucucuggcgaagaguucggcccccugacucggcugguguuaguuaaugcgauauacuucaaaggagacuggaaacaaaaguuuagaaaggaagauacucagcugaucaacuucacuaaaaaauag

SEQ ID NO: 14775 - RNA, 1218 nt, Artificial Sequence
  Description of Artificial Sequence: Synthetic coding sequence
auggacacuaucuuccucuggucucuacuuuugcuauuuuuuggcucucaagcaagccgaugcuccgcucaaaagaauaccgaauucgccguggaucuguaccaggaggucagucucucucauaaagacaacauaauuuuuagcccccucgguaucacauuagugcuugagaugguccagcuaggagcgaaaggcaaggcacaacagcagauucggcagacacugaagcaacaagaaacuagcgcgggugaggaauucuuugugcugaagagcuucuucagugcuauaucugaaaagaagcaggaguucacauucaaucuagcuaaugcuuuauauuuacaggaaggcuucaccgucaaggaacaguaucugcaugggaacaaggaauuuuuucagucugcuauuaagcugguggauuuucaggacgcuaaggcaugcgcugagaugaucaguacuuggguugaacgcaaaacggacggcaagaucaaggacauguuuucaggugaggaguucggcccuuugacccggcuuguauuggugaaugcaaucuauuucaaaggcgacuggaaacagaaauuucgcaaggaagauacacagcuuaucaacuuuacaaaaaaaaacgguucuaccguuaaaaucccgaugaugaaagcauugcugcggaccaaauauggauacuuuucugagucaucacugaauuaucaggucuuagaguuguccuacaaaggagaugaauucucucuuauuaucauccugcccgcugaagguauggacauugaagaaguggagaaauugauuacugcccagcaaauucuuaaauggcugucagagaugcaggaagaagaaguggaaauuagccugccaagauuuaagguugagcagaaagucgacuuuaaggacgugcuguauucccucaauauaacagagauuuuuucugggggcugcgaccugucgggaaucacagauagcucggagguauauguaucucaagugacacagaaaguguuuuuugaaauuaaugaagacgguuccgaggccgcuaccagcacuggaauccacauccccgucauuaugagccuggcccagucccaauucauugccaaucacccuuuccuuuuuauuaugaaacauaauccaaccgaaucuauucuguuuauggguagagugacaaaucccgacacucaagagauuaaggguagggaucuagauagucuguag

SEQ ID NO: 14776 - RNA, 399 nt, Artificial Sequence
  Description of Artificial Sequence: Synthetic coding sequence
augcuuaucuucuggacaauuacacucuuuuugcuuggagccgcuaagggaaaagaagucuguuaugaagaccugggaugcuucagugauaccgaacccuggggaggcaccgcaauuagaccccuuaaaauauuaccuuggucuccugaaaagauuggcacccgauucuuauuguauacgaacgaaaaccccaauaacuuccaaauccuguugcuguccgauccuaguacaauugaagccucuaacuuucagauggaucgaaaaacuagauucauuauucacggguuuaucgacaaaggugaugaaucuuggguuacugacaugugcaagaaacuguucgagguggaagaggugaacuguauuugcguagauuggaagaagggaagucaagcuacauag

SEQ ID NO: 14777 - RNA, 606 nt, Artificial Sequence
  Description of Artificial Sequence: Synthetic coding sequence
augaagguucauauguuagucggggucuuagucauggucggcuuuacaguggguaaaguaccugugccagacauucguaccugccauuuuugccucguugaggauccuagugugggcugcauaucugguucagagaaguguaccaucucaaguuccucauuauguauggugaucacaaucuacuacgauguaaaaguccgguucaucgugcgugggugcggacaauauauuucauaucgcugccaggagaaacggaauaccuauuucgcugaauacugguaccaagcgcagugcugccaguacgauuacuguaacucuuggucaucuccgcagcuucaaaguucuuuacccgaaccucacgauagaccacuggcccucccccucagcgauucccaaauacaaugguuuuaccaagcacuuaaucugucccuacccuugcccaacuuccaugcaggcaccgagcccgauggucuggaucccauggugacauugagucucaaccucggccuaucuuucgccgaacuccgaagaauguaucucuucuugaacagcuccggacugcuaguccuuccacaggcuggucuucugacaccgcaucccuccuag

SEQ ID NO: 14778 - RNA, 1086 nt, Artificial Sequence
  Description of Artificial Sequence: Synthetic coding sequence
auggcaucacucggccuucuccuccuuuugcuacugacugcccuucccccucuuuggagcuccucguuaccggggcuugauacggcugagagcaaagcuacuauugcugaccugauuuuguccgcccuugaacgcgcgacugucuuuuuagaacaaaggcugccagaaauaaaucuggaugggauggucggagugcgggugcuagaagaacaacucaagucuguccgcgagaagugggcccaggagccacuguugcagcccuugagccugcggguagggaugcucggcgagaaacuggaagccgcuauucagagaagccugcauuaccuuaaacuuagugacccaaaguaccuucgcgaauuccaguuaacauugcagccgggguucuggaaacugccucacgcauggauccacaccgacgcgagccucgucuauccuaccuucggcccacaggacucauuuuccgaagaacgaagcgacgucuguuuggugcaacugcuugggaccgguacugauucuuccgagcccuguggacucucugaccucugccgcucauugaugaccaagccuggcugcucuggguauuguuugucccaccaguuguuguuuuuucugugggcuaggaugagggguugcacccagggcccgcugcagcagagucaagacuacauaaaucuuuuuugugcaaauaugauggaucuaaacaggcgugcagaggcaauaggcuaugccuacccuacucgugauaucuucauggagaacauaauguuuugcgggaugggcggcuuuucggacuuuuauaagcugagauggcuagaggcuauacuuucauggcaaaaacaacaagagggaugcuucggggagccagaugccgaggacgaggaacucaguaaagcuauucaauaccagcaacauuuuucccggcgggucaaaagaagagaaaagcaguuuccggauggguguucuucucauaacacagcgacagccgucgcggcucuaggaggcuuccuguacauccucgccgaguacccaccagcaaauagagaaccucaccccagcacaccaccaccucccaguucucgcuag

SEQ ID NO: 14779 - RNA, 162 nt, Artificial Sequence; identical to SEQ ID NO: 13140
  Description of Artificial Sequence: Synthetic coding sequence

SEQ ID NO: 14780 - RNA, 1305 nt, Artificial Sequence
  Description of Artificial Sequence: Synthetic coding sequence
auggccucgcugggauuacuucugcuccuccugcucacagcucuucccccucugugguccagcucucuuccuggauuagacacugccgaaaguaaggccacaaucgccgaucucauccuuucugccuuggagcgugcgacagucuuccuggaacagcggcugccagaaauaaaccuggacgggaugguaggggugcgcguacuugaagagcaacucaaaagcguccgggagaaaugggcccaggaaccuuuacuucagccuuugucccugaggguggggauguugggagagaaacucgaagccgcaauucagagaaguuugcauuaucugaagcuaagcgauccuaaguaccuucgcgaauuucaacuuacccuucaaccaggguuuuggaaguugccacaugcauggauucauaccgaugcaucacuuguguaccccacauuuggcccccaagacuccuuuucagaagaacgcagcgaugugugucucgugcagcuccugggaacuggcaccgacaguagugagccgugcggacucuccgaccugugccgaagucugaugaccaagccgggaugcuccggauacugccugucccaucagcuguuguucuuucuuugggcacguaugagagguugcacacaaggacccuuacagcaaagccaggacuauauuaaucuuuuuugcgccaacaugauggaccuuaaucguagggcagaggcuauaggguacgcauaccccacacgagacaucuuuauggaaaauagcguaaccggccaucccguguucuaccuuccucuuugcgauucauuucuccccccuaaagccgccccaguuacagaauuauacaccgauggcccaguaauguucugcgggauggguggcuuuagcgauuuuuacaagcugcgcuggcuggaagccauucugucauggcaaaagcagcaggaggguuguuuuggagagcccgaugccgaggaugaagaauuaagcaaagccauccaguaccagcaacauuuuucccgacgcgugaaacggagagaaaagcaauuuccggacucucgcaguguggcucaggccggugugcaauggcggaaccugggaucacuucagccacucccuccaggauuuaaacaauucagcugucucauccugccuuccaguugggacuaccgcucugugccaccauaccuggcaaauuucuauaucuucuugguagaaacgggcuuucaucacgucgcacacgcuggccuggaacugcucauuucgagggacccgccuacaucaggaucucaaucgguuggacuauag

SEQ ID NO: 14781 - RNA, 1311 nt, Artificial Sequence
  Description of Artificial Sequence: Synthetic coding sequence
augcagggcacaccugguggagggacgcggccaggcccuaguccuguggauagacggacccuguugguguuuucuuuuauauuagcggcggcauuaggacagaugaauuucaccggugaucaaguccuccgggugcuagcuaaagacgagaaacagcugagccuccuuggcgaccucgaaggucucaagccccagaaggucgauuuuuggcgcgggcccgccaggccuagucucccaguugauaugagaguuccguucagcgaacuaaaggacauuaaagcauacuuagaaagucacgggcuagccuauucaaucaugauaaaggacauacagguacuguuggacgaggaacggcaggcuauggcaaaaucaagacgguuagaacgcucuaccaauucuuucucguauucaucauaucauacucuugaagaaauauauuccuggauugauaauuuuguaauggagcacucagacauaguguccaaaauccaaauugguaacuccuucgagaaccaguccauuuugguccuaaaguuuaguacugggggcucccgacaucccgcuaucuggauugacaccggcauccacucucgggaauggaucacacacgccacuggaaucuggacugcaaacaaaauugucagcgauuacggaaaggaucggguacuuacugacauccugaaugcuauggacaucuucauugaacuggucacuaaccccgauggauucgcguuuacccacucaaugaacaggcuguggcgaaaaaacaagucuauuaggccgggaauuuucugcaucggaguugaccucaauagaaacuggaagagcggguuugguggaaacgguucaaauaguaaccccuguagugagacuuaccacggaccuucaccucagagcgaaccagaggucgcagcaaucgucaacuuuauaacagcccacggcaacuucaaagcgcugaucucaauccacucauauucccagaugcuaauguauccuuacggccgccugcuggaaccaguguccaaccaacgcgagcucuacgaucuggcuaaggacgcaguggaagcauuguacaaaguccacgggaucgaguauaucuucgggagcauuuccacuacucucuaugucgcaucaggcauuacaguugauugggccuacgauucagguaucaaauacgcuuucucauucgaauuacgcgacaccggacaguauggcuuucuucuaccugcuacucagauaauccccacagcccaagaaaccuggauggcccuccgaacaauuauggaacacacucuaaaccaucccuauuag

SEQ ID NO: 14782 - RNA, 1218 nt, Artificial Sequence
  Description of Artificial Sequence: Synthetic coding sequence
auggacacgauuuuccucuggucacuucuguuauuauucuuuggaagucaagcuagcaggugcagcgcccagaaaaacaccgaguucgccguugacuuauaccaggaggucucucucagucauaaagauaacaucauuuuuucuccucuaggaauaacccugguacuugagauggugcagcugggcgcuaagggcaaagcacagcaacagaucaggcagacccucaaacaacaagaaaccuccgcaggcgaggaauucuucguccucaagucuuuuuuuucugcaaucagcgaaaaaaaacaggaguucaccuucaaccuggccaacgcacuauaccuacaggagggcuucaccgucaaggaacaguaucugcaugggaacaaggaauucuuucagagcgccaucaaacuuguugauuuucaagaugccaaggccugcgcggaaaugauuucuaccuggguggagcgaaaaaccgacggaaaaaucaaagacauguuuucaggcgaggaauucggaccacucacacgacucguccuggugaaugcaauuuacuucaagggagauuggaagcagaaauucagaaaggaagacacacagcugaucaauuuuacaaaaaagaaugggucuaccgugaagauuccuaugaugaaagcccuccuucguacuaaguacggauauuucucagagucaagucugaacuaucagguuuuggaacucagcuacaaaggagacgaauuuucacugauuauuaucuuacccgcagagggaauggacaucgaagaggucgaaaaauugaucacagcucaacaaauauugaaauggcugucagaaaugcaagaggaggaaguagagaucuccuuaccucgguuuaaggucgaacagaaagucgauuucaaggacguguuguauagccugaacauuacugagauuuucagcggugguugcgaccugaguggaauuacugacagcucagaaguguauguaucccaagugacccaaaagguuuuuuuugaaaucaacgaagauggguccgaggccgcaaccucuacaggaauucacauccccguaauuaugucccuggcgcaaagucaguuuauagccaaucauccauuucuguucauuaugaagcauaacccaaccgaaucuauucucuuuaugggccgcgucaccaacccugauacccaggaaaucaaaggaagggacuuagacucauuauag

SEQ ID NO: 14783 - RNA, 510 nt, Artificial Sequence
  Description of Artificial Sequence: Synthetic coding sequence
augcucuaucagaccauuaauucucucaagaccaaaaauccuaaauugaaaauucugcugucuauugggggcuaucuguuuggcuccaagggcuuucauccuauggucgacucgucuacuagccgauuagaauuuauuaacaguauuauucucuuccugcgcaaucacaauuucgacggacuugaugugucuuggauuuauccggaccagaaggaaaauacacauuucacagugcuaauucacgaacuggcugaggcauuccagaaagauuuuacaaaauccacaaaggaacgucuccugcuuacugcaggaguauccgccggaaggcagaugauugauaacucauaccaaguggaaaaacuagcgaaggacuuagauuucauuaaccuacucaguuuugacuuccauggaucaugggaaaagccucugauuaccggacauaacucuccgcucucuaaaggguggcaggaccgaggacccagcagcuacuacaacguagaauaugcauag

SEQ ID NO: 14784 - RNA, 1209 nt, Artificial Sequence
  Description of Artificial Sequence: Synthetic coding sequence
auggcuucgcuggggcuccuacugcugcugcuguuaacggcucuuccuccuuugugguccaguagcuugcccggccuggauacagccgaaucgaaagcuaccauugccgaccugauacugucagccuuagaacgagcgaccguuuuucucgaacaaaggcuucccgagauaaauuuagaugguaugguuggggucagagugcuggaagaacagcuuaagucugugcgagagaagugggcgcaagagccuuuauugcagccacuuucacugagagucggaaugcuaggcgaaaaguuagaggcagcuauccagcgcucccuccacuaucuaaaauugagcgauccuaaguaccuacgagaguuucagcuaacccugcagccaggauuuuggaagcucccucaugcuuggauacauaccgaugcuucacugguguacccuacauuugggccccaggacuccuuuagcgaagagagauccgacguuugucuugugcagcuacucgguacugguacagacucuucagagcccugcggccuguccgaucugugucgaagcuuaaugaccaagcccggcuguucaggcuacuguuuaucccaucagcuguuauuuuucuugugggccaggaugagaggguguacucaaggaccgcuacaacaaucccaggacuacaucaauuuguuuugcgccaacaugauggaucugaauagacgugcugaagccauugguuaugcauauccgacaagggacauuuucauggaaaacaucauguucugcggcauggguggcuuuuccgacuucuauaaauuacguuggcuugaagcuauuuuauccuggcagaagcagcaggaagguuguuuuggcgaaccagaugcugaggacgaggagcuuuccaaggcaauccaguaccagcagcauuucagcagacgugucaaaagaagagaaaaacaguuuccugauucccggucuguggcccaagccgggguucaguggcguaaccuggggucccuacagccucugccgccuggguucaaacaguucucuugucuuauucugcccucuucgugggauuauagguccguucccccauaucuggccaacuuuuacaucuuucucguugagaccggcuuccaccacguagcacacgcaggguuggaguugcugauaagucgcgacccccccacaucagguucucagucagucggcuuguag

SEQ ID NO: 14785 - RNA, 1680 nt, Artificial Sequence
  Description of Artificial Sequence: Synthetic coding sequence
auguggacuaauuuuuuuaagcuccgucuguuuuguugucuucuggccguccucaugguggugguacuggucauuaauguuacccagguggaauaucuggaccacgaaacugucagcgccacauuuauagacucaaguggccaauucguaaguagccaagugaccggaauuuccaggaauccuuacugcggauacgaccagcagaccuuaucuagccaggaacgaauggaagaggauucacugcuagccgcuuuacacagacaagucccugaugugggcccaguccccuucgucaagucaacagacccaaguucuuccuacuuuguuaucuugaauuccgccgcauuuuuuaaagugggaucucaacuggaagugcuaguccacgugcaggauuuucagcgaaagccuaaaaaauacggaggugauuaucuucaggcgcgaauccacucccugaaguuacaggccggcgcugugggaagaguugucgacuaccagaaugguuuuuacaaaguuuuuuuuacccuauuauggccaggcaaggugaaagugagugugucucucguucauccgagugaagguauuagggugcuucagagauuacaggaggauaagcccgauagaguauacuucaagucuuuauuucguuccgggagaauuucagagaccacagaguguaacguaugcuugccaggcaaccugccguugugcaauuucacagaccucuacacaggggaaccaugguucuguuuuaagccgaagaaacucccuugcuccagccgcauuacacauuucaaagggggcuacuugaagggauuacugaccgcagcugagagcgcauuuuuccagagcggugucaauauaaaaaugccgguuaauucuucugguccggauuggguuacugucauccccagaaggauaaaagaaacaaauucucuggagcucucucagggcagcgguacuuuucccagcggcuauuacuauaaggaccaguggagaccgaggaaauucaaaaugagacaguucaaugacccagauaauaucaccgaaugucuacagcggaaagugguacauuuguucggcgacucaaccauacgucagugguuugaauaccuuacaacauucgugccagaucuuguugaguucaaccuggggucuccuaagaacgugggaccuuuccuggcagucgaucagaagcacaacauucugcugaaauaucggugucacggcccaccuauccgauuuacaaccguauucuccaacgaacugcacuacguggccaacgaauugaaugggaucgucggcggaaagaauaccguaguagccauagccguguggagccacuucagcacauuuccccuggaggucuacaucagaagacugcgcaauauacgccgggcagugguccgacuccuggacagaucaccaaaaaccgucguagucauccguaccgcaaacgcccaagaacuggggcccgaagucucucucuuuaauagcgauugguacaacuuccagcuggauacuauacuuagacguauguucaguggcguuggaguguaucuugucgacgccugggagaugacccucgcccacuaccuuccccauaagcugcauccggaugaagugauugucaaaaaccaacuggauauguuccucucuuucguuugcccacucgaaacuuag

SEQ ID NO: 14786 - RNA, 402 nt, Artificial Sequence
  Description of Artificial Sequence: Synthetic coding sequence
auggccauggucucugcuaugucuuggguccuguaccuuuggaucuccgcaugcgcuaugcuucucugucauggaucucugcaacauacuuuccaacaacaucaccuccaucgacccgaggguggcaccugcgaagugaucgcagcacacaggugcuguaauaagaaccggauagaagagcgaagccaaaccguuaaaugcuccugucucccugguaagguggcaggcaccacuaggaaccgaccuucauguguugacgccuccauugugauuggaaagugguggugcgagauggaaccaugucuggaaggcgaagaaugcaaaacacugccugauaauucuggauggaugugugcuacuggaaacaaaaucaagacaacuaggauccacccaagaacguag

SEQ ID NO: 14787 - RNA, 606 nt, Artificial Sequence
  Description of Artificial Sequence: Synthetic coding sequence
augaaaguccacaugcuggugggggugcuggugaugguaggguucacagugggcaaagucccuguuccugacauucgaacuugucacuuuugucugguugaggauccaucagucggcuguauuaguggcucggaaaagugcacuaucucuuccaguagucugugcaugguuauuacaauuuacuacgaugugaaggugcgguucauagugcgggguugcggacaauacaucagcuaucgcugccaagaaaaaagaaacacauauuuugccgaguauugguaucaggcacaguguugccaauacgauuauuguaacuccuggucuucaccucaacugcagagcagucucccugagccucaugacagaccuuuggcccugccccuuagcgacucccaaauucagugguucuaccaggccuuaaaccuuagccuaccgcuaccaaauuuucacgcuggaacugaacccgauggccuggacccuaugguaacucuaucacuaaaucugggacuaagcuuugccgagcugagaagaauguacuuauuuuugaauucaucagggcugcuggugcuaccccaagccggucugcugacuccccauccgaguuag

SEQ ID NO: 14788 - RNA, 606 nt, Artificial Sequence
  Description of Artificial Sequence: Synthetic coding sequence
augaaagugcauaugcugguggguguacucgugaugguuggguucacggucgggaaagucccugucccggacaucagaacaugucacuuuugcuuaguggaagauccgucuguuggguguaucagcgggucagagaaguguaccaucucaaguagcagccuauguaugguaaucacuauauacuaugacguuaagguuagguuuaucguccgggguuguggacaauauauuucuuaucgcugucaagaaaaaagaaacaccuauuuugcagaguauugguaucaggcccaauguugucaguacgauuacuguaauucuugguccucuccgcaacuucagucuucacugcccgaaccccacgacagacccuuggcccuucccuugagugacagccagauacaaugguucuaccaagcuuuaaaucuuucuuugccacugccaaacuuccaugcuggcacugaaccagauggccucgaccccauggugaccuugucuuugaaucucggccugaguuuugcugaacugcgccguauguaucuuuucuugaacucuagugggcugcucguacuuccacaagccggauugcuuacgccacacccaaguuag

SEQ ID NO: 14789 - RNA, 732 nt, Artificial Sequence
  Description of Artificial Sequence: Synthetic coding sequence
augggcccagaagcuuugucuucucuacugcuccuucugcuuguggcaaguggggacgcagacaugaagggacauuuugaucccgccaaaugccguuaugcccucggaaugcaagaucgcaccauucccgacucagauauuuccgccucuuccucauggagcgauuccaccgcggcucgucacagucggcuugagaguagcgacggggacggagcuugguguccugccgggagugucuucccuaaagaagaagaguacuugcagguagauuugcagcgguuacaucuaguggcucuggucgggacucagggccgucaugcuggagggcugggcaaggaguuuagccgaucguauaggcucagauacucacgagaugguaggagauggaugggauggaaggaucgauggggucaggaggugauuuccgguaaugaggacccagagggggugguguugaaagauuugggcccacccaugguugccagacuggucagauuuuauccuagagccgaucgggugaugucagugugucucaggguggaacuuuaugggugcuuguggcgcgauugcucaaugggagugugggcuucauggcagauggugugguggggcuggaugacucugggaagagugcgcagcugugggucaggacaggcaaugacuaugugggauggagccacuacggcaaguccuguggccauguggcgguggucucuuucucuuacaggcuag

SEQ ID NO: 14790 - RNA, 258 nt, Artificial Sequence; identical to SEQ ID NO: 13151
  Description of Artificial Sequence: Synthetic coding sequence

SEQ ID NO: 14791 - RNA, 348 nt, Artificial Sequence
  Description of Artificial Sequence: Synthetic coding sequence
augggacgaguguuucugacaggagagaaagcuaauucuauacugaaaagguauccccgggcuaauggguucuucgaggaaauucgccaggggaacaucgagcgagaaugcaaggaggaguucuguaccuucgaagaagcuagagaggcuuuugagaauaacgaaaagaccaaagaauuuuggaguaccuauaccaaagcacagcagggcgagagcaacagaggcuccgacugguuucaguuuuaccuuaccuuuccacuuaucuucgggcucuuuauaauacugcuaguuaucuucuugauauggagauguuuuuugcgaaacaagacccgaaggcagaccgucuag

SEQ ID NO: 14792 - RNA, 606 nt, Artificial Sequence
  Description of Artificial Sequence: Synthetic coding sequence
augaagguucauauguuagugggcguacuggugauggugggauucacaguugguaagguuccuguuccagacauuagaaccugucacuucugccucguagaggauccuuccgucggcugcaucaguggcucugaaaaaugcacuaucucuucuucuagcuuaugcauggucauaacuaucuacuaugacgucaaggugcgguucaucgugagaggcuguggacaguacauaaguuaucggugucaagaaaaacguaauacauauuucgcugaauauugguaccaggcucagugcugucaguacgauuauuguaacuccuggucuucuccacaguuacaguccucgcucccagaaccucaugaucgcccucucgcuuugccacuguccgacagccaaauccaaugguucuaccaggcucuuaaccucucuuuacccuuaccuaacuuucacgccggcacggaaccagaugggcucgaccccauggugacauugucauuaaacuuaggacugucauuugcugagcuuagacguauguaucuguuccugaauuccagcggcuuacuaguccuuccacaggcugggcuucugacuccccauccaucuuag

SEQ ID NO: 14793 - RNA, 1311 nt, Artificial Sequence
  Description of Artificial Sequence: Synthetic coding sequence
augcaggggaccccuggcggcgguacccgaccaggccccucuccgguugacagacgcacccuguuggucuuuuccuuuauccuugcugcagcacuagggcaaaugaacuuuacaggcgaccagguguuaaggguacucgcaaaggaugagaaacaacuuucccuacugggcgaccucgaagggcuaaaaccccagaaaguggacuucuggcgcgguccagcuagaccaucucucccggucgauaugagggugcccuuuucugagcucaaggacauuaaggcauaucuagaaucccauggccuagccuacucaauaaugaucaaggacauucagguuuugcuagacgaggaaagacaggcgauggcaaaaucucgaaggcuugaaagguccacaaauuccuuuucguauuccagcuaccacacccuggaggagaucuauucuuggaucgauaacuucgugauggagcauucagacauugucagcaaaauacagaucggcaacucuuucgagaaccaaucaauacucgugcuuaaguuuaguacugguggcagccggcacccugcaaucuggauagauacaggcauucacucaagagaauggaucacccaugccacaggcaucuggacagccaacaaaauugucagcgauuacggaaaggaucgcguauuaaccgacauccugaaugccauggauauuuuuauagaauuagucaccaacccagauggcuuugcauuuacucauuccaugaacagacuauggagaaaaaauaagucaauacgaccaggaaucuuuuguauuggaguggaucugaauaggaauuggaagaguggauucggcggcaauggcagcaauucaaaccccugcucagagacuuaucaugguccauccccgcaauccgagcccgaaguugcugccaucgugaacuuuaucacugcccaugggaauuuuaaagccuugauuaguauccauucauacagccagaugcugauguauccuuauggucgguugcuugagcccgucuccaaucagcgcgaauuguaugaccuagcgaaagaugcuguggaagcccuguacaaaguccauggaaucgaguauauuuucggaucuaucagcacgacgcucuauguugccucaggcauaaccguagauugggccuaugacuccggaauuaaguaugcguuuucguuugaguuacgggacacaggacaauacggauuccuccugccugcuacucaaauuauuccgacagcucaggaaacuuggauggcucugcgcacuaucauggaacacaccuuaaaccacccauacuag

SEQ ID NO: 14794 - RNA, 606 nt, Artificial Sequence
  Description of Artificial Sequence: Synthetic coding sequence
augggugcaaccacaauggaccagaaaucccugugggcuggcguugucguccugcuccuccugcaaggugguucagccuauaaacucgugugcuacuuuacuaacuggucucaggaccggcaggagccgggcaaguuuacgcccgaaaacauagacccuuuccuguguucgcaccugaucuacuccuuugccucaauugaaaacaauaaaguuauaauaaaagacaaguccgaaguuaugcucuaccaaaccauuaacucacucaagaccaaaaauccaaagcuuaaaauccuccuguccaucggcggcuaucuguuugggaguaaaggauuucaucccaugguggauucuucaaccucaagacuggaguucauuaauaguauuauacuuuucuugcguaaucacaauuuugacggccuggacgugagcuggaucuaucccgaccaaaaggagaauacccacuucaccguguuaauucaugaacuggcugaggcuuuucagaaggacuucacaaaaucuacuaaagaacggcugcuccucacugcuggcguguccgcaggaagacagaugauagacaauuccuaccaagucgagaaacuggccuag

SEQ ID NO: 14795 - RNA, 75 nt, Artificial Sequence; identical to SEQ ID NO: 13156
  Description of Artificial Sequence: Synthetic coding sequence

SEQ ID NO: 14796 - RNA, 252 nt, Artificial Sequence; identical to SEQ ID NO: 13157
  Description of Artificial Sequence: Synthetic coding sequence

SEQ ID NO: 14797 - RNA, 1254 nt, Artificial Sequence
  Description of Artificial Sequence: Synthetic coding sequence
auguuagcccucuuggugcugguuacaguagcguuagccucagcucaucaugguggcgagcacuuugaaggggagaagguguucagggucaauguagaagacgagaaccacauuaauaucauuagagaacuggcgagcacaacccagaucgacuucuggaagccugacucuguuacccaaauuaagccucauagcacagucgacuuccgaguuaaagccgaagauaccguaacaguggaaaacguacucaagcagaaugagcuccaguauaagguguuaauaucaaauuuaaggaacgugguugaggcccaguuugacucaagagugagagcaacagggcauagcuaugagaaauacaacaagugggaaacgaucgaggcauggacccaacagguggcuacagagaacccagcgcugauaaguagaagcguaaucggaacaaccuucgagggcagagcaauauaccugcuuaaagugggcaaggccggucagaauaaacccgcaaucuuuauggacuguggcuuccaugcaagggaauggauuaguccagccuucugucaaugguucgucagagaggcugucaggacuuacgggagagagauacagguuacagaguugcucgacaaacuggacuuuuacgugcuuccuguccugaacaucgacgguuacauauauacuuggacgaagagccgcuucuggaggaagacucgaucaacacacaccggaaguaguuguaucggcacugaccccaaccguaacuuugacgcagguuggugugaaauuggagccagccggaauccaugugacgagacauacugugguccugcggcagaaagugagaaggagacuaaggccuuagcagauuucauucgcaacaaacugucuucaaucaaagcauaccugacaauucauagcuacucacagaugaugaucuacccuuauucuuacgccuauaaacuuggagaaaauaacgcagaauuaaacgcccucgccaaggcaaccgugaaggagcuugccagccugcacggcacuaaauauaccuaugggccaggugccacgacuaucuaccccgcagccggaggaagcgaugacugggccuaugaccaggggauacgcuacaguuucacuuucgaacugagagacacgggcagguacggguuccuguuaccagaaucccagauaagagccaccugcgaagaaaccuuccuggcuauaaaauacgucgcauccuauguacuagaacaccucuacuag

SEQ ID NO: 14798 - RNA, 1680 nt, Artificial Sequence
  Description of Artificial Sequence: Synthetic coding sequence
auguggacgaacuucuuuaagcuucgacuuuucugcugcuuacuugccgugcuaaugguggugguacugguaaucaacgugacucagguggaguaucuggaccacgaaacuguguccgcaacuuuuaucgacucauccgggcaguucgugagcucccaagugacuggaauuucgagaaaucccuauugcggcuaugaccagcagacccucucuucccaagaacgcauggaagaagauucccuccuggcggcccugcacagacaggucccugaugucgggccuguucccuucguuaaauccacugacccguccagcucuuacuuugugauccugaauucagcagcuuucuucaagguaggcucacaguuagagguccuugugcauguccaagacuuccaaagaaagccaaaaaaguaugggggagacuaucuacaagccaggauccacucacucaaacuucaggcuggggcuguagggagagucguagacuaucaaaauggauuuuacaagguguuuuucacauuguuauggccagguaagguuaaggugucugugucguuggugcacccaagugaaggcauccgcgugcugcagcgguuacaggaggacaaaccugacagaguguauuuuaagucccuauuucgaucaggacgaauaucagaaaccacugaauguaauguuugcuuaccagggaauuugccucucugcaacuuuaccgaucuauauaccggcgaaccaugguucugcuucaaaccuaaaaaacucccaugcucuucucgcauuacucauuucaaagguggcuaccucaagggccuccugacugcagccgagagugcguucuuccaaucaggcgugaacauuaaaaugcccgugaacuccagcggaccggauugggugaccgugauacccagacgaauaaaggagacgaauagccuggagcugagccagggauccggcaccuucccauccggauauuauuacaaagaccaguggagaccccgcaaguucaaaaugaggcaauuuaacgauccugauaauauuacagagugccuccagcgcaagguuguucaccucuucggcgauagcacaauuaggcagugguucgaguaccucacgacauuuguucccgaucugguggaguucaaucuaggaucaccaaagaaugugggaccauuucucgcgguggaucagaaacauaauauucuacuaaaauacagaugccaugguccaccuaucagguuuaccacaguguuuaguaacgaguugcacuacguggccaaugaguugaacgguauagugggcggcaaaaacaccgugguggcuauugcuguuuggucgcacuuuucaacauucccacuugagguguauauccgucgguugcgaaauauucgccgcgccguggugagacuccuagauagaucuccuaaaacgguagugguuauucgcacagcaaacgcacaagagcuuggcccugaaguuaguuuauucaacuccgacugguauaacuuucagcucgacacaauucuccgcaggauguuuucuggagucggcguauaccugguugaugccugggagaugacgcuugcacacuauuugccccacaagcuacaccccgacgaagucaucgugaagaaccagcuggacauguucuuauccuucgugugcccccuugagaccuag

SEQ ID NO: 14799 - RNA, 99 nt, Artificial Sequence; identical to SEQ ID NO: 13160
  Description of Artificial Sequence: Synthetic coding sequence

SEQ ID NO: 14800 - RNA, 180 nt, Artificial Sequence; identical to SEQ ID NO: 13161
  Description of Artificial Sequence: Synthetic coding sequence

SEQ ID NO: 14801 - RNA, 303 nt, Artificial Sequence; identical to SEQ ID NO: 13162
  Description of Artificial Sequence: Synthetic coding sequence

SEQ ID NO: 14802 - RNA, 234 nt, Artificial Sequence; identical to SEQ ID NO: 13163
  Description of Artificial Sequence: Synthetic coding sequence

SEQ ID NO: 14803 - RNA, 12 nt, Artificial Sequence
  Description of Artificial Sequence: Synthetic coding sequence
auguggacauag

SEQ ID NO: 14804 - RNA, 402 nt, Artificial Sequence
  Description of Artificial Sequence: Synthetic coding sequence
auggccaugguauccgcuauguccuggguccuuuaucuuuggauuucugcuugugcgaugcuccucugucauggaagcuuacagcacaccuuccagcagcaucaucuacacaggcccgaaggcggaacaugugaagucauugccgcacaccgcugcuguaacaagaaccggauugaggagagaagccagacagucaaaugcucaugccuucccgggaaaguagccgguacuacacgaaaccgucccagcugcguggaugcaaguauuguuaucgguaagugguggugcgaaauggagccuuguuuagaaggggaggagugcaagacacuaccagacaacagcggauggaugugcgccacuggaaauaagauuaagacaaccaggauucauccaaggacuuag

SEQ ID NO: 14805 - RNA, 600 nt, Artificial Sequence
  Description of Artificial Sequence: Synthetic coding sequence
augaccaugcgccacaacuggaccccugaucucuccccauuauggguccugcuacucugugcucacgucgugacacuccuaguuagagcuacgccaguuucccagaccaccaccgccgccaccgccucugugagauccacgaaggacccaugccccagccaacccccggucuuccccgcagccaaacagugcccagcccuggaagugacuuggccugaggucgaagugccauuaaacgguacccuuagccuguccugcguugcgugcagccguuucccaaacuuuuccauuuuauacuggcuuggaaaugguagcuuuauugaacaucugccagggagacugugggagggcuccacaucucgagaaagaggaaguaccgguacucagcuuugcaaagcgcuuguccuggaacaguuaacuccggcgcuacacucuacaaacuucagcuguguucucgucgauccugaacagguuguucagaggcaugugguccuggcccaguugugggugcggucaccacguaggggucugcaagagcaagaggagcuguguuuccauauguggggaggcaaaggcgggcucugucaaaguagccuuuag

SEQ ID NO: 14806 - RNA, 1044 nt, Artificial Sequence
  Description of Artificial Sequence: Synthetic coding sequence
augggugugguacaguacggugauaaucccgcaacacacuuuaaccugaaaacacacacuaauucacgggaccuaaaaacggcaaucgagaagauuacccaacgcggcgguuugucuaacgugggcagggcuauuucuuucgugacuaagaauuucuucagcaaggccaauggcaauagaagcggagcaccgaauguagucguaguuauggucgacggauggccaacagacaagguugaggaagcaagcagacuggcucgugaauccggcauaaacauuuuuuucauuacuauugagggggcagccgagaaugagaaacaauacgugguugagccuaauuucgccaauaaggcugucugccggacgaacggcuucuauagucugcacguucagaguugguuuggccuccacaaaacacugcagccucuuguuaaaagaguuugugacacagaccgccuggccuguagcaaaacauguuugaacucugcugacauaggauuugugaucgauggaagcucuagugugggaacagguaacuuuagaacagugcuccaguuuguaacaaacuuaaccaaagaauucgagauuuccgacacagauacgagaauuggcgccgugcaguacacuuacgagcagcggcuggaauuuggauuugacaaauacagcucuaagccagacauucucaacgcuauuaaacgggucggcuauuggucuggcggcacuucgaccggagcagcgauuaacuuugcccuugaacagcucuuuaagaaaucaaagccuaacaagcgaaaacugaugauauuaaucaccgauggacgcucuuaugacgauguuagaauccccgccauggcugcgcaucucaagggggugaucacauacgcaaucggcguugcgugggccgcucaggaagaacuagaggugauagcgacgcaucccgcaagagaccauucauuuuucguagaugaguucgauaaccuacaccaauacgugccacgcauuauucagaauauuuguaccgaauucaacagucagccccggaacuag

SEQ ID NO: 14807 - RNA, 27 nt, Artificial Sequence
  Description of Artificial Sequence: Synthetic coding sequence
augcaaggaacaccagggggcggcuag

SEQ ID NO: 14808 - RNA, 369 nt, Artificial Sequence
  Description of Artificial Sequence: Synthetic coding sequence
augcuguaccagacaaucaacucacugaaaacaaagaacccuaaacucaaaauuuugcucuccauuggcggauacuuauuuggaucuaaaggauuucaucccaugguugacucuuccaccucaaggcuggaguuuaucaacuccaucauccuauuuuuacggaaucacaacuucgacggccuggacguaucuuggauuuaucccgaucaaaaggagaauacacauuuuacuguguugauccacgaauuggccgaagcauuucaaaaggauuucacaaagaguacaaaggagaggcuguuauuaacagcuggaguuagugcagguagacagaugauugacaacucuuaucagguggagaaacuugcguag

SEQ ID NO: 14809 - RNA, 309 nt, Artificial Sequence
  Description of Artificial Sequence: Synthetic coding sequence
augagagugucuggcguucugcggcuacuugcccucauuuucgccauugugaccacauggauguuuaucaggagcuauaugaguuuuucuaugaaaacaauccgacugccacguuggcuggcagcaucccccacaaaagaaauacaggugaagaaauacaagugcggcuugaucaagcccugccccgccaauuacuuugcauuuaagauuuguucaggcgcugcuaauguggucggaccuacaaugugcuucgaagauaggaugauuaugucucccgucaaaaauaacguagguagaggccucaacuag

SEQ ID NO: 14810 - RNA, 660 nt, Artificial Sequence
  Description of Artificial Sequence: Synthetic coding sequence
augaaacugcuacucugggcauguauugugugcguugcauucgcaaggaagagaagguuuccauucauuggcgaagacgacaacgacgauggacacccccugcaccccucccucaacauacccuacggaauucgaaaccuuccccccccacuguacuaccgacccgugaacaccgugccauccuacccuggcaacaccuauaccgacacuggacucccauccuaccccuggauuuuaacaaguccuggcuuccccuauguguaccauauuagaggguucccuuuagcuacucagcucaauguccccccucugcccccucgcggcuuccccuuuguuccgccuucccguuucuuuuccgccgcagcugcuccugcggccccucccauugccgccgagcccgccgccgcugcaccccuaacugccacaccugucgccgcagagccagcagcaggcgcuccuguggccgccgagccggcagcugaggcccccguaggugcugaacccgcugccgaagcccccgucgcugccgagccagcugcggaggccccggugggaguugagccagcggcugaggagccaucacccgccgaacccgccacagccaagcccgcugcgcccgaaccacacccgucaccuucccuagaacaagccaaccaguag

SEQ ID NO: 14811 - RNA, 1869 nt, Artificial Sequence
  Description of Artificial Sequence: Synthetic coding sequence
augggaaagagugagggucccgugggaaugguagaaagugcggggagggccggucagaaaagacccggcuuucuggagggcgguuuacuacuccugcuccuccuggugaccgcagcguuaguugcgcucggaguucuguacgccgacaggagagguaaacagcugccacgucuggcauccaggcuguguuucuuacaagaagaaagaacauuugugaaaagaaagccucguggaauucccgaagcucaagaggugucugaaguuugcaccacuccaggcugugugaucgcugcagcacggauuuugcagaauauggaucccacuaccgaaccaugugaugauuuuuaucaguucgcuuguggagggugguuacgccgacacguaauucccgaaacaaauuccagauauucaaucuucgauguucuucgcgaugaauuagaaguaauuuugaaagccguucucgagaauagcacugcuaaggcaacaguuccccaagaagagagacaugacguaauugcucuguaccauagaaugggccuugaagaacuccaaagucaguucggcuuaaaagguuuuaauuggacauuguucauccagaccgucuugagcuccgugaagauaaagcuguuacccgaugaagaagugguuguguacggcauccccuaccugcagaauuuggaaaacaucauugauacauauagcgcgcgcacaauacaaaacuauuuaguguggagguuagugcuggauagaauaggaucccucucgcagcgguuuaaggacacacguguaaacuauaggaaggcgcuguuuggcacaaugguugaagaaguuagguggcgggagugcguugguuacgugaauuccaacauggagaacgccguuggcucuuuguaugugcgcgaggcguuucccggcgacucuaagucgaugguacgggaacugauagauaaagugaggacgguguucguugagacgcuagaugagcugggauggauggacgaggaaucuaagaagaaagcccaggagaaggcaaugaguauacgagaacaaaucgggcaccccgauuacauccuggaagaaaugaacagaaggcuagacgaggaguauagcaaucuaaacuucagcgaagaccuuuauuucgagaacucacugcaaaacuugaaggugggugcccagaggagucugagaaaguugagggagaaggucgacccaaaucuauggauuauuggugcagcuguugucaacgccuucuauagccccaaucgcaaccaaauaguguuuccagccgguauacuucagccucccuucuuuaguaaagaacagccccaggcacucaauuuuggaggaaucggaaugguaaucgggcacgaaauuacccauggguucgaugacaacgggagaaacuucgacaagaaugggaacaugauggacugguggucuaacuuuucaacccagcauuuucgcgagcagucugaguguaugaucuaucaauacgggaacuauagcugggaccuggcagacgaacagaauguuaauggauuuaauaccuugggagaaaauaucgcagacaacggaggagucagacaggccuauaaggcuuaccugaaguggauggccgaagguggaaaagaccagcaguugccuggauuagaccuuacgcacgagcaacucuucuucauuaauuaugcccaaguguggugugguaguuaccgucccgaauuugccauucaguccaucaaaaccgaugugcacagcccccugaaguaucgcguccuggggagccuucagaauuuggcugccuucgcagacaccuuucauugugcccgaggaaccccuaugcauccaaaagagcguuguagagucugguag

SEQ ID NO: 14812 - RNA, 168 nt, Artificial Sequence; identical to SEQ ID NO: 13173
  Description of Artificial Sequence: Synthetic coding sequence

SEQ ID NO: 14813 - RNA, 156 nt, Artificial Sequence; identical to SEQ ID NO: 13174
  Description of Artificial Sequence: Synthetic coding sequence

SEQ ID NO: 14814 - RNA, 1620 nt, Artificial Sequence
  Description of Artificial Sequence: Synthetic coding sequence
auguccgaaccccaggagaaaaaacuuagcgaaaacaccgauuucuuagcucccggaguuaguaguuuuaccgauuccaaccagcaggaaucuaucaccaaaagagaagaaaaccaagaacagcccagaaauuauagccaucaucaguugaacaggagcucgaagcacagccaaggcuuaagggaccaaggcaaccaggaacaggaccccaauauaucaaauggcgaagaggaagaggagaaggaacccggagagguaggaacucauaaugauaaucaggagcgaaagacggagcugccccgggagcaugccaauagcaagcaggaagaagauaacacucaaagcgacgacauucuggaggaaucagaucagccuacacaggucagcaagaugcaagaagacgaauuugaccaagggaaccaagaacaagaagauaacagcaacgcagagauggaagaagaaaaugcaucuaacguuaauaaacacauccaagagaccgaguggcagucccaggaagguaaaacuggacuggaggcaaucucaaaccauaaggaaacagaagaaaagaccguguccgaagcccugcugauggaaccuaccgacgacggaaacacaacuccaagaaaccacggaguagacgacgauggugacgacgauggugaugacggggguacagacggaccacggcauucagcuagugaugacuacuuuauccccucacaggcauuuuuagaggccgaaagggcacaaucuaucgcuuaccacuugaagaucgaagagcagagagagaaagugcacgagaacgagaacauugguacaacugagcccggcgagcaccaggaggcgaaaaaggccgagaauuccuccaacgaagaagaaacaaguuccgaagguaacaugagagugcacgcgguugauuccugcauguccuuucaaugcaagcgagggcacaucugcaaggcugaccagcaaggaaaaccgcacugugugugccaggacccuguuacuugccccccaacuaagccauuagaucagguauguggcaccgacaaccagaccuaugccuccucaugucaucucuucgcuacuaagugucgccucgaagggaccaagaaaggccaccaacuucaguuagacuacuucggcgccugcaaguccauuccaaccuguacagauuucgaagugauccaguucccacuucgcaugagggacuggcucaaaaacauuuugaugcaacucuaugaagccaacucagagcacgcgggauauuugaacgaaaaacagaggaacaaagugaaaaaaaucuaucucgacgagaaacgccugcuagccggcgaucacccuaucgacuugcuuuugagagacuuuaaaaagaauuaucacauguaugucuacccaguacacuggcaauuuucagaacuugaucagcaucccauggaucgagugcucacacauuccgaacuggccccccugcgagcuagccuugugccgauggaacauuguauuacuagauuuuuugaagaaugugauccgaauaaagauaagcauauuacacugaaagagugggggcauuguuuuggaauuaaagaagaggacauugacgagaaucuucuguuuuag

SEQ ID NO: 14815 - RNA, 591 nt, Artificial Sequence
  Description of Artificial Sequence: Synthetic coding sequence
augccucauuuagccagcuuauuuacugccuccuccagaugcugcccgcauccacugagaccugaagguucaggggccaugggucccgaagcccugucaagucugcugcuguugcuccugguugccucuggugaugcagauaugaaaggccacuucgauccugcaaaaugucgauacgccuugggaaugcaagaccguaccauucccgacucagacauuuccgcguccagcucauggagugacucaacugccgcacggcacucucgauuagagucuucugauggagauggggccuggugcccagccggcagcguguuccccaaggaagaggaauaccuucaaguggaucuacagcgucugcaccugguggcccucguuggcacacagggacgccaugcagguggauugggcaaggaguuuucucggucauaccgucuaagauauucccgcgaugguagaagauggauggguuggaaggauagauggggacaggaagugaucagcggaaaugaggacccugaaggaguaguucugaaggauuugggaccaccuaugguagcucguuuggugcgcuucuaccccagggccuag

SEQ ID NO: 14816 - RNA, 162 nt, Artificial Sequence; identical to SEQ ID NO: 13177
  Description of Artificial Sequence: Synthetic coding sequence

SEQ ID NO: 14817 - RNA, 126 nt, Artificial Sequence; identical to SEQ ID NO: 13178
  Description of Artificial Sequence: Synthetic coding sequence

SEQ ID NO: 14818 - RNA, 222 nt, Artificial Sequence; identical to SEQ ID NO: 13179
  Description of Artificial Sequence: Synthetic coding sequence

SEQ ID NO: 14819 - RNA, 369 nt, Artificial Sequence
  Description of Artificial Sequence: Synthetic coding sequence
augggucccgaagcucugagcucauugcuacugcugcuacucguugcgucaggugaugccgauaugaaggggcacuuugaccccgcuaagugccguuacgcacugggcaugcaggaccgcacaauuccggauagcgauauuuccgccuccucauccuggagcgacagcaccgccgcuagacacucgagguuggaaucuagugauggggauggggcgugguguccggccggcaguguuuucccuaaagaagaagaguaccuccaagucgaccugcagagacuccaccuuguggcuuuagucggaacacaggggcgucacgcugggggguugggaaaagaguuuaguaggucuuacagauuaagguauuag

SEQ ID NO: 14820 - RNA, 483 nt, Artificial Sequence
  Description of Artificial Sequence: Synthetic coding sequence
augggaccugaagcccugucaaguuugcugcuacuccuacuggucgcauccggagaugcugauaugaaaggccauuuugacccggcaaagugucgcuaugcacugggaaugcaggacagaacaauacccgacagcgacauuucugcaucaucuuccuggagcgauucgaccgcggcucgucacucaaggcuggaguccucagacggagacggggccugguguccugcaggauccguguuccccaaagaggaggaguaccuucagguggaccuacaacggcuccaucucguagcacuggucgguacccagggacgccacgcuggaggccuugguaaggaguucuccagguccuacaggcugagauauucuagagacggucgcagauggaugggauggaaagaucguuggggccaagaagugauauccggaaaugaagaccccgagggaguaguacuaaaggaucuggguccccccaugguguag

SEQ ID NO: 14821 - RNA, 540 nt, Artificial Sequence
  Description of Artificial Sequence: Synthetic coding sequence
auggggucuaguggacugcuuuccuuauugguucuguucgugcucuuggccaacgugcagggucccgggcugaccgauugguuauuccccaggaggugcccgaaaauaagagaggagugcgaauuucaggaacgagacguguguacuaaagaucgccagugucaagacaauaaaaaaugcugcguauucaguugugggaagaaaugucuggaucucaagcaagauguaugugaaaugcccaaagaaaccggcccaugucucgcuuacuuccuucauuggugguaugacaagaaagauaacacguguucaauguuugucuacggggggugucaaggaaacaauaauaacuuucaaagcaaggccaacugucuuaauacuuguaagaauaaacagcccugcccaaagaucaaaguggagugugaggucgaggagauagaucagugcaccaagccaagagauuguccggaaaauaugaaauguugcccauucagcaggggcaagaaauguuuagacuucagaaaagcaagccucaguacuuag

SEQ ID NO: 14822 - RNA, 438 nt, Artificial Sequence
  Description of Artificial Sequence: Synthetic coding sequence
auguuauuuaggaaccgauuccugcuucugcucgcccuugccgcacuucuggcuuucgugucacuuucccuacaguuuuuccacuugauccccgugucgacucccaagaauggaauguccaguaaauccaggaagagaauuaugccggaccccgugacugagccucccgugaccgaccccguuuaugaagcucugcucuacuguaauauucccucuguagcugagagaaguauggaaggacaugccccacaccacuuuaagcugguuuccguccacguauucauccgccacggugacagguacccucucuacgugaucccuaagacuaagcgacccgagauugauuguacccuuguggcuaaucggaaaccauaucaccccaaacucgaagcuuuuauuucucacaugucaaaagguaguggagccucuuuugaauag

SEQ ID NO: 14823 - RNA, 399 nt, Artificial Sequence
  Description of Artificial Sequence: Synthetic coding sequence
augggaccugaggcacugucaagucuguugcuacugcuacucgucgccuccggggacgccgacaugaagggccauuuugaccccgccaaaugccgguaugcccuagguaugcaggauaggaccauccccgauuccgauauaucagcuuccucaucaugguccgacucaaccgcagcccgccauucaaggcuggagagcuccgauggggacggugcauggugccccgccggcucagucuuucccaaggaagaggaauauuugcaaguggaccugcagagacugcaucuuguggcgcucguggggacacagggucgacacgcuggcggacuugggaaggaauuuaguaggucauaccgccugagauacagcagggacggccgcagauggaugggaugguag

SEQ ID NO: 14824 - RNA, 306 nt, Artificial Sequence
  Description of Artificial Sequence: Synthetic coding sequence
auggggcccgaggccuuaucaucacuucuuuuacuccucuuaguugccucuggugacgcagacaugaaaggucauuuugacccagcuaaaugccgauacgcacuuggaaugcaggacagaaccauaccagacagcgacaucagcgcaucauccucuuggucugacucaaccgcagcaaggcacucucgucuggaaaguagcgacggcgauggagccuggugucccgccggaagcguguucccaaaggaggaggaguaccugcaagucgaccuucagcgccuucaucucguggcacucgugggguag

SEQ ID NO: 14825 - RNA, 393 nt, Artificial Sequence
  Description of Artificial Sequence: Synthetic coding sequence
augcuggccccacuuuuucugugcuguuugagaaaucuguucaggaagcuuauuuccuuccagcccccccaguuaggucgaacuaacaugcauuauagcaagcucccacgcaccgccaucgaaacagaauuuaagcaaaacgucgggccccccccgaaggaucucacugccgaagucuauuuucccuccauuaagucccgcucucaccuccccgccguguuuuauaaucaguauuucaagcaucccaaaugcgucggagaguaugggccgaaaaacggagcugaacgccagaucgaggaaagaaaaguauugccgacaacuaugauguucuccaugcucgccgacugcguccugaagaguacucccauaccuauucuugguguugccauguag

SEQ ID NO: 14826 - RNA, 420 nt, Artificial Sequence
  Description of Artificial Sequence: Synthetic coding sequence
augcccgcgaucgccguccucgcugccgcugcugccgcaugguguuuccuucagguagaaagccgucauuuagacgcucucgcaggcggagccgggccaaaccacggcaauuuuuuggacaacgaccaauggcucuccaccguuucgcaguacgaccgggacaaguacuggaaccgauuucgcgaugaugauuacuuuaggaacuggaacccaaacaagcccuuugaccaggcccucgaucccucuaaagaucccugucugaaggugaagugcuccccccacaaagugugcgugacucaggauuaccaaacagccuuaugugucucgcgcaaacaccucuuaccccggcagaagaaaggaaaugucgcacagaagcacugggugggaccaucuaaccucgucaaguguaagccuuguuag

SEQ ID NO: 14827 - RNA, 510 nt, Artificial Sequence
  Description of Artificial Sequence: Synthetic coding sequence
augagacucuugauacugacgugucuuguggcuguggcccucgcucggccuaagcuuccccuccgauacccugaaaggcuccagaacccauccgagucgagcgaaccuaucccccuagaaucccgagaggaguacaugaacggaaugaaccgacaaaggaauauccugagggagaaacagacagacgaaauuaaaaacugcguaguugccgaaccagaaaagauggaaucaucuaucaguucuuccuccgaagagcaguucugcagacugaaugaguacaaucagcugcaauugcaagcagcucaugcgcaggagcagauucgcaggaugaacgaaaauagccaugugcagguuccuuuucaacagcuaaaccaacuggccgccuacccuuaugcagugugguacuacccucaaauuaugcaauacguacccuuuccacccuucagugacauaucuaacccgaccgcucacgaaaacuaugaaaaaaacaacgugaugcuucagugguag

SEQ ID NO: 14828 - RNA, 921 nt, Artificial Sequence
  Description of Artificial Sequence: Synthetic coding sequence
augaagaaagaugaaccaccacuugacuuccccgacacccuagaaggcuucgaguacgcuuuuaaugaaaaaggccaacuacgccacauaaagacgggugaaccauucguguucaauuaucgagaggaucugcaccguuggaaccaaaaaagauaugaggcgcugggcgagauaauuacaaaauacguguaugaacugcuggagaaggacugcaaccugaagaaagucucaaucccugaagguuacgggguuaucgugcucaauccgaaugagaauuauauagagguugaaaaaccuaagauucacguccagucaucgucagacucaucugaugaaccagcggagaaaagggaaagaaaagauaaagugaguaaggagacuaaaaaacggcgagacuucuaugaaaaguaccggaacccccagagagagaaggagaugaugcaguuguauauuagagagaaugggucccccgaagaacacgcuauuuaugucugggaccacuucaucgcucaggccgccgccgagaauguuuuuuuuguagcacacaguuaugguggauuagccuucguggagcucaugauucagagagaggccgauguaaagaacaaggucaccgccguugcacucaccgauuccgugcauaauguuuggcaccaggaagcagggaaaaccaucagggaguggaugcgagagaauuguugcaauuggguaucaagcucugaaccucucgacacauccguggagucuauguugcccgacugcccaagagugucagcugggacugaucgacacgagcucacuagcuggaagagcuuuccuucaauuuucaaguucuuuaccgaggccucagaagcaaaaaccuccucacucaaaccugccguuacaagaaggucacaucgaauuaaacacgaagaacuuuag

SEQ ID NO: 14829 - RNA, 2862 nt, Artificial Sequence
  Description of Artificial Sequence: Synthetic coding sequence
ugacagcuuuguugguugccacuacuugcuccucucuugcucuugagaccaccuggcguucagucugccgggccaauucgggccuucguugucccucacucgcacauggaugucgguuggguguacaccguucaagagagcaugcgggccuaugcugccaauguuuacacaucagucguggaggaacuggcacgaggacaacaacggagguuuaucgccguggagcaggaguuuuuuagauuguggugggacgggguggcuucagaucagcaaaaauaucaggugcggcaguuacuggaggagggucgguuggaguuuguuaucgggggacagguaaugcaugacgaggcugugacucaccuggacgaucaaauccuacagcucaccgaaggacauggcuuucuguacgagacauuuggaaucaggccacaguuuucguggcaugucgacccuuuuggggccagcgccacaaccccuacucuguuugcccuugccggauucaacgcccauuuaggcuccaggauugauuaugaccucaaggcugccaugcaagaagcucgaggauugcaguuuguguggcgcggaucuccuucccugucugagcgucaggaaauuuuuacucauauuauggaccaguauuccuacuguacgccuagucauauuccuuuuagcaauaggucaggcuucuauuggaacggagucgcaguguuccccaaacccccgcaggaugguguauauccaaauaugagcgagccuguaacccccgcgaauauaaaccucuaugccgaggcgcucguagcaaacgucaaacagagagcagccugguuucgaaccccccacgugcucuggcccugggguugcgacaagcaguuuuucaacgcgaguguccaauuugcaaacauggacccacuucuugaccauauuaacucacacgcggcagaacucggaguuucaguccaguacgccacacuuggugauuacuuucgcgccuugcacgcauugaaugucacauggagagucagagaucaucaugacuucuugcccuacagcacugaaccauuccaggcauggacggguuuuuauacuucuagguccucacuaaagggcuuagccaggcgagccuccgcccugcuuuaugcgggagagucuauguucaccagauaucucuggccagcuccucgcggccaccuggauccuacuugggcacuccagcaguuacaacagcuucggugggcagugucugaaguucaacaucacgaugccaucacuggaaccgagucacccaaggugagggacauguacgcuacgcaccuagccuccgguauguuaggaaugagaaaacugauggccagcauaguguuagacgagcuacaaccucaggcacccauggcugcuuccagcgaugccggaccugccggccacuuugcaaguguuuacaaucccuuagccuggaccgugacaacuauagugacauuaacggugggcuucccggggguuagggugaccgacgaagccggccaucccguuccgucacagauccaaaacucaacagagacuccuucugcuuacgaccuucucaucuugacuacuaucccaggcuugucuuaucgacauuacaacauuagaccuacagcuggcgcgcaggagggaacacaagaacccgcagcuaccguggcguccaccuugcaguuugggcgcaggcuucggaggaggacuucccacgcaggccguuacuuagucccagucgccaaugauugcuacauuguguuacucgaccaggauaccaauuugaugcacucuauuugggaacggcagagcaacagaacagucaggguuacacaagaguuccuugaauaucauguuaacggagaugugaagcagggcccgauuagcgacaacuaccuuuuuaccccaggcaaagcugcagugccagcaugggaagcugucgagauggagaucgucgcugggcaguuagucaccgagaucagacaauacuucuaccgcaauaugacugcccagaauuauacauacgccauccggucacgccugacccacgugccccagggacaugacggagaacugcuaugccacaggaucgagcaggaguaucaggccgggcccuuggagcuaaauagagaggcugucuuacgaaccaguacuaaccucaacagccagcaggugauuuacucagacaauaauggauaccagaugcagcgacggccauaugugagcuacgugaauaauaguauugcacggaauuacuauccuauggugcagagcgcuuuuauggaagaugggaaaagcagacucgugcugcucucugaacgggcacacggcauuucaagucaaggaaaugggcagguugaaguuaugcuccacagacgucuuuggaacaauuuugacugggacuuaggcuacaauuuaacccucaaugacacuuccgucguccaccccguucuuugguuguugcugggaaguuggagccugacaacagccuugaggcaacgauccgcacuggcgcuucagcauaggccugucguucucuucggcgaccuagccggaaccgcacccaaauuaccagggccucagcaacaagaggcaguuacucuaccacccaaucuucaucuucagauucuuaguauucccggcuggcgcuacucaagcaaucacacugaacauucgcaaaauuugaggaaaggacaccgcggagaagcucaggccgaucuccgcagaguccuacuacguuuguaccaccucuacgaaguuggugaagacccagugcuaucucagccagugacaguuaauuuagaggucaacuuccccaccccgauucaaaccaucucccagggcagcaaacccuag

SEQ ID NO: 14830 - RNA, 459 nt, Artificial Sequence
  Description of Artificial Sequence: Synthetic coding sequence
augcgauucaagacuacugccaaggauggacuucugcucuggaggggggauucaccaaugagaccaaacuccgauuuuauaucucugggccugcgggauggagcucucguguuuucuuauaaucucggaucaggaguugcaucuauuaugguuaauggaaguuuuaaugacgguagauggcacaggguaaaagcuguucgugauggucagagcgggaaaauuacuguggacgauuacggggcucgcacaggcaaaaguccggggaugaugcgacagcugaacauuaauggugcucucuacgucgggggcaugaaagaaaucgcccuucacaccaacagacaauauaugagaggacugguaggcuguaucucacacuuuacccugagcacggauuaucacauaagucucguggaggaugcaguggacgggaagaacaucaacacuugcggagcgaaauag

SEQ ID NO: 14831 - RNA, 1701 nt, Artificial Sequence
  Description of Artificial Sequence: Synthetic coding sequence
auggacuuucuccuggcccugguauugguauccucccucuacuuacaggcugcagcugaguuugacggucguuggccgagacagauaguuucuucuauugguuugugcagauauggggggcgcauugauuguugcuggggcugggcgcgccagucauggggucagugccagcccgugugucaaccgagaugcaaacacggagagugcauaggacccaauaaaugcaagugucacccuggcuaugccggaaagacaugcaaucaagaugaacauauccccgccccucuugaccaagguucugaacagccauuguuccaacccuuagaccaccaagcgaccucccugccuucucgagaucucaaugaguguggguugaagccuaggccuugcaagcacagauguaugaauacguauggcucuuacaaauguuacugccuaaacggauauaugcucaugccagauggaucguguagcucagccuugacuuguucuauggcuaacugucaguaugguugugacguggugaaaggccagauucgcugccaauguccuagcccaggccuccaacuagccccugauggacggacguguguggacguugacgagugcgcuaccggucgggcuucuuguccucgcuuucgacagugcguaaacaccuucgguuccuauauaugcaagugucacaagggguuugaccuuauguauauugggggaaaguaucaaugccaugacaucgacgaauguagcuugggccaguaucagugcaguuccuucgcaagaugcuacaauauacgaggaucuuauaagugcaaaugcaaggaagguuaccaaggagaugggcuuacaugcguuuauauucccaaggugaugauagagccaucagggccaauacaugucccuaagggcaacggaaccauccugaaaggcgacacagggaauaauaauuggauaccugacguaggaaguacaugguggccuccuaagacuccguacauaccuccaaucaucaccaaccgccccaccagcaaaccaacaacccgaccaacuccuaaaccaacccccauacccaccccuccucccccgccaccccugccaacugaacuucguacgccccugccuccuaccacaccagagcggccuacuacuggacuaacaaccaucgccccagcugcaucuacuccuccugguggcauuacuguagacaauagagugcaaaccgacccccaaaagccacgaggagaugucuuuucuguauuagugcacucgugcaauuuugaccauggcuuguguggauggaucagggagaaggauaaugacuugcauugggaacccauuagggacccggccgggggacaguaucuuaccguaucagccgcgaaagcgcccggaggaaaagccgccagacuuguguugccacugggccgacuuaugcauaguggcgauuugugucucagcuuccgccacaaagugacaggccuacauucagggacacugcagguguucgugcggaaacacggggcgcacggggcugcauuguggggcagaaaugguggacauggcuggaggcagacacagauuacucuacggggagcggauaucaagucggugguauuuaagggugaaaaacggagggggcauacaggagagaucggacuggacgauguuucuuugaagaaaggacauuguuccgaagaaagauag

SEQ ID NO: 14832 - RNA, 213 nt, Artificial Sequence; identical to SEQ ID NO: 13193
  Description of Artificial Sequence: Synthetic coding sequence

SEQ ID NO: 14833 - RNA, 237 nt, Artificial Sequence; identical to SEQ ID NO: 13194
  Description of Artificial Sequence: Synthetic coding sequence

SEQ ID NO: 14834 - RNA, 339 nt, Artificial Sequence
  Description of Artificial Sequence: Synthetic coding sequence
augagauucaaaacaaccgcuaaggauggacuguuauuguggaggggagacucaccuaugcgcccaaauucagauuuuauuucccugggccugagagauggcgcucuuguguucuccuacaaccuugggucugguguagcuucuauuauggugaacggcuccuuuaaugacggacgauggcacaggguuaaggcaguuagagacggacaguccgguaagaucacagucgacgacuauggagcucguaccggcaagucuccaggaaugaugaggcaauugaacaucaauggugccuuguacgucggaggcaugaaagagaucgcacuacacacuaauuag

SEQ ID NO: 14835 - RNA, 2685 nt, Artificial Sequence
  Description of Artificial Sequence: Synthetic coding sequence
augucuuugccucgcugcuguccacauccacugcgaccggaaggaagcggugccaugggccccgaagcccucuccucccugcucuuauuacuccuugucgcauccggggacgcugacaugaaaggucauuuugaccccgccaagugccgauaugcccugggaaugcaggaucguaccaucccugacagcgacauuucagcuucuuccucauggagugauaguaccgccgccagacacagucgccucgagucuucugacggugauggggccuggugcccggcaggaucagucuuuccgaaagaagaggaauauuuacagguggaucuccaaagacugcaucugguugcacucguagggacccaaggacggcacgcagguggacuggguaaggaguucagcagguccuauaggcuucgcuacucaagggacggccgccgguggaugggcuggaaggauagguggggucaagaggugauaucugggaacgaagaucccgagggagucguauugaaggaccugggaccaccuaugguagcucgacugguacguuucuacccgagagcagauagagugaugucggucugccucagagucgaauuguauggcugucuguggagagacgggcugcugucauacaccgcaccuguggggcaaacaauguaccuaagcgaagccgucuacuugaacgauucaacauaugauggucauaccgugggaggucugcaauacggaggauuaggacaacuggcagauggcguggucggccuggacgauuuccggaaaucucaggagcugcgcguguggccggguuacgacuaugugggcuggagcaaccacagcuuuuccaguggcuauguggaaauggaauucgaauucgauaggcugagggcuuuccaggcaaugcagguacauugcaacaauaugcacacacugggcgcucggcucccuggaggcguggaaugcagauuuagacguggccccgcaauggcuugggaaggggaaccuaugagacauaaccugggagguaacuugggcgacccucgugccagggcugugucuguuccacuaggcggaaggguugcacgauuccugcagugccgcuucuuguucgccggacccuggcugcuguuuagcgaaauuaguuuuaucagcgaugugguuaauaacucaucaccagcuuugggagguacuuucccuccagcaccaugguggccaccagggccaccacccacuaacuuuuccucgcucgaauuggaaccccgaggucagcagccuguugcuaaagcugaaggaucaccuacugccaucuuaaucggcugccugguugccauuauccuguuguuacuguuaauuauugcucucauguuauggcggcugcauuggcggcgccuguuguccaaagcugagcgccggguccucgaagaagagcugaccguucaccugagcguuccaggagacacaauucucauuaauaaccgcccagguccccgagagccucccccguaucaggagccaaggccuagaggcaauccaccacauagcgcaccuugugugccuaauggaagugcguacuccggcgacuauauggagcccgagaagccuggcgcaccacugcugcccccuccuccccaaaauagugugccacauuaugcugaggcugacauugugacccuccaaggugugacggggggcaauacauacgccguaccugcuuugccgcccggugccguaggagauggaccgccacgaguggacuucccaagaagcaggcugagauuuaaagagaaacuuggugagggccaguuuggcgagguccaucugugcgaaguggauucaccucaggacuugguuucuuuggauuucccacugaacguuaggaaagggcacccacugcugguggcuguaaaaauucugagacccgaugcaacuaagaaugcucguaacgauuucuugaaagaaguuaagaucaugucucgauuaaaggacccuaauauuauucgacuucuuggcgucugcguucaggaugaccccuuaugcaugauaaccgacuacauggagaauggcgaucugaaccaauuucugagugcucaucagcuggaggacaaggcugcagagggggcaccaggcgauggucaggcagcucaaggaccuacuaucagcuauccgauguuguuacauguugcugcucagauagcgaguggaaugcgguauuuggcaacacugaacuucgugcaccgcgaucucgccacaagaaacugucucgucggagagaauuuuacuaucaaaauagccgauuucggaaugucuaggaaccuuuaugccggcgauuauuaucggguucaggggcgcgcuguccuuccaauccgguggauggccugggaaugcaucuuaauggguaaguuuaccacagccuccgacguaugggcuuuuggugugacacugugggaagucuugaugcuaugcagagcacaaccuuuuggccaauugacggaugaacaggugauugagaacgccggagaauuuuuuagagaucaggggcgccaggucuaucuuucccguccgcccgcaugcccacaagggcuguaugaacugaugcuccggugcuggucuagagaaagcgaacagagaccccccuucagccagcugcacagauuccuggccgaggacgcucugaacacgguuuag

SEQ ID NO: 14836 - RNA, 384 nt, Artificial Sequence
  Description of Artificial Sequence: Synthetic coding sequence
augggacccgaggccuugaguucccugcuguuacucuuacucguugccuccggugaugccgauaugaagggccauuucgaucccgcaaagugcagauacgcacuggggaugcaagauagaacgauaccugauagugacauaucugccucauccaguuggucagacaguacagcggcaaggcauagccgccuggagagcuccgacggcgauggagcauggugcccggccggaucuguguuuccuaaggaagaggaguaccugcaaguagaucugcagagauuacaccuuguagcacuugucggaacgcaaggcaggcacgcgggcggacugggcaaagaauucucgaggucguacaggcugagauacucaagggauggaagauag

SEQ ID NO: 14837 - RNA, 1113 nt, Artificial Sequence
  Description of Artificial Sequence: Synthetic coding sequence
augaagaaagacgagccuccccuggacuuucccgacacuuuagaaggauuugaguacgccuucaacgagaaaggacaacugagacauauuaaaaccggagagccguucguguuuaacuaucgcgaagaccugcaccguuggaaccagaaaagauacgaggcccugggcgaaauuaucacaaaauacguauaugagcuacucgaaaaggauugcaaucucaagaagguuuccaucccaguagaugccaccgaguccgaaccaaagaguuucauuuucaugagugaagaugcccugacuaacccucagaagcuuauggugcuuauccacgguucugggguuguaagggcgggacaaugggccaggcgucugauuaucaaugaggaccuugauuccggcacacagauucccuucauaaaacgcgccgucgcggaaggauacggggugaucgugcugaauccaaacgaaaauuauauugagguggaaaaaccuaaaauucacguccagucaagcagugauaguagcgacgaaccagcagagaagagagagaggaaagacaaaguuaguaaagaaaccaagaaacgaagagauuuuuacgagaaguaucggaauccgcaaagagagaaagaaaugaugcagcuguacauuagggaaaacggaaguccugaggaacacgcuaucuacgugugggaucauuucaucgcccaggcagccgcagaaaacguguucuucgucgcucacucauacggcggacuugcauuuguagaauuaaugauccagagggaggccgacgucaagaauaaagugaccgccguggcccucaccgauagugugcacaacguuuggcaucaagaagcaggaaaaacaauaagagaauggaugagagaaaacuguugcaauugggugagcuccucugagccacuugauaccucuguugaguccauguugcccgauugcccuaggguaucagcaggaacugaccggcacgaacugaccucauggaagucuuucccuagcauauucaaauucuuuacggaagcuucagaggccaaaaccucuagucuuaaaccugcaguaacccgccgaagccaccgcauuaaacacgaagaguuguag

SEQ ID NO: 14838 - RNA, 435 nt, Artificial Sequence
  Description of Artificial Sequence: Synthetic coding sequence
augaaaacaggguuauuuuuucuguguuugcucgggacugcagccgcuauaccuaccaaugcccgcuuguugucugaucauuccaagccgacugcagagaccguggccccggacaacaccgcaauucccuccuuaagagcagaagccgaagaaaacgaaaaagaaaccgcugugaguacagaggacgauagucaucacaaagccgaaaagucaucagugcugaagaguaaggaagaaagucaugagcagagcgcugaacaaggcaagucaagcucacaagaauuggggcugaaggaucaggaggauagcgauggacaucugagcgucaauuuggaauaugcccccacagaaggaacccuugacauuaaagaggauaugagcgaaccucaggaaaagaaacuuagcgagaacacggauuucuuggcaccaggguag

SEQ ID NO: 14839 - RNA, 1341 nt, Artificial Sequence
  Description of Artificial Sequence: Synthetic coding sequence
cugacucuccacucucucacguguuacgaggaccuggucaccuuccuccagcagucuauucaccaauuugaagucggccccuacgguugcauuuuacucacauuaucugccauccugucgagauccaccgagcuuauccgccaggacuuugacgugcccacgagccaucuuauuggagcacacggauauuguacccaagaacucgugaaccugcuccuaaccggaaaggcaguuagcaauguuuuuaaugacgugguagagcucgacucaggggacgggaacaucaccuuacuaaggggcauagcugcgcggucagacauuggguuucucagccucuucgaacacuauaacaugugccaaguaggguguuuuuugaaaacgccccgauuuccaauauggguugucugcucugaaucacauuucaguaucuuauucucacugcagccaggacugcugcgagacuggcgcaccgaacgacuguuugaucuuuacuauuacgacggccuugcgaaucagcaggaacagauccgacuuacuaucgauacuacacagaccaucuccgaggacaccgacaaugaucucgugccuccauuagagcuguguauucgcaccaacaucgguucagcccugggauucaaguaccccgugggaaacaaccagaccgcaguacaggacaacgugaaaguaucccuggccuucgggcuuuccauugccaccuuagcacaauccgucggacacaucagcggcgcucaccuaaaucccgcaguuacccucggccuacuccuuuccugccagauuucgauuuuccgggcauugauguacauuaucgcacagugcgucggagcgauagucgcuaccgcaauccugagcgggaucacaagcucuuuaaccggcaacagccuggggaggaaugaucuugcggauggagucaacucugggcaggggcucgguaucgaaaucauugggacucuucagcucgugcucuguguucucgcaacaacugaucggcguagacgagauuuggggggaagugccccuuuagccaucgggcucagcguggcucugggucaccuuuuggccaucgauuauaccggcugcggaaucaauccugcacgaaguuucgggucagccguaaucacacauaauuuuagcaaucacuggaucuuuuggguuggccccuuuauuggcggcgcauuagcgguguugaucuaugauuuuauccuggcacccagauccagcgacuugaccgacagagugaaaguguggacaucaggacaaguggaggaguacgaucucgacgcugaugauauuaauuccagaguugaaaugaagcccaaguag

SEQ ID NO: 14840 - RNA, 81 nt, Artificial Sequence; identical to SEQ ID NO: 13201
  Description of Artificial Sequence: Synthetic coding sequence

SEQ ID NO: 14841 - RNA, 348 nt, Artificial Sequence
  Description of Artificial Sequence: Synthetic coding sequence
augggucccgaagcccuuucuagucugcuguuacugcuguuaguggccuccggagaugccgauaugaaaggacauuuugauccagcuaaaugucgcuaugcccuuggaaugcaggaccgaacaauucccgauucagacaucucugccagcuccucuuggagcgauucaaccgcggcuaggcacucucgucuggaguccucagacggugauggugcauggugccccgcaggaucuguuuuucccaaggaagaggaguaccuccagguggauuugcagaggcugcaccugguugcccuggucgggacacaaggacgacaugcuggaggucuaggaaaagaauuuaguuag

SEQ ID NO: 14842 - RNA, 165 nt, Artificial Sequence; identical to SEQ ID NO: 13203
  Description of Artificial Sequence: Synthetic coding sequence

SEQ ID NO: 14843 - RNA, 351 nt, Artificial Sequence
  Description of Artificial Sequence: Synthetic coding sequence
auggugcuacuacacuggugucuccuuugguuguuguuuccucugucuagcagaacacagaaacucccaacgagggaugaggaauuguuucaaaugcagaucagagauaaggccuucuuccacgauaguuccgugaucccugacggcgccgagauuuccuccuaccuguuccgggacacuccaaaaagauauuuuuucgucguagaggaggacaauacaccccugagcgugaccguuacccccugcgaugccccucuggaauggaaacuuagccugcaagagcuaccugaagacagauccggugaaggcaguggagaucuggaacccuuggagcagcagaaacagcaauag

SEQ ID NO: 14844 - RNA, 432 nt, Artificial Sequence
  Description of Artificial Sequence: Synthetic coding sequence
auggggccugaagcacucuccuccuuacuucugcugcuccuggucgcauccggcgaugcagauaugaaaggccauuuugauccagccaaguguagguacgcacugggcaugcaggauagaacuaucccagauucugauauuagcgccagcucauccuggucggacuccacugcagcaaggcacucacggcuagaaucuucagacggcgacggagcaugguguccugcugggaguguuuuuccaaaagaagaagaauauuuacaagucgaccuucaaagacugcaucucguggcacuggugggcacccagggucggcacgccggaggucucgggaaggaauucucuagaaguuauagacucagauacagcagggacgggcggagauggaugggcuggaaagaucggugggggcaggagguaauuucaggguag

SEQ ID NO: 14845 - RNA, 747 nt, Artificial Sequence
  Description of Artificial Sequence: Synthetic coding sequence
auggaauuacuccaagugaccauacuguuccugcuucccucgauuuguaguuccaacucaacuggcguucuggaggcagccaauaacaguuuagucgugaccacuacaaaaccuucaauuacuacucccaauacggaaagucugcagaagaacgucgucacucccaccaccgguaccaccccuaagggaacuaucacaaaugagcugcugaaaaugucucucauguccacugccacuuucuugaccaguaaggaugaaggucucaaagcuaccacaaccgaugugagaaaaaaugacagcauuauaucaaaugucaccguuacuucgguuacacuuccaaacgcaguaagcacgcuacaaaguucaaaacccaaaagcuccgugcuccaacccgaugcuucuccaucuaaaacaggcacacucacuagcaucccagugaccauuccagagaauaccagccaaucacaaguuaucggcaccgaaggugguaagaaugccucuacuagugcaaccucacgguccuacuccuccaucauccugcccguugugaucgcucuuaucguuaucacacugucaguguucgugcuggucggauuguauagaauguguuggaaggcagacccaggaacacccgaaaauggcaacgaccaaccucagucagauaaggaauccgugaagcugcugacaguuaaaaccauuucucacgagagcggagaacacagugcccaaggaaagaccaaaaacuag

SEQ ID NO: 14846 - RNA, 363 nt, Artificial Sequence
  Description of Artificial Sequence: Synthetic coding sequence
augaagacgggccuuuucuuucugugccuucuuggcaccgcugcugcgauacccaccaacgcucgccucuugucagaucauucaaaaccuacagcugagaccgucgccccugacaacacagcuauaccuucacugagagccgaggccgaagagaaugaaaaagaaacggccgucagcaccgaagaugauucacaucauaaggccgaaaaaucuaguguacucaagaguaaggaagaaucucaugaacaaucagccgagcagggaaagucauccucucaggagcuaggacugaaagaccaggaagacucagacggccaccugucaguaaacuuggaauaugcaccaaccgaaggaacccuguag

SEQ ID NO: 14847 - RNA, 339 nt, Artificial Sequence
  Description of Artificial Sequence: Synthetic coding sequence
augggacccgaagcccugaguucgcugcuccugcucuuacuugucgccagcggugaugcugauaugaaaggccacuucgauccagccaagugccgcuaugcacugggcaugcaagaccggaccauuccagacagcgauauuucagcauccuccucguggucagauuccacggcagcacgucacucaaggcuagaaaguucagauggagacggcgcauggugcccagcagggagcguauuucccaaagaagaggaguaucugcagguagaccuccagcggcugcaucuugucgcgcuggugggcacacaaggcagacacgcaggaggcuuagggaaguag

SEQ ID NO: 14848 - RNA, 513 nt, Artificial Sequence
  Description of Artificial Sequence: Synthetic coding sequence
augggucccgaggcccuuagcagccugcugcuucuacuguuaguagccagcggcgacgccgacaugaaagggcauuucgaccccgccaaaugcagguacgcccuuggcaugcaggauaggacuaucccugauagcgauauuuccgccagcaguuccuggucugacucaacggccgcccgccauagccgcuuagagucuuccgauggcgauggagcuugguguccggccggaaguguuuuuccuaaagaggaggaguacuuacagguugaucuacaaagacuucaccuugucgccuuaguggggacucagggucgccaugcgggcggucugggcaaggaguucucacguagcuauagacuaagguacucucgggacgggcggagguggaugggauggaaggaccgcuggggccaggaagucauaucugggaaugaagacccugaaggaguuguuuugaaggauuuaggccccccaaugguggcaagacugguuagauucuauccaagggcguag

SEQ ID NO: 14849 - RNA, 417 nt, Artificial Sequence
  Description of Artificial Sequence: Synthetic coding sequence
augggaccugaggcucuuagcuccuuacugcuucuucuucugguggcaaguggcgaugccgauaugaagggacacuucgacccggcaaaguguagauacgcccuugguaugcaggacaggacaauuccggacagcgauaucucagcauccaguagcuggucugauagcacagccgcgaggcauucucgauuggaauccucugauggcgacggcgcuuggugcccugccggaaguguguuuccuaaggaggaagaauaucuccaaguggaucuucagcgacugcauuuaguggcauuggugggcacucagggacggcacgcgggcgggcuaggaaaggaguucucaaggaguuacagacugagguacagccgagauggaaggcgguggaugggguggaaagaucgaugggggcaauag

SEQ ID NO: 14850 - RNA, 285 nt, Artificial Sequence; identical to SEQ ID NO: 13211
  Description of Artificial Sequence: Synthetic coding sequence

SEQ ID NO: 14851 - RNA, 156 nt, Artificial Sequence; identical to SEQ ID NO: 13212
  Description of Artificial Sequence: Synthetic coding sequence

SEQ ID NO: 14852 - RNA, 2760 nt, Artificial Sequence
  Description of Artificial Sequence: Synthetic coding sequence
augggcccugaagcccuguccucauuacuuuuauuguuacuggucgccagcggugaugcugacaugaaaggccauuuugacccagcaaaaugccgguacgcccugggcaugcaggaccgaacuaucccugacagugacaucucugcuuccucuuccugguccgacuccaccgccgcuagacacucucgguuggaaagcucagacggagauggugcuuggugcccugccggauccgucuuccccaaggaagaagaauaccugcagguggaucugcagagauugcauuuagucgcccugguagggacacagggccggcacgcggguggccucggcaaggaguuuucacgaucuuacaggcuuagauauaguagagauggacgccgcuggaugggauggaaagauagauggggucaggagguaaucucugguaaugaagauccggaaggagucgugcuaaaagaccucggaccaccgaugguggcccggcuuguaagguuuuauccaagggcagauagggugaugagcgugugucugagaguagagcucuauggcuguuuauggcgagacgguuuacugagcuacacagcuccagucgggcagacuauguaucucagugaagccguguaccucaaugacucaacuuaugacggucauacugucggggggcuucaguacgguggauugggacaacuugcagacggaguggucggauuagacgauuucagaaaaagccaggagcugcguguuuggccaggguacgauuauguuggaugguccaaucacagcuucucuagcgguuauguggaaauggaguucgaguucgauagacuccgagcuuuucaagccaugcaggugcacuguaacaacaugcacaccuuaggggcucgccuucccggagggguagaaugccguuuuagaagaggccccgccauggcuugggagggcgaaccuaugcgucauaaucugggcggcaaucucggagacccuagagcccgcgcagugagcguaccucuuggugggcggguggcucguuuccuacagugccgauuccuuuuugccgguccuuggcugcuauuuagugaaaucagcuuuauuagcgacgucguaaacaauuccucaccagccuuaggugggaccuuuccucccgccccuugguggcccccuggaccaccucccaccaacuucagcucuuuagaacuugagccaagaggccagcaaccuguagccaaggccgaagggaguccaacugcuauccugauagggugccuagucgcgaucauucucuuacuccugcucaucauugcccugaugcucuggcgcuugcacuggcgucgacuguuaucaaaggccgagcgccgcgugcuggaggaagagcuuaccgugcaccugagugugcccggagacaccaucuuaaucaauaauagacccgggccgagagaaccuccccccuaccaagagccuagaccucgcgguaacccaccucauuccgcuccguguguaccuaacggcuccgcccuguugcucuccaacccagcuuauagguuacugcuagcaacauacgcaaggcccccacgcggucccggcccuccuacccccgcuugggcuaaaccgacaaacacccaggccuacuccggugauuacauggaaccugagaaacccggagcgccacuuuugcccccucccccucagaacucugucccacauuaugccgaagcggacaucguaacucuccagggagugaccggggggaauacauacgccgucccagcucucccccccggcgccgugggugacggcccgccccguguugacuucccccggucaaggcuucguuucaaggagaaacuuggugaaggccaguuuggagaagugcacuuaugcgaggucgauagcccccaagaucuagucagccucgacuucccccuuaaugugcgcaaaggacauccacuguugguugccgugaagauccuccgaccugaugcaacaaagaaugccuccuucagucucuuuuccagaaacgacuucuuaaaggaagugaagaucaugagccggcugaaagauccuaauauuauuagauugcuggguguuuguguccaggacgauccacucuguaugaucaccgauuacauggaaaauggagauuugaaccaauuccucucugcucaccagcuggaagauaaagccgccgagggcgcccccggggauggccaagcugcacaaggaccuacgauuaguuauccaaugcuguuacauguagccgcacagauagcuaguggaaugcgauaccuggccacacugaauuucgugcauagagaucucgccacucguaauugcuuggugggagaaaacuucacuauuaagaucgccgauuuuggcaugucgaggaauuuguacgccggggauuauuaccgaguucagggaagagcaguucucccgauccgauggauggccugggaaugcauucucauggggaaauucacuaccgcuuccgaugucugggccuuuggugucacucuuugggaaguccugaugcuuugucgagcccagcccuucggccaguugacggaugaacaaguaaucgagaacgcaggcgaauuuuuccgcgaucaaggucgccagguauaucugagucggccuccggcauguccgcaggggcuguacgagcugaugcuaagguguugguccagggaaucagaacagagaccaccauuuucacagcuucaucgauuccuagcagaagacgcacuaaauaccguauag

SEQ ID NO: 14853 - RNA, 318 nt, Artificial Sequence
  Description of Artificial Sequence: Synthetic coding sequence
augggugucucaaaguuagacauuuuguacagaaggcuucuccucaccaagcuguucauacgcggaugggggcgcccagaagauuugaagaggcuguuugaauucaggaaaaugauagguaacagggaaagaugccaaaaccuaguguccucggauuaccccguacauauagauaagaucgaggagcaaucagauuguaagauucuugacggccauuuugugaguccaauggcucacuacguacccgacauuaugcccaucgaaagcgugaucgccagguuccaguuuauugugccuaaggaauggaauaguaaguag

SEQ ID NO: 14854 - RNA, 126 nt, Artificial Sequence; identical to SEQ ID NO: 13215
  Description of Artificial Sequence: Synthetic coding sequence

SEQ ID NO: 14855 - RNA, 459 nt, Artificial Sequence
  Description of Artificial Sequence: Synthetic coding sequence
augcgcuucaagacuaccgcgaaagacggguuacugcuuuggcgaggcgacagcccaaugagaccaaacagugacuucauaucuuugggacuccgggauggugcccuaguuuucucuuacaaccuuggaucaggaguugcaagcaucaugguuaaugguuccuuuaaugaugggagguggcacagggugaaggccguucgagauggacaaaguggcaaaauaaccgucgacgauuacggcgcucgcacagggaagagcccaggaaugaugcgacagcuuaacaucaauggggcccuguauguuggcgggaugaaggaaaucgcacuccacacaaacaggcaguacaugagggggcuggucggcugcaucagucacuucacauuguccacugauuaucauaucucacuuguagaagacgcuguagacgguaagaauauaaauaccuguggugcaaaguag

SEQ ID NO: 14856 - RNA, 1611 nt, Artificial Sequence
  Description of Artificial Sequence: Synthetic coding sequence
auggauuuccuucuugcucugguucuggugucuucuuuguauuuacaggcugcagccgaguuugauggcagauggccccgucagaucguaucuucuaucggguuaugcagguauggaggccgcaucgacuguuguugggggugggcacgucaguccugggggcagugccagccagugugucaaccaagguguaaacacggcgagugcaucggcccuaauaaguguaaaugccacccggguuaugccggcaagacgugcaaucaggacuuaaaugaauguggucugaagccaagacccuguaagcaucgguguaugaauacuuacggaucuuauaaaugcuauugucugaacggcuacaugcuaaugcccgacgggucaugcuccagugcacugacguguucaauggccaacugccaguaugguugcgacguuguuaagggacagauacgaugucaaugcccgucucccggauugcagcuggcaccagacggccgaacuuguguagacguugaugagugcgcuacugggcgagccuccugcccuagauuccgucagugcgugaauacuuucggcuccuacauuugcaagugucauaagggcuucgaucuuauguauaucgguggaaaguaucagugccacgauauugacgagugcagucuuggacaauaccaaugcucuucuuucgcucgcuguuauaauauccgggguuccuauaaauguaagugcaaagagggauaccagggagacggacugacuuguguguauauucccaaagucaugauugagccuagcggcccaauacacguccccaaaggcaacggaaccauucuuaagggcgauacaggaaauaauaacuggauucccgacguugggucgacaugguggccacccaagacuccuuacauaccaccgauuaucacaaaccgccccaccagcaaaccaacaaccagaccgacaccaaaaccuacaccgauuccgacacccccaccaccgccuccuuugcccaccgaacuucgcacaccacucccuccuacuacgcccgagcgcccaacaacagguuuaacuacaauugccccagcagcaagcacaccgcccgguggcaucacaguugauaaucgcgugcaaaccgauccacagaagccgcggggagacgucuuuuccguacuuguccauuccuguaacuuugaccacggacuuuguggguggaucagagaaaaggauaaugauuugcauugggaaccuaucagagaucccgcggggggccaguaccucacaguguccgcugccaaggcuccaggugguaaagccgcacggcucgugcucccacuugguaggcugaugcacagcggcgacuuaugccucuccuucagacauaaagugacgggccuccauucaggaacucugcagguguucguucggaaacauggggcacauggugcugcccucuggggcaggaacggcggccacggauggcgucagacacagauuacgcugcggggggcagacauaaagaguguuguguucaaaggugaaaagaggaggggacauacaggggaaauugggcucgaugauguuaguuuaaagaaagggcacuguagcgaagagcguuag

SEQ ID NO: 14857 - RNA, 288 nt, Artificial Sequence; identical to SEQ ID NO: 13218
  Description of Artificial Sequence: Synthetic coding sequence

SEQ ID NO: 14858 - RNA, 213 nt, Artificial Sequence; identical to SEQ ID NO: 13219
  Description of Artificial Sequence: Synthetic coding sequence

SEQ ID NO: 14859 - RNA, 417 nt, Artificial Sequence
  Description of Artificial Sequence: Synthetic coding sequence
auggguccugaggcucugaguagccuuuugcuccugcugcugguugccuccggagaugccgacaugaaaggccacuuugauccggcgaagugccgcuacgccuuggggaugcaagaucgaacgauucccgauagcgauauuucugcuagcucaagcuggucagacucaaccgccgcccgacacucuagacucgaaucaucugacggcgacggugccuggugcccggcuggaagcguuuucccgaaagaagaggaguaccuucagguggacuugcagagacugcaccuuguggcccucguuggaacacaaggaaggcacgcaggcgggcucggaaaggaauucagccguucguacaggcuuagauauagcagggauggucgcagauggaugggguggaaagauagguggggccaguag

SEQ ID NO: 14860 - RNA, 219 nt, Artificial Sequence; identical to SEQ ID NO: 13221
  Description of Artificial Sequence: Synthetic coding sequence

SEQ ID NO: 14861 - RNA, 438 nt, Artificial Sequence
  Description of Artificial Sequence: Synthetic coding sequence
augguacuacugcauuggugucuguuauggcuacucuuuccacuaucgagucgaacccagaaauugccuacucgagaugaggaacucuuucaaaugcagauacgagacaaagccuuuuuccacgacucuagcgucaucccugacggggccgagaucucgagcuaucucuucagagacacaccgaagcgcuauuucuuuguggucgaagaggauaauaccccccugagcgugacggucacaccaugcgaugccccgcuugaauggaagcugagccugcaggagcugccagaggauagaucuggcgagggaaguggggaccuagagccucuagagcagcagaagcaacaaauaaucaacgaagaaggaaccgagcucuucuccuauaaagguaaugaugucgaauacuuuauuaguucauccaguccaagcggccuguag

SEQ ID NO: 14862 - RNA, 258 nt, Artificial Sequence; identical to SEQ ID NO: 13223
  Description of Artificial Sequence: Synthetic coding sequence

SEQ ID NO: 14863 - RNA, 1410 nt, Artificial Sequence
  Description of Artificial Sequence: Synthetic coding sequence
augcuaaaaguacacuauccuaaauuuggggucuccgaggacugucuuuaccuuaauaucuaugcaccagcccaugcggacacuggaucuaaguugccuguauuggugugguuccccggcggagcuuuuaagaccgggagcgcuagcauauucgaugggucugcacuggcugcauaugaagauguguugguugugguaguucaguacagacugggaauuuucggauucuuuaccacuugggaucagcaugccccaggaaacugggcuuucaaagaucagguugccgcucugagcuggguccagaaaaacauugaguucuucgguggugaccccucaucuguaacuauuuuuggugagagcgcaggugccauuucuguaucuucuuuaauucugucgcccauggcaaaggggcucuuccauaaagccauuauggaauccgguguugcuaucaucccauaucuggaggcucacgauuaugaaaaaagcgaggaccugcaggucguugcacauuucugugguaauaaugcauccgacucugaggcacucuugcggugucugaggacaaaacccaguaaagagcuuuugacauugucccaaaaaacuaagagcuucacccgugugguugacggagccuuuuuccccaaugaaccauuagaccuuuugagccagaaagcauucaaagcgaucccuucuauaaucggcgugaacaaccaugaauguggauuuuugcugccuaugaaagaggcacccgaaauucuguccggcuccaauaaaucuuuggcccugcaucugauccaaaauauccugcauauacccccucaauaucugcaccucguugccaacgaauauuuucacgauaaacauucccuuaccgaaauucgcgauucacuuuuggaccugcuuggggacguauuuuuugucguaccagcacucaucaccgcuagauaccauagagacgcaggcgcccccguguacuuuuacgaauuucggcaccgaccucagugcuuugaggauacaaaaccugcauucgugaaggccgaucacgcugaugagguucgauuuguguuuggcggcgcauuucuaaaaggcgauauagugauguucgagggcgcuaccgaggaggaaaaguuacuuucacguaaaaugaugaaguauugggcuaccuuugcaaggacuggcaaccccaacgggaaugaccucucuuuauggcccgccuacaaccucaccgaacaguaucugcagcucgaccucaacaugucccugggccagcgucucaaagaaccccgcgucgauuuuuggacgagcacaaucccgcuaauccuguccgccucagacaugcuucacucgccacuauccucucuaaccuuccucucguugcuucaaccauucuucuucuucugcgcccccuag

SEQ ID NO: 14864 - RNA, 393 nt, Artificial Sequence
  Description of Artificial Sequence: Synthetic coding sequence
augcugcccuucuuguuuuucagcacacucuucucaagcaucuuuaccgaggcacaaaaacaguacugggugugcaauucuuccgacgccaguauuucauacacuuacugcggacgcgacuuaaaacagcuguacuucaauuuauauaucaccgugaacacuaugaaucugcccaagagaaaggaggucauauguagaggaucagacgacgauuacagcuucuguagggcacucaaaggcgaaacagugaacacuacuauuucuuucucuuuuaaaggaaucaaguucuccaaggggaaguauaaguguguggucgaggcaauaucuggaucccccgaggagaugcuguucugcuuagaguuugucauccuucaucagcccaauucuaacuag

SEQ ID NO: 14865 - RNA, 318 nt, Artificial Sequence
  Description of Artificial Sequence: Synthetic coding sequence
augaaguguacagcacgagaauggcugcgcguaacaacggugcuguuuauggcccgagcuauacccgccaugguaguucccaacgcgacucuuuuagaaaaacuacuggagaaguacauggacgaggauggagagugguggaucgccaagcagagaggcaaaagagcaauaaccgauaacgacaugcagaguauuuuagaucuccauaauaaacugcggagucaaguauacccuaccgccaguaacauggaauauaugacuugggacguggaacucgaaagaucagcugagucaugggccgagucgugucuuugguag

SEQ ID NO: 14866 - RNA, 567 nt, Artificial Sequence
  Description of Artificial Sequence: Synthetic coding sequence
augacaauggucugccaucgaccagagggauuagagcagcucgaagcgcagacgaauuuuaccaaaagagaacugcaggugcuuuaccgcggcuuuaagaacgagugcccuuccggaguuguaaaugaggauacauucaagcagauauaugcgcaguucuuuccucacggagaugcaucaacauaugcccacuaucuauuuaacgcauucgacaccacacagacaggaucagugaaauucgaggauuuugugacugcccugaguauuuuguuacgagguaccguacaugagaaacuacgguggacuuuuaaccucuacgacaucaacaaagauggauacaucaacaaagaggagaugauggauaucgugaaggcuauauaugauaugaugggaaaguauacauauccaguguugaaagaagacacaccccgccaacaugucgacguguucuuucagaagauggacaagaacaaggaugguauagugaccuuggacgaauuucuugaauccugccaggaggaugauaauauuaugcggaguuugcagcucuuucagaacguaauguag

SEQ ID NO: 14867 - RNA, 1275 nt, Artificial Sequence
  Description of Artificial Sequence: Synthetic coding sequence
augcccccauuucugauuacguuauuuuuguuucacaguugcugucucagggcaaauggacaucuccgagaaggcaugaccuugcugaagaccgaauucgcccugcaucuuuaucagucuguagcugccugcagaaaugagacuaacuuuguuaucuccccagccggugugucacucccucucgaaaucuugcaauuuggagccgaaggauccaccgggcaacagcucgccgacgcauuggguuacacaguccacgacaaacgagucaaagauuuccugcacgccguguacgccacucugccaaccuccagucaggguacagagauggaauuagcaugcagccuauuuguacagguaggcacuccucugucaccuugcuuuguggagcacguuucauggugggcgaacuccucccuggagccugcggaucucucugagccaaacucaacagcaauacagacaucagaaggugcaagccgggagacagcaggcggggggccgucugaaggacccggggguuggccuugggagcaggugagcgcugcauuugcacaauugguucuggugucuacaaugucuuuccaggggacuuggcguaaaagauuuuccuccacugauacucaaauccuucccuuuacuugugccuacggacuggugcuccagguuccuaugaugcaccagacaacagaggugaacuacggacaguuucaagauacagccggacaucaaguaggagugcuugagcuuccuuauuugggcucagccgugucauuauuccugguccucccucgcgacaaagacaccccccucucccacaucgaaccacaccucacagccagcaccauccaucucuggacuaccucacugcgaagagcacgcauggauguauuccuuccacgauuccggauucagaaccaauuuaaucucaaauccauucugaacagcuggggagugaccgacuuauucgauccauugaaagccaaucucaaaggaaucagcggucaagacggcuuuuaugucagcgaagcuauccauaaggcaaagaucgagguccuggaggaagguaccaaggccuccggugcaaccgcccuacugcuucugaagaggucacgcauuccaauauucaaggcugaccgcccuuucaucuacuuucugagggagcccaacacaggcaucacaguguuuuuugaucggauacagauuaucuaccagugccugucuucaaauaaagguucauucguccauuacccacuuaaaaauaaacauagcuucuag

SEQ ID NO: 14868 - RNA, 1815 nt, Artificial Sequence
  Description of Artificial Sequence: Synthetic coding sequence
auggccguacugguuuguccggcuagcugccacggccuaaaagaauuccgcauacgacgaggaauguggcgauugugccugguuuauuacuucuacccugcaagcagcacacucuacguccugaggauagauguccuaaacuauaccaguaaggacgaaggacccucugccgaaggcccccagagaaauacccgucuaggauggauccagggcaaacaggugaccguguuaggcagccccgucccaguuaacguguuuuugggagugccuuucgccgcucccccuuuaggaucccugagguucacgaacccacaaccugccucacccugggacaaccugcgagaggcuacuuccuauccaaaccugugccuccaaaacuccgaguggcuucugcuagaucaacacaugcucaagguacauuauccaaaauucggcguaucagaggacugucuuuaccugaacauuuacgcuccugcucacgccgacacaggcucuaagcucccgguguuaguuugguucccugggggggccuuuaagacagguagugcaagcauauucgacggauccgcucuggcagcuuacgaagauguacuggucgucguaguccaguacagauuggguaucuuuggcuucuuuacgacgugggaucagcacgcaccagggaauugggcuuucaaggaucaaguagcagcacuguccugggugcagaagaacaucgaauucuuugggggcgacccgagcucugucaccauuuucggcgaaucagcaggcgcaaucucuguuucuagccuaauucuaagucccauggcuaaaggacuuuuccacaaggcgaucauggaaucugggguagccauuaucccuuaccuggaggcacaugauuaugaaaaaagcgaggaucugcaaguuguagcucacuuuugcggcaauaaugcgagugauucugaggcucugcugcguugccuaaggacuaagccaucuaaggaauugcugacgcugagccagaagacaaagucauuuacccgugugguggacggagcuuuuuucccgaacgagccacuugaucuccugucacagaaagcuuucaaggcuauccccucaauuauuggcgugaacaaucaugaaugcggauucuugcuacccaugaaagaggcccccgagauacuuagcgggagcaacaaaucccucgcacugcauuugauucagaacauauuacacauaccaccacaguaccugcaccuggucgccaaugaguacuuccaugacaaacacucucuuacagaaauccgcgacagccuguuagaccugcuuggugacguuuucuuuguuguccccgcucugauuaccgcgcgauaccauagggacgcaggugccccaguguauuuuuacgaauuccggcauagaccccaaugcuuugaggauacuaagcccgccuucguuaaagcugaccacgcugaugagguuagauuuguguuuggcggcgccuuccuuaaaggcgacauugugauguucgagggagccacagaagaagagaaacuucugagcagaaagaugaugaaauauugggcaaccuucgcgcgaaccggaaaccccaauggcaaugaccucucccucuggccagcauauaaccuuacugaacaauaucugcagcuggacuuaaacaugucacucggucaaaggcucaaagagccaaggguggacuuuuggaccucaaccaucccucugauucuauccgcuucagauaugcuucacuccccauugaguucccugacguuucucucucuccuucagccuuuuuuuuuuuucugugccccguag

SEQ ID NO: 14869 - RNA, 939 nt, Artificial Sequence
  Description of Artificial Sequence: Synthetic coding sequence
augaauauuuggggacaaauuuggcccaaggcuguguaucuggugugcaacuacucuccaaaagggaacugguggggucaugcuccguacaaacacggacgucccuguucugccugcccaccaucuuucggcgggggaugucgggaaaaccuauguuacaaagagggcucggauagguacuauccaccuagagaggaagagacuaacgagauagagaggcagcaaucccagguucacgauacacacguuaggacacggucugaugacuccucccguaaugagguuauuagugcucagcagaugagucagauugugagcugcgagguaagauuaagagaccaguguaaaggaacuaccugcaaucgauacgaaugcccugccggaugccuggauucaaaagcaaaagugauuggcagcgugcauuacgaaaugcaauccagcauuugccgugccgcgauccauuaugggauuauugacaaugacgguggcugggucgacaucacacgucagggccguaagcacuauuucaucaagucuaacagaaacgguauucagacuauuggcaaauaucaguccgcuaacagcuucacugugucuaaaguuaccgugcaggccgugacaugugagacuacuguggaacagcuuugcccauuucauaagccugccagccacugccccagggucuacugcccaagaaauugcaugcaagcaaacccccacuaugcaagagugaucggcaccagaguuuacucagaccugagcucaauuugucgagccgccguccaugccggagucguucggaaccauggaggcuacguugauguaaugcccguugacaagcgcaagacuuacauugcuagcuuccaaaaugguauuuucucggagucuuuacagaacccuccuggggguaaagcuuuucguguguucgcugucguguag

SEQ ID NO: 14870 - RNA, 777 nt, Artificial Sequence
  Description of Artificial Sequence: Synthetic coding sequence
augauugcuauaucugccgugagcucagcccuccucuucucccuccuuugugaagccucaacaguaguucugcugaacucuaccgacagcagccccccaacaaauaacuuuacugauauugaagcagcgcucaaggcucaacuggacucagcugacauuccaaaggccagacgaaaaagauacaucucucagaacgauaugauugcuauuuuagauuaucauaaccaggugagaggcaagguuuuucccccugccgcgaacauggaauacauggugugggaugaaaauuuggcuaaaucagcagaagcuugggcagccacuuguaucugggaucacgguccuaguuaucuacugagauuucucggccagaacuuauccguaagaacaggucgcuauagaagcauccugcagcuagugaagcccugguacgacgaaguaaaggacuaugcuuuuccauauccccaggauuguaacccacgguguccgaugcgauguuuuggcccaaugugcacucacuacacucagauggugugggcuacuucuaaccgcauuggcugcgcgauucacaccugucaaaacaugaaugucuggggguccguuuggaggagggcuguguaccuagucuguaacuacgcuccaaaaggcaauuggaucggcgaagcuccuuacaaggugggagucccauguucaagcugcccuccaucuuaugggggauccugcacugacaaucuuugcuucccaggcgugacuucaaauuaccuauauugguucaaauag

SEQ ID NO: 14871 - RNA, 1215 nt, Artificial Sequence
  Description of Artificial Sequence: Synthetic coding sequence
augcccccauuccugauaacacuguuucuguuucacucuuguugucuuagggcaaauggucaucugcgcgaaggaaugacacugcucaaaacugaauuugccuuacaccuguaccagucugucgccgcaugucggaaugagaccaauuucguuauuagcccugccggggucucccugccucuugaaauucugcaauucggggccgaggggagcacaggccaacagcuagccgacgcccucggcuauacgguccaugacaagagggucaaagauuuucugcacgccguuuacgccacccugccuacaagcagucagggaacagagauggaacuggcguguucucuguuuguccagguggguaccccacugucacccuguuucguggagcauguaucuuggugggcuaauucuagccuagagcccgcugaccucucagagccgaacaguacagccauccaaacgucugaaggcgccagccgugaaacagcaggaggugggccaagcgaggggccuggcgguuggccuugggaacaagugagcgccgcauucgcgcaacugguucuugugagcacuaugucuuuucaaggaaccuggagaaagagauuuagcucaaccgacacucaaauucucccauuuacuugcgccuaugggcuuguacuccaggucccaaugaugcaccagaccacugaggugaauuacggucaauuucaggacaccgcagggcaccaagucggagugcuggaauuaccauauuuggggagcgcuguuagucucuuuuugguucucccccgcgacaaagauacuccucuuucccacaucgaaccacaccugaccgcuucuaccauacaccuguggacuaccucacuuagacgggcccggauggacguguuccucccuagauuuagaauccagaaucaguucaaucugaaauccauucucaacucuuggggcguaacagauuuguuugauccccucaaagcgaaccugaaagguaucucaggacaggacggguuuuacgucucugaagcuauacacaaagccaagaucgaaguucucgaggaagguacuaaagccucaggcgcaaccgcccuuuuacuccucaaaagaagucgcauccccaucuuuaaggccgacagaccauucauuuauuucuugagagagccuaauaccggauuugucuuuaguaucggccgugugucuaauccgcuugauuag

SEQ ID NO: 14872 - RNA, 936 nt, Artificial Sequence
  Description of Artificial Sequence: Synthetic coding sequence
augcucuaucagaccaucaauaguuugaaaaccaagaauccgaaacucaaaauacuucucucuaucggcggcuaccucuucggcaguaaaggcuuccacccuaugguagauucaagcacaucuaggcuggaguucaucaauucuauaauucuguuccuucgaaaucacaacuuugacgguuuagauguauccuggauuuauccggaccagaaggagaauacgcacuucaccguuuugauacacgagcucgccgaagcuuuucagaaagauuuuaccaagucuaccaaagaacgacuacuccugacagccggaguuucugcaggacggcagaugauagauaauuccuaccagguagagaaauuggcaaaagaucucgacuucauaaaucuccucucuuuugauuuucauggaucaugggaaaagccucucauuacaggacacaauagcccacuuagcaaaggcuggcaagacaggggcccguccagcuauuauaauguggaguacgcuguuggauacuggauccacaaaggcaugccuucagagaaaguugugaugggcauuccaaccuacggccacagcuuuacuuuagcuagcgccgaaaccacugucggugccccugcuuccggaccaggagcugccggcccuaucacagagucuucugguuuucucgcuuauuacgagaucugucaguuccuuaagggcgcaaaaauuacuaggcugcaggaucagcagguuccuuacgccgucaaagguaaucaguggguggguuaugaugacgucaagucaauggaaaccaaagugcaauuccucaaaaacuugaaccugggaggggcgaugaucuggucaaucgauauggacgacuuuacagggaaaagcuguaaucagggaccuuauccuuuggugcaggcuguuaagcgaucucucggaaguuuauag

SEQ ID NO: 14873 - RNA, 555 nt, Artificial Sequence
  Description of Artificial Sequence: Synthetic coding sequence
auggccucugagagacugccgaaccggcccgcaugcuuacucguggcgaguggggccgccgaaggagugagugcucaaucuuuucuacauugcuuuaccauggcuucaacagcauucaauuugcaggucgcgacucccggcgggaaggcuauggaguucguugaugugacagaauccaacgcccgaugggugcaggacuuccgccucaaggccuacgcuucgccugcaaagcuagaaaguauugacgaaccuauuugugcagugggacacggcgucgccgcccucuguugcgcuaccaacgaggaccggucuuggguguucgacuccuauagucugaccggcccaucugugugugagcuaguccgagccccaggcuucgcccgucuuccauugguuguggaggacuuuguuaaagauaguggcgccugcuuuuccgccucagaacccgaugcuguccauguuguccuggaucgccaccuugugaccggccagaacgccucauccacaguaccagcagugcagaaccuccuuuuucuuuguggcucccggaaauag

SEQ ID NO: 14874 - RNA, 1257 nt, Artificial Sequence
  Description of Artificial Sequence: Synthetic coding sequence
augcgaucacuccuucuucugucagccuuuugccuccuggaggcggcucucgccgcugaagucaagaagcccgcagccgccgcagcucccggcaccgcugaaaaacucucucccaaggccgccacccucgccgaaagauccgcugggcuugcauuuucccuuuaccaggcuauggccaaggaucaggcaguggaaaauauccuggucucaccaguugugguugccaguucccuaggcuuggugucccuaggcggcaaagccacaacugccagccaagccaaagcaguguuauccgcugagcagcuuagagacgaagaggugcaugcaggguugggggagcuccugcggagccugagcaacucgacugccagaaacgucaccuggaaauuggguagcagauuauacggaccuucuagcgugaguuuugccgacgacuuuguucggaguucuaagcaacacuacaauugcgagcacagcaagaucaacuuuagagauaaacguagcgcauugcaaagcaucaacgaaugggccgcccagacaaccgaugguaaguugcccgaagucacuaaggauguggagagaacagauggggccuuacuggugaaugcuauguuuuucaaaccacacugggaugagaaguuucaccacaagaugguggacaauagaggguuuauggucacuagaaguuauacaguugggguaaugaugaugcaccggacuggacuuuacaauuauuaugaugacgaaaaggagaagcuucaaauagucgaaaugccacuugcgcacaaacugagcagcuuaaucauucugaugccgcaccacgucgaaccuuuggaacggcucgaaaaguuauugaccaaggaacagcucaaaaucuggaugggcaaaaugcagaaaaaagccguggcuaucagucugcccaaagguguuguggaagugacacacgaccugcaaaagcaccuggcgggauuaggucuuacagaagcgauugacaagaacaaagccgaccugucacggaugucuggcaagaaagaucuauaccuugccucaguguuccacgccaccgcauucgagcuagacacagauggcaacccauucgaucaggacauuuacggacgagaggagcuaagaucccccaaauuauucuaugccgaucacccuuuuauuuuucuggugagagauacacaaucaggaagccugcuguuuauaggcagauuagugcgaccuaaaggagauaaaaugagagacgaacuguag

SEQ ID NO: 14875 - RNA, 1425 nt, Artificial Sequence
  Description of Artificial Sequence: Synthetic coding sequence
auggaccguaacccauccccaccacccccugggcgagacaaggaagaggaagaggaaguugccggaggggacugcaucggcucuaccguguacaguaaacacugguuguuuggagugcuuuccggacuaauucagaucgucagcccagagaauaccaaaaguucaagcgaugaugaagaacagcuuaccgaacucgacgaggaaauggaaaacgagaucuguagaguuugggacaugaguauggacgaggauguugcccuuuuuuugcaggaauucaacgcaccugacaucuuuauggggguguuagccaaaucuaagugcccccgccugagggaaaucuguguggguauacuggguaacauggccuguuuucaggaaauuuguguauccauuucuucagauaagaaccugggccagguuuugcuucacuguuuauacgauucugacccucccacucuacuugaaacuaguagguuacugcugacaugucuuagucaagcggagguggcaucuguguggguggagcgcauccaggagcauccggccauuuaugacucaaucuguuuuauuaugaguaguaguaccaacguagaccuccucgugaaagucggggaaguuguggauaaguuauuugaucuggacgaaaaacucaugcucgaguggguucgcaauggugccgcacagccgcuggaccaaccacaggaggaauccgaagaacagccuguuuuccgccuggucccuugcauucucgaagccgcaaagcaagugcgaagugagaacccugagugguuagauguguacaugcauauucuccaacugcugacaaccgucgaugaugggauacaggccauaguccauugucccgacacagggaaagacauuuggaaucuacuauucgaucugguuugucaugaauucugucaauccgaugauccaccuauaauacugcaagaacaaaaaacagugcuugccuccguguucucuguccuaucugccauauaugcgagccagaccgagcaagaguauuugaagauugaaaaaguugaccucccccucauagacagccucauaagaguacugcagaauauggagcagugccaaaaaaagcccgaaaacuccgccgagucgaacaccgaagagaccaagaggacugaccuuacccaggacgauuuccaccugaagauucugaaggacauauugugugaauucuuaucaaauauuuuccaagcuuugacgaaagagaccguggcucagggugucaaagaaggccagcuaucaaaacagaaguguaguucagcuuuucaaaaucuguugccuuucuauaguccgguuguugaggauuucaucaaaauucuucgcgaagucgacaaagcacuugccgacgaucucgagaaaaacuucccuucccugaagguccagacauag

SEQ ID NO: 14876 - RNA, 438 nt, Artificial Sequence
  Description of Artificial Sequence: Synthetic coding sequence
auguuaacacgcuuaguuuuaucugcacaucuguccaguacuacaagcccuccauggacacaugcggcuauuucuugggaacucgacaauguccugaugccaucucccagaaucuggccacaagucacucccacaggaaggucagcaucuguucgaagugaagggaacacgucuucgcuguggaauuucuccgcuggacaggacguucaugcaauugugacacgaacgugugaaucgguucuaagcucugcuguuuauacucacggauguggcugcgugaggagugcgaccaauaucaccugucaaucuucaggccaacagagacaggcugcgcgacaggaggaggaaaacagcauuuguaaggcccacgacagcagggagggaaggcugggauacccauuauccgcccaucaaccaggguccggcgguccuaauuag

SEQ ID NO: 14877 - RNA, 1728 nt, Artificial Sequence
  Description of Artificial Sequence: Synthetic coding sequence
uaaauuuuugguggcuccauccauuacuucagaguccccagagaguacuggcgagaccgacuacugaaaaugaaagcaugcggcuuaaacacccuuaccacuuacguaccauggaaccugcacgaacccgaaaggggcaaauucgauuucagcggaaacuuagacuuagaagcuuucguccuaauggccgcagagauugggcugugggugauccugagaccugggccauacaucuguagcgaaauggacuuaggaggacuccccucuuggcuacuccaagacccgggcaugcgguugaggacaacauacaaaggauuuaccgaagccguggaucuguauuuugaccaucugaugucccgggucguacccuuacaguacaaacgcggcgggcccaucauugccguucagguagaaaacgaauauggcagcuauaacaaagacccagccuacaugcccuacgugaaaaaggcacucgaggaucgaggaaucguggagcugcuccuaacuucugauaauaaagacggccucucuaaaggcauuguucagggcguccucgcuaccaucaaccuucagucuacucaugagcugcaacuuuuaacuacauuccuuuuuaaugugcagggaacccagccuaagauggucauggaguauuggaccgguugguuugauuccuggggcggaccccauaauauccucgauucaagcgaaguacuuaaaacagucucagccaucguggaugcuggcucaucaauuaaccuguauauguuccacggcgguaccaauuuuggcuuuaugaacggugcaaugcauuuccacgauuacaaaucagacguaaccuccuaugauuacgaugcgguuuuaaccgaagcuggcgauuacacggcaaaguauaugaaauuaagagauuuuuuuggcuccaucuccgguauuccgcucccuccgccucccgaccuucuacccaaaaugcccuaugaaccgcucacaccuguguuguaucuuucuuugugggaugcucucaaauaccuaggcgagcccauuaagucugaaaagcccauaaauauggagaauuugcccgucaauggagggaacggacagaguuucgguuacauccuuuacgagacgaguauuaccaguagcgggauacugucagggcacguccacgauagaggccaggucuuuguaaacacagugucuaucggcuuucucgacuauaaaacuacaaagaucgcuguuccacugauccaggguuauaccguucugcggauacugguugaaaaccggggucgcgucaauuauggcgaaaauauugacgaucagcggaaaggacuaaucggcaaccucuaucugaaugacuccccauugaagaacuuucgaauuuacucacuugauaugaaaaagaguuucuuccagagauucggucuugacaaaugguccucuuugccugaaacgccuacuuugccugcauucuuccuuggaucucuaagcauuuccuccacuccuugcgacacauucuuaaaguuggagggaugggaaaaaggcgucguguucaucaacggccaaaaccuuggaagguauuggaacauuggaccccagaagacacuguaccuucccggaccuugguugucaucaggaauuaaccagguuauuguguuugaggaaaccauggccgggccagcuuugcaauucaccgagacgccucacuuaggaaggaaccaguauaucaaguag

SEQ ID NO: 14878 - RNA, 255 nt, Artificial Sequence; identical to SEQ ID NO: 13239
  Description of Artificial Sequence: Synthetic coding sequence

SEQ ID NO: 14879 - RNA, 744 nt, Artificial Sequence
  Description of Artificial Sequence: Synthetic coding sequence
augcguucucugcuuuuguuaucagccuucugcuuacucgaagcagcucuggcggcugaagugaagaaacccgccgccgccgcagcgccaggaacggccgaaaagcugucgccaaaagcagcuacccuggcagaaaggagugccggacuggcauucucccuuuaccaagccauggcuaaagaucaggcaguagagaauauuuugguaagcccaguuguagucgccucaucccuuggacuaguuucccugggcggaaaagcuacgacagcaucucaggcaaaagccgugcucagugcagagcagcucagggaugaggaagugcaugccgggcugggggagcugcuaaggagcuugucaaacucuacugccagaaaugucaccuggaaauugggaucccgccuuuacggcccaucuuccguaucauucgccgaugauuucguccgauccuccaaacagcauuauaacugugaacauaguaaaauaaacuuuagagauaaacgcucugcccugcagucuaucaacgagugggcugcacagaccaccgacggaaaauugccugaagugacuaaggacgucgagagaaccgauggcgcucugcucgugaacgccauguuuuuuaagccgcacugggacgaaaaguuccaucacaaaaugguggauaacaggggauuuaugguaacaagaagcuauacugugggggugaugaugaugcauaggacuggauuguacaauuauuaugauuag

SEQ ID NO: 14880 - RNA, 117 nt, Artificial Sequence; identical to SEQ ID NO: 13241
  Description of Artificial Sequence: Synthetic coding sequence

SEQ ID NO: 14881 - RNA, 750 nt, Artificial Sequence
  Description of Artificial Sequence: Synthetic coding sequence
augcgaagccugcuguuacuuagugcuuucuguuugcuggaagcugcccucgcggccgaagugaaaaagccugcugccgcagccgcgcccggaacugccgagaaacucucacccaaggccgccacuuuagcugaacgcagcgccggauuggcauucucacucuaucaggccauggccaaggaucaagcuguugagaacauucuggugucuccugucguuguugccagcucccuugggcucguuucucucggagguaaggcgacaacugcaucucaagcaaaagcagugcucucagcggagcaacuucgggaugaagaggugcaugccggucucggggaguuacugagaucccugucgaauaguaccgcacgaaacgugaccuggaaauuaggaaguaggcuuuacgggcccaguucaguaucauuugccgaugacuucguccggucgaguaaacagcauuacaauugcgagcacaguaagauaaauuuucgagauaagcggagugcucugcagagcauuaacgagugggccgcucaaaccaccgauggcaaacugccagaagugacuaaagacguagaaagaacugauggagcucuucuggugaacgccauguucuuuaagccacauugggacgaaaaauuccaccacaagaugguagauaaccggggauuuauggugaccaggaguuacacuguaggagugaugaugaugcauaggacgggauuguauaacuacuacgacgaugaauag

SEQ ID NO: 14882 - RNA, 201 nt, Artificial Sequence; identical to SEQ ID NO: 13243
  Description of Artificial Sequence: Synthetic coding sequence

SEQ ID NO: 14883 - RNA, 1002 nt, Artificial Sequence
  Description of Artificial Sequence: Synthetic coding sequence
auggucuccaagucccgcuggaagcuccucgcaaugcuggcguuagugcucguaguaauggugugguacaguaucagccgcgaagaccgguacauugaacuuuuuuacuuuccaauaccagagaaaaaggaacccugccuucaaggggaagcugaaagcaaggcgucuaaacuuuucggcaacuacagccgcgaccagcccauuuuuuuaaggcuugaagauuacuuuugggugaaaacuccaucagcauaugaacugccauaugggaccaaggggucugaggaccuguuacuuaggguccuugcaauaacaagcuccuccaucccuaaaaacauucaguccuuacgcugccggagauguguugucgugggcaaugggcaccguuuaagaaauucaucucucggggaugcgauuaacaaguacgauguggugauaagacucaauaacgcuccaguagcuggguacgagggagaugugggaucuaagacaacgaugcggcuguucuacccugagagugcgcacuuugaccccaaaguggaaaauaacccggauacacuguugguccugguagcuuucaaagcaauggacuuccacuggaucgagaccauuuugagugacaagaagcgcgugcgcaaagguuucuggaaacaacccccucuuauaugggauguuaauccaaagcagaucagaauuuugaaccccuucuuuauggagaucgcugcugacaaacuacugucucuaccgaugcaacagccccgcaaaauuaaacagaagccaacaacaggcuugcuugcuauaacucuggcucuccaucucugcgaccuaguucacauugccggauucggauauccugaugcauauaauaagaaacagaccauccacuauuacgaacagauuacgcugaagaguauggcggguucaggacauaauguuucucaggaagcuuuggcuaucaaacgcaugcuggagaugggcgcgaucaagaaucuuaccucauuuuag

SEQ ID NO: 14884 - RNA, 645 nt, Artificial Sequence
  Description of Artificial Sequence: Synthetic coding sequence
augagaccuaagaccggacagguagggugugaaaccccugaggaauugggcccugguccacgccagcguuggccucugcucuugcucggccuggcaaugguggcacacggauugcugcgcccuaugguugccccucagucuggagaucccgauccuggcgcaucuguuggaaguagccguaguagccugagaagccuguggggacgccugcugcuccagccaucuccccagagggcugacccacgauguuggccuagaggauucuggagcgaaccccagagucuguguuacgucuuuggcacaggcacgaaagucacaguucuaggacagcccaaagccaacccaacaguuacccuauucccccccagcucagaagaacugcaggccaauaaagcaacccucgugugucucauuuccgacuucuacccuggagcugugaccgucgcauggaaagcggaugguagcccugugaaggccggcgucgaaaccaccaaacccuccaaacaguccaauaacaaauacgcggcauccuccuaucuuagucuuacacccgagcaguggaaaucgcaccgcuccuauucaugucaagugacgcaugagggcucaacaguggaaaaaaccguagcuccuacagaaugcucauag

SEQ ID NO: 14885 - RNA, 1050 nt, Artificial Sequence
  Description of Artificial Sequence: Synthetic coding sequence
ugacuguacaaaaaucgcuugggauccggaggcaggggaagauguaucaagcaaggggagaauugguacucgcccacagaauucgaggcaauggcaggacgcgcauccucuaaagauuggaaacgcucuauccgcuacgcaggaagaccacuacagugccugauccaggacggaauacuuaacccacacgcugcuaguugcaccugugcagccugcugugacgauaugacauuauccggcccugugaggcuguucgucccuuacaagcgaaggaagaaggagaacgaacuccccaccacaccagucaagaaagacucaccaaaaaacaucacccuccucccugcuacugccgcgacgacuuucaccguaaccccaaguggccaaaucaccacaagcggagcucugacguucgaccgcgcaucuaccgucgaggcaacagccguaaucagugagaguccagcccagggcgacgucuucgccggagcaacuguccaggaagcaucagugcagccuccgugcagagcgucacacccagaaccccacuaccccggauaucaggacagcugccagauagcaccuuucccagaagcugcccuccccacaagucaccccaaaauaguccugaccucacucccagcccuugccguuccacccccaacacccaccaaagcugcaccuccugcacugguuaacggccuagaacucucugagccccgcuccuggcuguaucuggaagaaauggugaacucucugcugaacacagcccagcaacucaaaacccuguuugagcaagcuaagcacgcgagcacuuaccgagaagccgccacaaaucaggcuaagauacaugcugacgccgaacggaaagagcagagcugcgugaauuguggaagagaagcaaugucugaaugcacagguugucauaaggucaacuauuguucaaccuuuugucaaagaaaaagauggucacugacuaugcugacuucucucgugucuauuucauggcuccgcgcuauccugccuugccaaccgccaaaaguguuaggucucuag

SEQ ID NO: 14886 - RNA, 600 nt, Artificial Sequence
  Description of Artificial Sequence: Synthetic coding sequence
augucacucgacauccagagucucgauauucagugcgaagagcucucugaugcaagaugggccgagcucuuaccucuccuccagcagugccagguagugcgacuggacgacuguggacuuaccgaggcaagguguaaagauaucucuagcgcucugcguguuaauccagcuuuagcugaacucaaccuaagaucgaacgaacucggggauguaggcguucacugcgugcuacagggucuucaaaccccuuccugcaaaauucagaaacugagccuccagaacuguugucugacaggcgccgggugcggcgugcuguccucgacgcugagaacacugccuacacugcaagagcuucaucucucugauaaucugcugggcgacgcaggccugcaguugcuuugcgagggacuacuugacccccagugccgauuggaaaaauuacagcucgaguauugcagucuuucugccgcaucaugugaacccuuggccuccguccugagggcaaaacccgauuuuaaagaacucacuguaagcaauaaugauauuaacgaagcuggagugcguguccugugucagggacuuaaggauagccccuguuag

SEQ ID NO: 14887 - RNA, 465 nt, Artificial Sequence
  Description of Artificial Sequence: Synthetic coding sequence
auggcugggaucccaggccuccuuuuccugcuauucuuccuacucugcgcagucgggcaggugagucccuacucggcacccuggaagccgaccuggccggccuauagacuuccaguaguucucccgcaauccaccuugaaucuugcuaagccugauuucggcgccgaagcaaaauuagaaguaaguagcucuuguggcccacaaugucacaaaggcacaccucuccccacauaugaggaagcgaagcaauaccucaguuaugaaacccuauacgccaacggaucgcgcacagagacacaagugggcaucuauauucugagcucuaguggcgacggagcccagcacagagacaguggcagcucuggcaagagucggcgaaaaaggcagauuuaugguuaugauucuagauucucuaucuuuggaaaggacuuucuacuuaauuauccauucucaacaagcguguag

SEQ ID NO: 14888 - RNA, 936 nt, Artificial Sequence
  Description of Artificial Sequence: Synthetic coding sequence
auggguauaauccagucuauccuagcuacaagccgcgacuguuauucauuuaagaaaaaacccauuccaaaaaagccuacuaugcuugcccuugcaaaaauucuucuaauaucuaccuuauucuauagccuguuguccgggucacaugggaaagagaaccaggauaucaacacgacccaaaauauagccgagguguucaaaacaauggaaaauaaacccaucagucuagaaagugaagccaaccugaacuccgauaaagagaauauuacaacaucuaacuuaaaggcaagccacagcccaccccucaaucugccuaauaacucucauggcaucacugauuucucauccaauaguagcgcagagcacucauuagguagccugaaaccuacuagcacaaucuccaccuccccuccccuaauacacagcuuugugaguaaaguccccuggaacgcaccaauagccgaugaggaccuucuuccaauuuccgcacauccaaaugccacacccgcacugucuucagagaauuucaccuggagccugguuaacgacacagugaagacgcccgacaauuccuccaucaccguaagcauacugucuucugagccuacaucaccuuccguaacacccuugauagucgagcccagcggcuggcucacaaccaauuccgacucauuuaccgguuucaccccuuaccaagagaaaacaacccuucagccaacccucaaauucacaaauaauagcaaacuuuuuccuaacacuucugacccccagaaaguccugaggcuggacaaugccccugagcccuacgacguguccuuuggaaauaguuccuacuauaacccuacacuuaaugacuccgcuaugccugagagcgaagagaacgcaagagaugggaucccaauggacgacauacccccucucagaacaagcguguag

SEQ ID NO: 14889 - RNA, 1404 nt, Artificial Sequence
  Description of Artificial Sequence: Synthetic coding sequence
auguugauuuuuuggaccauuacucuuuuuuuguuaggugccgcuaagggcaaagaggucuguuacgaggaucuuggcuguuuuagcgacacagagccauggggugguacagccauuagaccccugaaaauccuccccuggaguccugaaaaaaucggcacaagauuucuccuuuacaccaaugagaacccgaauaauuuccaaauacugcugcugucagaucccucuaccaucgaagcauccaauuuccagauggaucguaaaacccguuucauaauacauggcuucaucgauaaaggcgacgagucauggguuacagauauguguaaaaagcuguuugaggucgaggagguuaacugcauuugcguggacuggaagaagggcucgcaggcuacauacacacaggccgccaacaacgugagaguugucggagcucaaguugcccagaugcuugacauucuguuaaccgaguauucuuacccaccaaguaaaguucaucuaauagggcacagccucggagcccauguggccggagaagcaggaucaaagacucccggacugucuagaaucaccggccuugacccagucgaagcaagcuucgagucaaccccugaagaaguccgucucgauccauccgaugccgauuuuguagacgugauccauaccgaugcugcucccuugauaccguucuuggguuuuggaacaaaccaacagauggggcaccuggacuucuucccaaauggcggugaaagcaugccuggcuguaaaaaaaacgccuugagccagauaguggaccucgacggaaucugggccgggacccgcgacuucguggccuguaaucauuugcguuccuauaaauacuaccucgagucuauccuaaauccugacgguuucgcggcuuacccaugcaccucuuacaagaguuuugaaucugacaaaugcuuucccugccccgaucagggcugcccccaaaugggucauuacgcugacaaguuugccggacggacaagugaggagcagcagaaauuuuuccuaaacacgggagaagcguccaauuucgcccgcuggagauauggagucucgauuacacuuagcggccgcacagcaaccggacaaauuaagguggcuuuguuuggcaauaaaggcaauacacaucaguauagcauuuuucgagguauccucaagccuggaucuacgcacucguaugaguucgaugccaagcuggacguugggaccaucgaaaagguaaaguucuuauggaauaacaacgugaucaauccuacacuuccaaaggugggcgccacaaaaauaacuguacagaaaggagaagagaagacgguauacaacuuuuguagcgaggacacaguacgcgaagacacccugcugacccugaccccaugcuag

SEQ ID NO: 14890 - RNA, 81 nt, Artificial Sequence; identical to SEQ ID NO: 13251
  Description of Artificial Sequence: Synthetic coding sequence

SEQ ID NO: 14891 - RNA, 549 nt, Artificial Sequence
  Description of Artificial Sequence: Synthetic coding sequence
augaggcgaaugugggcaacacaggguuuggcaguggcauuggcucugagcguguuaccaggaucccgcgcccucaggcccggugauugcgagguguguauuagcuaucuugggcgcuucuaucaagaccucaaagacagagauguuaccuucucuccugccacaaucgaaaacgaacuuaucaaguuuugccgagaggcccgcggaaaagaaaaccguuugugcuauuauaucggcgccaccgacgacgcagcuacuaagauuaucaacgaaguuucuaagccauuagcucaccauauaccaguggagaaaauuugcgaaaagcucaaaaaaaaagauagccagauaugcgaguugaaguacgacaagcaaauugaccugagcaccguggaucugaagaaacugagaguaaaggaguuaaaaaaaauucuggaugauuggggugagacauguaaaggaugcgccgaaaaauccgauuacaucaggaagauuaacgagcuaaugccuaaauaugcaccuaaagccgccagcgcacgaacugaccuauag

SEQ ID NO: 14892 - RNA, 153 nt, Artificial Sequence; identical to SEQ ID NO: 13253
  Description of Artificial Sequence: Synthetic coding sequence

SEQ ID NO: 14893 - RNA, 666 nt, Artificial Sequence
  Description of Artificial Sequence: Synthetic coding sequence
augggggccaccacgauggaucagaagagccugugggcagguguggucguucuucuccuucuccaggggggcucggccuacaagcucgugugcuacuucaccaauuggagccaagaccgucaggaaccaggcaaauuuacacccgagaacaucgaccccuuucuuuguucccauuugaucuauaguuucgcgucaauugaaaauaacaaagugauaaucaaagauaaauccgaaguuauguuguaucagacaauuaacagcuuaaaaaccaaaaauccaaaguugaagaucuuacuuucuauuggaggguaccucuucgguucuaaaggcuuucauccgauggucgauucuucaacgucccguuuggaguuuaucaauagcauuauccuuuuuuuaagaaaucacaacuucgacggccuggaugugucauggaucuauccggaccaaaaggaaaauacucacuucaccguucugauucacgagcuugccgaagccuuccagaaagacuucaccaaguccacgaaagaaaggcugcuccucacagccggagugucggccggacgccaaaugauugauaauaguuaccaaguugagaaacuggcaaaagauuuggacuucauuaaucuacucucguuugacuuucauggauccugggaaaagcccuag

SEQ ID NO: 14894 - RNA, 1257 nt, Artificial Sequence
  Description of Artificial Sequence: Synthetic coding sequence
augagaacacuguucaauuuacuaugguuagccuuagcaugcagccccguucacaccacauugaguaaaucagaugcgaaaaaagccgccucuaaaacucuacucgagaagguaaaauuuugcucgugcugccccggguggucagcaauggcacgcucuuggcuuacagcaaccucugccacccagagccaauucuccgauaaaccagugcaggacaggggacugguuguuaccgaccuuaaggcggaaagcguggugcucgaacauaggucuuauuguucugcaaaagcacgggaccggcacuucgcuggugauguucugggauaugucacuccuuggaacucccauggcuaugaugugacuaaaguguucggaucuaaguuuacgcagauuagcccgguguggcugcaacucaagaggcgcggcagggaaauguucgagguaacaggucuccacgauguggaucagggauggaugagagcagugagaaaacacgccaagggacugcacauuguccccagacugcucuuugaagacuggacguacgacgacuuuagaaacguauuagacucagaggacgaaaucgaagaauugucuaagaccguugugcagguugcgaagaaucagcacuuugauggauucgugguggaaguguggaaccaacuccuuucucaaaagcgcguuggacuaauacacauguuaacacaucuggcugaagcucugcaccaggcuagauugcuggcucuguuggugauuccuccugcaaucacaccggguacagaucaauugggaauguuuacccauaaggaguucgaacagcucgccccuguauuggaugguuuuuccuuaaugacuuacgauuauagcacagcucaccagcccggccccaacgcaccccucaguuggguucgagcuugcgugcaaguacuggacccuaaaagcaaguggagaaguaaaauacuucucggacucaacuucuacgguauggauuaugcgacaucuaaggaugcuagagagccaguggugggagcucgauacauucagacacuaaaagaccauaggccgcgaauggucugggacagucaggcaagugagcauuuuuucgaauauaagaagucccgcuccgguagacaugucguuuucuacccaacguuaaaaagucuucaaguucgacucgaacuggcuagggaacugggggugggggugucuauuugggaauugggucagggucuggacuacuuuuaugaucugcuguag

SEQ ID NO: 14895 - RNA, 612 nt, Artificial Sequence
  Description of Artificial Sequence: Synthetic coding sequence
augcggucccugcuuuuacuaucugccuuuuguuuauuagaagcagccuuggcugcagaagugaaaaagcccgcagccgcugccgcaccuggcacggccgaaaaguuaagcccgaaggcugcaacccuggcggaacgcucagccgguuuggcauucucccucuaucaggcuauggcaaaggaccaggcuguugaaaauauucuggucucccccguaguggucgccuccagucucggauuggugucucugggcgggaaggcaacaacagcaucccaggccaaagccguccucucugcagagcagcuucgugaugaggaagugcacgcuggacugggagaacugcugcgaagucuauccaauuccaccgcaagaaacguaaccuggaaacugggaagccgccuguacggaccuagcucuguaucauuugccgacgacuuuguacgaaguagcaagcagcauuauaacugugaacauucuaagaucaauuuucgagauaaaagguccgccuuacaguccauuaacgagugggcagcacagaccacugacggaaaacugccugagguuacuaaggaugucgagcguaccgauggggcacugcuggugaacgccuag

SEQ ID NO: 14896 - RNA, 492 nt, Artificial Sequence
  Description of Artificial Sequence: Synthetic coding sequence
augaggucguugcuucugcucucugcuuucugccuccuggaagcugcuuuagccgcugaggugaagaaaccggcagcagcagcagcacccggcacagccgaaaaacuguccccaaaggccgcuacgcucgcugaaaggagcgcugggcucgccuucucucuuuaccaagccauggccaaggaccaagccguugaaaauauccugguauccccugucguugucgccucaagccucggacucguaucucugggcggaaaggcaacaacugccucucaggccaaagccguccugucugcggagcagcugagagacgaagaggugcaugccggauuaggggaacuuuuaaggucucugaguaauuccaccgcccgcaacgucaccuggaaacuugguagccggcuguauggaccuagcagcguuucauuugcagaugauuucgugcgaucaagcaagcagcauuauaauugugagcacuccaagauuaacuucuag

SEQ ID NO: 14897 - RNA, 570 nt, Artificial Sequence
  Description of Artificial Sequence: Synthetic coding sequence
augagccuggauauucaaucgcuggauauucaaugugaggaauuaagugacgcaagaugggccgaguuacuaccauuacuucagcaaugucagguuguccgucuggacgauuguggccugaccgaagcucgaugcaaggacauuuccucggcacuucgcgugaacccugcccuagccgagcugaaccugagaucaaaugagcugggggaugugggugugcacugugugcuccagggcuuacagaccccuuccugcaagauucaaaaacugucucugcagaauuguugccugaccggcgcaggaugcgggguauuguccaguacucucagaacacuaccgacacuacaggagcugcacuuaucagacaaccuuuugggugacgcgggccuacaguugcuaugcgaggggcuacuugauccacaaugucgauuagagaaacugcagcuggaauacugcucccugagugcugccucuugcgagccacuagccucaguuuugagggcuaagcccgauuucaaagaacuaaccgugucaaacaaugacaucaacgaagcagggguuaggguuuag

SEQ ID NO: 14898 - RNA, 585 nt, Artificial Sequence
  Description of Artificial Sequence: Synthetic coding sequence
auguccuuagacauccagucccuagacauccagugcgaagaacugagugaugccaggugggcugaauuguuaccucugcugcagcagugucagguuguacgauuagacgacugcggcuugaccgaagcccgauguaaggacauuuccucugcacuuagggucaaccccgccuuagcugaguugaaccuccggagcaacgaacugggugacguuggugugcauugcguucugcagggccuucagacaccauccugcaagauccagaagcuuucucugcaaaauugcugccugacgggagccggauguggcguguugucaaguacacuacgcacccugccaacacuccaggaacugcaccugucugauaaccugcucggagaugcugggcuucaauuauugugugagggccuguuagacccccagugucggcuggagaaacuucaauuggaguauuguucauugagugccgccucuugcgaaccccuggccuccgugcuucgagccaaaccggauuucaaggaacugaccguuucaaauaaugacauaaacgaagccggcguaagggugcucugucaaggguuguag

SEQ ID NO: 14899 - RNA, 1086 nt, Artificial Sequence
  Description of Artificial Sequence: Synthetic coding sequence
auggguauaauccagucuauccuagcaacgagccgcgacuguuacagcuucaagaagaaacccauuccaaagaagcccaccaugcuagcacuagccaaaaucuuacugaucucuacucucuucuacagccuucuuucaggcagucacggaaaagaaaaccaggauaucaauaccacacaaaacaucgcagaaguauucaaaacaauggagaacaaaccuauuucucuggaaagcgaggcaaauuuaaacucagauaaggaaaauaucaccaccaguaaucuuaaggcuucccacucaccccccuuaaaccuacccaacaacagccauggcauaacagauuucagcucgaauaguucugccgagcauagccucgggucccucaaaccuaccuccacuaucuccacauccccaccacuaauucauuccuucguaucgaaaguccccuggaacgcacccauugccgaugaggaccuacugcccaucucugcccaccccaaugccaccccagcucugucauccgaaaauuucacauggagccuugugaacgacacaguuaagaccccugauaacuccucuauuacuguaaguauucuguccucugagccaaccagcccuucagucacaccucuuaucguggaacccuccggcuggcucacaacaaauagcgacuccuuuacagguuucacgccuuaucaagaaaaaaccacccuacagccuacacuuaaauucacgaacaauuccaagcuguuucccaauacuagcgacccccagaaagagaacagaaauaccgguaucgucuucggggccauucucggugccauccucggagugagccugcucaccuuagugggguaucuguuauguggcaagcggaaaacugauuccuuuucucaccgcagacucuaugacgacaggaaugaacccgugcuuagauuggacaacgcuccugaaccuuaugacguauccuucggcaacucaaguuacuauaaucccacgcuaaacgauucugcaaugccugagucagaagagaaugcacgagacggaauucccauggacgacaucccuccucugcgcacaaguguuuag

SEQ ID NO: 14900 - RNA, 327 nt, Artificial Sequence
  Description of Artificial Sequence: Synthetic coding sequence
uaaccaaagucgaaauggaggucuaagauauuauugggccugaacuuuuauggaauggacuaugcuacaaguaaagaugcuagagagccuguggugggggcgagauauauacagacuuuaaaagaccauagaccaagaauggugugggauagccaagccagugaacauuucuuugaauacaaaaaauccagguccgguagacauguggucuucuauccuacguuaaagucccugcagguuaggcuugaauuagcccgcgaguugggaguaggggucagcaucugggaacuuggucagggccucgacuauuucuacgaccugcucuag

SEQ ID NO: 14901 - RNA, 504 nt, Artificial Sequence
  Description of Artificial Sequence: Synthetic coding sequence
augagaucccuucuccuacucuccgccuucugucugcuggaagcugcacuugccgccgaagucaaaaagccugcugccgcagcugcgccagggaccgccgaaaaacugagucccaaagccgcgacccuggcagaacggucggccggccuugccuuuucucucuaccaagcaauggcaaaggaucaagcugucgagaauauucuggugagcccagucgucgucgcuucaucccugggccuggugucucugggagguaaggcuacaaccgcgucucaggcaaaagcaguccuaucagcugagcagcugagagaugaggaaguccaugccggacugggggaacucuugagaucauugucuaacucuaccgcccgaaaugugaccuggaaacugggcagcagacuuuauggacccagcucagugucuuucgccgaugacuuugucaggucuuccaaacagcauuauaauugcgaacauaguaagaucaacuuuagagacaagcgauag

SEQ ID NO: 14902 - RNA, 1209 nt, Artificial Sequence
  Description of Artificial Sequence: Synthetic coding sequence
augaugguugcauuaaggggugccuccgcauugcugguacuuuuucuugccgccuuucucccuccaccccaguguacgcaggaucccgcaaugguccauuacauauaucaacgguuuagaguguuggaacagggucuugaaaaaugcacccaggcaaccagagcauauauucaagaauuccaggaguuuuccaagaacauuucaguuaugcuugguaggugucaaacauauaccagugaauauaagagcgcugucggaaaucuggcacugagggucgaacgggcacagcgggaaauugauuauauucaauaccuacgggaagcagacgagugcauugaguccgaagauaagaccuuggcagaaaugcuucuccaagaagcagaagaggaaaagaaaauccgcacacuuuuaaaugcuagcugcgauaauaugcucaugggaauaaagagccucaaaaucgucaagaagaugauggauacucaugguucauggaugaaagaugccguuuacaauagcccuaaaguauaccugcugauuggaucgagaaauaacaccguaugggaguuugccaauauucgcgcauucauggaggacaacacaaagccugccccgaggaaacagauuuuaacucuuagcuggcaagggacaggccagguaaucuacaaaggguucuuguuuuuccacaaccaagccacaucaaaugagauuauuaaguauaauuuacaaaaacggaccguugaggacagaaugcugcugccgggcggaguggggagagcacuggucuaucagcauucacccuccaccuacauagaucuggcaguugaugagcacgggcuuugggcuauucauuccgguccuggcacucauagccaucucguccugaccaaaauugagccuggcacauuagggguugaacacuccugggacacacccugucggucacaagaugcggaagcuucuuuccugcuguguggcguccuguacguggucuacucuacugguggccagggcccucaccgaauuacuugcaucuacgauccacucggaaccauuagcgaagaggaccucccaaaccuuuucuuuccuaagaggccccgaagucauucuaugauccauuacaacccacgagauaagcaacucuacgcauggaacgaagggaaucagauuauuuacaagcugcaaacgaagagaaaacugccucugaaauag

SEQ ID NO: 14903 - RNA, 975 nt, Artificial Sequence
  Description of Artificial Sequence: Synthetic coding sequence
augagaucucugcuacugcucucugccuuuugccugcucgaagccgcccuggccgcugaagugaaaaaacccgcggccgcugcagcaccgggcaccgccgagaagcuuucacccaaggcagcaacucucgccgaacgcagcgcuggccuugccuuuucucuguaccaagccauggccaaagaccaggcugucgagaacauucucgugucuccaguugucguggcauccucacugggucucgugagucucggcggcaaagcuacuacagcuagccaagccaaagccguacucucugcugaacagcugcgagaugaagagguccacgccgggcugggggaacuccuuagaucccucuccaauucuacggcccguaauguuacauggaaauuaggaucgcgucuguauggaccgucuagcguguccuuugccgaugacuucguacgcucaucuaaacagcacuauaacugugagcauaguaaaaucaauuuuagggauaaaagaucugcauugcaaagcauuaaugaaugggccgcccaaacuaccgacggcaagcuccccgaagugaccaaagacguugagaggacugacggagccuugcuggugaaugcaauguuuuuuaaaccucauugggacgagaaauuucaccacaaaaugguugacaaccggggauucaugguaacacgcucauacacagugggggucaugaugaugcauagaaccggauuauacaacuacuacgaugacgagaaggagaaguugcaaauaguugaaaugccauuagcacauaaacuaucaucucuaaucauucugaugccucaccacguggagcccuuagagcgucucgagaaacuuuugaccaaggagcagcuuaagauuuggaugggcaaaaugcagaaaaaggccguggcgaucucguugcccaaaggagugguggagguuacccaugaucugcaagugagaggcggaccagcguag

SEQ ID NO: 14904 - RNA, 990 nt, Artificial Sequence
  Description of Artificial Sequence: Synthetic coding sequence
auggugucuaagucacguuggaaacuccucgcgaugcuggccuuaguacucguagugaugguuugguauuccauuagcagagaagacaguuuuuauuuuccgaucccugaaaagaaggagcccugucugcagggugaggccgaaucuaaagcaaguaaacuguuuggaaacuauagccgagaucaacccaucuuucugcgcuuagaagauuacuucuggguuaaaacaccaucugcauacgagcugccuuacggaacaaaaggaucggaggaucugcucuuacggguauuggcaauuaccuccucuuccaucccuaagaacauccaaucucugcggugccgcagguguguggugguggggaauggacacagguuacggaacucaucucugggagacgcaauuaauaaauacgacguggugauaagacugaacaaugccccaguggcaggauacgagggcgauguggguagcaagacaacaaugcgacuguuuuacccagaauccgcucacuuugacccuaagguggaaaauaaccccgauacucuccuuguucucguugcuuucaaagcuauggacuuucauuggaucgaaacaauacugagcgauaagaagagggugcgcaagggauuuuggaagcagccaccucucauuugggacguuaacccuaaacagauccgaauccugaaccccuuuuucauggagauugcagcugauaaacuuuuaucccugcccaugcagcagccccggaagauaaaacaaaagcccaccacugguuuacuggcaaucacucuggcccuucaucugugcgauuugguacacaucgccggcuuuggauauccugacgcuuauaauaaaaagcaaacuauacacuacuacgagcaaaucacacucaaaagcauggcugguaguggccacaauguaagccaggaagcccucgcaauuaaaagaaugcuggaaaugggagccaucaagaaucuaacauccuucuag

SEQ ID NO: 14905 - RNA, 351 nt, Artificial Sequence
  Description of Artificial Sequence: Synthetic coding sequence
augcgcacccuguuuaaucuucuauggcuugcgcuugcguguagccccguucauacaacccuuucaaaaucggaugccaagaaagccgccagcaaaacacuacuugaaaagucccaguucuccgacaagccugugcaggacaggggauugguugugaccgacuugaaagcagagagcguugugcucgaacaucgguccuauuguucagcaaaagccagagaccggcacuuugcaggcgacguccuggguuaugugacaccauggaauucccauggauacgacguaaccaaaguguuugggucaaaauuuacucagauuaguccaguuuggcuucaacucaaaagacgguag

SEQ ID NO: 14906 - RNA, 282 nt, Artificial Sequence; identical to SEQ ID NO: 13267
  Description of Artificial Sequence: Synthetic coding sequence

SEQ ID NO: 14907 - RNA, 255 nt, Artificial Sequence; identical to SEQ ID NO: 13268
  Description of Artificial Sequence: Synthetic coding sequence

SEQ ID NO: 14908 - RNA, 27 nt, Artificial Sequence
  Description of Artificial Sequence: Synthetic coding sequence
augagccucgauauucaaagucuguag

SEQ ID NO: 14909 - RNA, 576 nt, Artificial Sequence
  Description of Artificial Sequence: Synthetic coding sequence
augcucaucuuuuggacgauaacguuauucuuauuaggcgcggcaaaaggaaaagaggucugcuaugaggacuuaggauguuucagcgauaccgaacccuggggcgggacagcaauuagaccuuuaaagauccugccuuggucuccagagaaaaucggcacacgauuucuccuguacacgaacgaaaaccccaacaacuuccagauccuccuccucuccgacccaagcacaaucgaagcuaguaacuuucagauggaccgaaaaacccgguuuauaauccauggauucaucgacaagggugaugagucauggguuacagacauguguaaaaaguuguucgaaguugaggagguaaacuguauuuguguugacuggaagaaagggucgcaggcuacguacacucaagcugccaacaauguucgaguggugggcgcccaggucgcucagaugcuagauauacugcugacggaguauucauacccaccaagcaaagugcaucuuaucggucacaguuugggagcacacgucgcuggggaggcuggcucaaaaacaccuggccugucacggaucaccuag

SEQ ID NO: 14910 - RNA, 123 nt, Artificial Sequence; identical to SEQ ID NO: 13271
  Description of Artificial Sequence: Synthetic coding sequence

SEQ ID NO: 14911 - RNA, 648 nt, Artificial Sequence
  Description of Artificial Sequence: Synthetic coding sequence
augaggccuaagaccggacaagucggaugugagacuccugaggagcugggaccggggccuagacaacgguggccucuuuuguugcucgggcuggcuauggucgcccauggucuccugcguccaaugguugcaccgcaaucaggugauccugacccuggcgcaucuguggggaguucacggaguucacugcgaaguuuauggggcuccagacugcuauuacaaccuucuccccagagagcugacccucggugcuggccuagaggauucuggagcgagccgcagagcuuauguuauguuuucgggacuggcaccaaggugacagugcuagggcaacccaaagcaaacccuaccgugacauuguucccuccgagcucugaagaacuccaggccaauaaagcaacgcuugugugucugaucucggacuuuuauccuggcgcggugacgguugcauggaaagccgacggcagcccugugaaagcuggcguagaaacaacaaagcccuccaaacagucuaauaacaaguaugccgccuccuccuaccucucgcugacaccagaacaauggaaaucccaccgauccuauucaugucaggucacccacgagggaucuacugucgaaaaaacugucgccccaaccgaauguuccuag

SEQ ID NO: 14912 - RNA, 999 nt, Artificial Sequence
  Description of Artificial Sequence: Synthetic coding sequence
auguguccagcuggauggaagcucuuggccauguuagcauuaguguuaguggugaugguuugguacagcaucagucgcgaggauagauacauagaacuguuuuacuuucccaucccagaaaagaaggagccgugucugcaaggcgaggcagaaucuaaagcuaguaaguuguuuggcaauuauagucgggaucagccuauuuuccuccgauuggaagacuauuucugggugaaaacuccguccgcuuaugagcuaccuuacggcacaaagggcucagaagaucugcuguugcgaguauuggcuaucaccaguucaucuauuccaaaaaacauccagagcuugaggugccgcagauguguggucgugggcaacggucaccgauuaaggaauuccucccugggagacgcuaucaacaaauaugacgucgugauccggcuuaacaaugccccaguagcugguuaugagggggaugucggcuccaaaacaacuaugcgacuuuucuaccccgaauccgcucauuucgaucccaaaguggaaaauaaccccgauacccuacucguacuggucgcuuucaaggccauggacuuucacuggaucgagaccauacugagcgacaagaaacgugugagaaaggguuuuuggaagcagcccccccucaucugggacgucaaccccaagcagauucgaauucugaaucccuuuuuuauggagauugccgcugacaaacugcucucccuccccaugcaacagccucgcaagauaaaacaaaaaccuacaaccggcuuacuggcaaucacccuugcacugcaccucugcgaccucguccacaucgcuggcuucggauacccagaugccuacaacaaaaagcagacaauacacuacuacgaacagauuacucugaaauccauggcaggaucaggucauaauguaagccaggaggccuuagcaauuaaacgaaugcuggagaugggcgcaauaaagaaucuuacaaguuucuag

SEQ ID NO: 14913 - RNA, 888 nt, Artificial Sequence
  Description of Artificial Sequence: Synthetic coding sequence
augcgcucucugcuucuauugucagccuucugccuccuugaagccgccuuggcugccgaagucaaaaagccugcugcagcggccgcccccgggacugccgagaaacuaucuccaaaggccgcuacucuggccgaacggucagcugggcuggcauuuucacucuaucaagcaauggcuaaagaccaggccguagagaacauucugguguccccuguggugguggcaucgucacugggccuaguuagucuggguggcaaagcuacgacagcaucccaggcuaaagccguguuaucggccgaacagcuucgcgacgaggaagugcacgccggacugggagagcuccuucgcuccuuauccaacucuaccgcuagaaauguaacauggaagcugggcucucggcuguacgguccauccagugugucuuucgccgacgacuuugugagauccuccaaacagcacuacaauugcgaacacuccaaaaucaauuuccgcgauaagagaucugcccuucaaucaauuaacgagugggccgcccagaccaccgacggaaaacugccugaagugacgaaggauguugagaggaccgauggcgcccuucucguuaaugcaauguucuuuaagccucauugggacgaaaaguuucaucacaaaauggucgauaaucggggguuuauggucacgcgaucuuacaccgucggugugaugaugaugcaccgcaccgggcuguacaacuauuacgacgacgaaaaagaaaagcugcaaauuguggagaugccauuggcacacaagcuguccucccuuaucauucuaaugccacaucauguagagccgcuugagagacuggagaaauugcuaacuaaggaacaguugaaaauauggaugggguag

SEQ ID NO: 14914 - RNA, 399 nt, Artificial Sequence
  Description of Artificial Sequence: Synthetic coding sequence
augagaacccucuucaaccuccuguggcucgcccuagccugcagucccguccacaccacccuaucuaaaucagacgccaaaaaggccgcgaguaaaacucugcuggaaaaaucucaguucagugauaagccagugcaggacaggggccugguggucacggacuuaaaggcugaauccguuguccuggaacaucgaucauauugcuccgcuaaggcuagagaucgccauuuugccggcgacgugcugggcuauguaacccccuggaacucccacggauacgauguaacuaaagucuuuggcagcaaguuuacucaaauuucaccaguauggcugcaacucaaacgacgggggcgcgagauguucgaggucacugggcugcacgauguugaucagggcuag

SEQ ID NO: 14915 - RNA, 360 nt, Artificial Sequence
  Description of Artificial Sequence: Synthetic coding sequence
augcgcacacuguucaauuuguuguggcuggcuuuggcgugcuccccugugcacacaacucuuucaaagucugaugccaagaaggcagcuagcaagacacuacuggaaaaaagccaauuuucugauaagcccgugcaagauagaggccugguugugacggaccuaaaggcugaauccgucgugcuugagcaucgaucauacuguagugcuaaagcacgagauagacacuucgccggugacgugcugggcuaugugaccccauggaauucucacggcuacgaugugacaaaaguuuuugguagcaaauuuacacaaauaaguccaguuuggcuacagcugaaacgccguggaagagaguag

SEQ ID NO: 14916 - RNA, 390 nt, Artificial Sequence
  Description of Artificial Sequence: Synthetic coding sequence
augccuauggcuucuccccagacccuaguucuuuaccugcucguacuggccgucacagaagccugggggcaagaagcuguaaucccugggugucaucugcauccguuuaacguaacagugagaucggaucgacaagggaccugucagggcucucacguggcucaagccugugucggucauugugaguccucugcuuucccuucgcgguacaguguccucguggccucaggguauagacacaacaucaccucaguuagccaguguugcaccauaaguggcuuaaagaaaguuaagguacagcugcagugugucgggagucggagagaagaguuagagauauucacagccagagcaugccagugugauauguguagacugaguagguauuag

SEQ ID NO: 14917 - RNA, 1386 nt, Artificial Sequence
  Description of Artificial Sequence: Synthetic coding sequence
augagccucgacauucagagccucgacauucagugcgaagagcucuccgacgcccgaugggcugagcuucuuccccuccugcagcagugucaaguggucagauuagaugacuguggacuuacagaggccagaugcaaagauaucaguuccgcuuugcgcgucaacccugcccuggccgaacuaaaucugagaucaaacgaacuuggagacgugggcgugcauugcguucuucaaggauugcagacaccgucaugcaagauucagaagcucucccugcagaauugcugucuuacuggagccgguugcgguguucugucuucuacacuucgaacauuaccaacauugcaagagcugcaccugagcgacaacuuauuaggcgaugcaggacugcagcugcuuugugagggccuccuggauccccagugcagacuagaaaaacuucaguuggaauacuguucuuuaagcgcugccucaugugaaccccuggcaucugucuugcgggccaagccugacuucaaggaacugaccgugagcaacaaugauauuaacgaggcaggggugagaguguuaugccagggccuuaaagauagcccuugucaguuagaggcucugaaacuugaaucuugugggguuaccagcgauaacugcagggaucuguguggaaucguagccagcaaagcuucuuugcgcgagcuugcuuugggauccaauaagcucggagauguggguauggcugaguugugcccugggcuacugcaccccuccaguagacugcgcacacuguggaucugggagugcggcauuaccgcaaaaggcuguggcgauuugugucgaguacugagagcuaaagaguccuugaaggaacugagccuagccggaaaugagcugggugaugaaggcgcaagacuacugugcgagaccuuguuagaaccaggaugccaacuggagucucuguggguuaaaucgugcucuuucacagccgcaugcuguucucauuuuucuucaguccuagcccaaaauagguuuuuauuggagcuccagauuagcaacaaccgccucgaggaugcuggcgucagggaacugugucaggguuugggccaacccggaagcgugcuacgggugcucuggcuugcagacugugacguuagugauucuaguugcucuagccuugcugcaacacugcucgcaaaccacucacugagagagcucgacuugaguaauaauugucugggcgaugcaggaauccugcagcucguggaaucuguuagacagccugguugcuuguuggaacagcucguccuguacgacaucuauuggucagaagaaauggaagacagguuacaagcgcuggagaaagacaagccgucauuaaggguuauuucauag

SEQ ID NO: 14918 - RNA, 453 nt, Artificial Sequence
  Description of Artificial Sequence: Synthetic coding sequence
augaggagucugcuccuauuguccgcuuuuugccugcucgaggcggcccuggcagcugaagucaaaaagcccgccgcagccgccgccccuggcacagccgagaagcuguccccuaaggcugccacucuggcagagcguagcgccggucuggcauucaguuuauaucaagcaauggccaaagaccaggccgucgaaaacauccucguaagucccguugugguggccucuuccuuaggacuggucucccucggugguaaagcaacaaccgcuucacaggcuaaagcaguccuuagcgccgagcaauuacgagaugaagagguacaugccggucuuggagaguuacugagaaguuuaucuaauucaaccgcuagaaacgucaccuggaagcuggggucccgucuuuacgguccgucaagcguaucauuugccgacgacuucgugaggucgagcuag

SEQ ID NO: 14919 - RNA, 1257 nt, Artificial Sequence
  Description of Artificial Sequence: Synthetic coding sequence
augagaucacucuugcugcuuagugcauuuuguuugcuggaggcugcuuuggccgccgaaguuaaaaaaccagccgcagccgcugcuccuggcacagcagaaaagcuuucuccuaaagcggcaacccuggccgagagaucagccggucucgccuucucccuguaccaagccauggcaaaggaucaggcuguggaaaacauucuuguaucuccagucguuguugcauccucccugggacugguuucucuuggcgggaaggcaacuacagccucucaagcuaaagcugugcucagugccgaacagcugagagacgaagaggugcaugcggggcucggugaacucuuacggucgcuuucaaacuccacagcucggaaugucacuuggaaacugggcucucgguuguaugguccaucuuccguauccuucgcugaugauuucgugaggucaucaaagcagcacuauaauugcgaacauuccaagaucaacuuccgcgauaagagauccgcacugcaaucaauuaaugagugggccgcccagaccaccgauggcaagcugcccgaaguaaccaaagacguggaacgaaccgauggagcccucuuagugaaugcuauguuuuuuaagccacacugggacgagaaauuucaccauaagaugguggauaacaggggauuuauggugacccgcuccuauacugugggcguaaugaugaugcaccggaccggacuauacaauuacuaugacgaugaaaaggaaaaguuacagaucguugagaugccgcucgcacauaaauuaagcucccuuauuaucuugaugccccaucacguggagccccuugaaagauuggaaaaacuucugacaaaagaacagcugaagauauggauggguaaaaugcaaaagaaagcuguggcuaucagucuccccaaaggggugguugaagugacucaugauuuacagaagcaccuggcuggauugggacugacagaagcuauagauaaaaacaaggcggaucuuagccgaaugucaggcaagaaggaucucuauuuagcaucaguguuccacgcgaccgcauuugagcucgacacagacgggaacccauuugaccaggauauauacggccgagaagaauuaagaucacccaagcuguuuuaugccgaccacccauuuauauuucucguucgcgacacccagaguggcucucugcuguucauagguagauugguuagacccaagggagauaagaugcgggacgaguuauag

SEQ ID NO: 14920 - RNA, 1002 nt, Artificial Sequence
  Description of Artificial Sequence: Synthetic coding sequence
augguuucaaaaagccgauggaagcuucucgccauguuagcucuggucuugguggugauggucugguauucaaucucgagagaagaucgguacauagagcuguuuuauuucccaauccccgagaagaaggaaccaugcuugcagggagaagcugagucaaaggccucaaagcuguuuggcaacuacucaagagaucagccaaucuuuuuacgacuggaagacuacuuuuggguuaaaacacccagugcauacgaauugccguacggaacgaaagguucagaggauuugcuguugcguguguuagccauuacuucuaguaguauucccaagaacauucaaucauugaggugcagaagauguguuguggugggaaaugggcaccgacuaagaaauucaucacugggugacgcaauuaauaaguacgacgucgugauccggcucaauaaugccccaguggccggcuaugagggagauguugguagcaagaccaccaugcgacuguuuuacccugaguccgcgcacuucgauccgaaaguggaaaacaaucccgacacccuccucguacugguggccuuuaaagcuauggacuuccacuggauugagacuauucucagcgauaaaaaaagaguucgcaagggauuuuggaaacagccaccucugaucugggacgucaacccuaagcagauacgaauucugaaccccuuuuucauggaaauugccgcugacaagcugcuaucccugccaaugcaacaaccuagaaagauaaaacagaagccaacaaccggucuuuuagcuauuacucuggcacuccacuuaugugaccugguacacauugcugguuuuggcuaccccgacgcuuacaauaagaaacagacaauccauuacuacgaacagaucacuuugaaaucuauggcugggucaggacacaaugugagucaggaagcacuugcgauuaaaagaaugcuugagaugggagccauuaagaaccucacaaguuuuuag

SEQ ID NO: 14921 - RNA, 987 nt, Artificial Sequence
  Description of Artificial Sequence: Synthetic coding sequence
augugccccgccggcuggaaguuauuggccaugcuugcacucguccuugucgugauggugugguauuccauuuccagagaggacucuuucuauuuccccaucccagaaaaaaaagagcccugccuccagggcgaagccgaaaguaaagcauccaaacuuuuuggaaauuauucuagagaccaaccuaucuuccuccgccucgaggauuauuuuugggugaagacuccaucugccuaugaacuucccuauggcaccaaaggaagcgaggaucugcucuuaaggguuuuagcaauuaccuccuccuccauuccuaagaacauccaaucccuacgaugccgacgaugugugguagugggcaacggacaccgacuaagaaauagcucgcugggggaugccauaaacaaauacgauguggugauacggcugaacaaugcaccuguugcuggcuacgaaggcgauguaggcuccaaaaccacuaugcgccuguucuauccugaauccgcccauuucgauccgaaaguagaaaacaacccagauacccuguugguacuaguggccuucaaagccauggacuuucacuggauugagacuauuuuaucugauaaaaagcgggugaggaagggauuuuggaaacagccuccacugauuugggacgucaaucccaagcagauccggauuuuaaacccauuuuuuauggaaaucgccgcagacaagcuacuaucacugccaaugcagcaaccacgcaaaauuaaacagaaaccaacuacgggacuuuuagccaucacucuggcacuccaccucugcgaccucguacacauugcuggguuuggcuauccugaugccuauaauaaaaaacagaccauacauuacuacgaacagauaacucucaaaagcauggcagguucuggucacaacguaucacaggaggcccuggcaauuaaacgaaugcucgaaaugggagcuauuaagaaucuuaccucauucuag

SEQ ID NO: 14922 - RNA, 585 nt, Artificial Sequence
  Description of Artificial Sequence: Synthetic coding sequence
augacaaugagacauaauuggacaccggaucuuagcccauuaugggugcugcuguugugcgcacacgucguuacacuacuaguuagagccacaccagucucccagaccacgaccgccgcuaccgcgucaguccggagcaccaaggacccauguccaucacagccuccuguuuucccagcugcaaagcaaugucccgcauuagaagucaccuggccugaagucgaggucccccugaauggaaccuugagcuuguccugugucgccuguucucgcuuuccgaacuuuuccauacuuuacugguuaggcaacggaagcuucaucgagcaccucccuggacgguuaugggaaggcuccacgagccgagaaagaggcaguacuggcacccaguuguguaaggcgcugguucuagaacaguugacacccgcucuucacucuaccaauuucucuugcguccuugucgacccugagcagguuguacagcgacauguuguccucgcccagcucugggccgggcucagggccaccuuaccccccacccaggaggcacugccaagcucacauucaagcccacagcagcaaggauag

SEQ ID NO: 14923 - RNA, 1386 nt, Artificial Sequence
  Description of Artificial Sequence: Synthetic coding sequence
augucacuggauauccagucccucgacauucagugugaggagcugucagaugcacguugggccgaacugcucccucucuugcaacaaugccagguaguccggcuggaugauugcggacuaacugaagcucgauguaaagacauaucuagugcucuccggguaaaccccgccuuggccgaacuuaaccugaggucaaacgaacugggagauguggguguucauugcguucuucaaggacuccagaccccuucauguaaaauccagaaauuaucacugcaaaacuguugccugaccggagcaggaugcgggguccugucuucuacucuuagaaccuuacccacacuacaggaauuacacuuaucugacaaucuguuaggagaugccggccuccaacuccuuugcgagggccugcucgacccccagugucggcuugaaaaacuccagcucgaauacugcaguuuguccgcagcaucuugugagccucuugcaagcguauugcgcgcuaaacccgacuuuaaagaacugacgguaucuaauaaugauaucaaugaggcaggcgugagagugcuuugccagggacuaaaggacucacccugccaguuggaggcucugaagcuggaauccuguggcgugaccagugacaauuguagagacuuguguggcaucguggcuaguaaagcuucccuuagagagcuggcucugggaucaaauaagcucggagacgugggaauggcugaauuguguccgggacuccuccauccaucuucgcgacucaggacccuguggauuugggaaugugguaucaccgcaaagggguguggggaucucugccgagugcugcgagccaaggagagccucaaagaacugagccucgccggaaaugagcugggcgaugagggagccagacuuuugugcgagacucuccuugaaccuggaugccaacuggaaagucuuuggguuaaaucgugcuccuuuaccgccgcuuguuguucucacuucucauccguucuagcccagaacagauucuugcuggaacuucaaaucucaaauaaccgcuuagaagacgccggcgugcgggagcuaugccagggccugggccaaccggggucggugcucagaguucuguggcuggccgauugugacgucucggacucuucauguucaagccuggcugcuacccuacuggccaaccauucccucagagaacuugaccugucaaauaacugucugggcgacgcuggaauacugcagcuuguggaguccguccggcaacccgggugccugcuggaacaauuagucuuauaugauauauauuggagugaagagauggaggaucgacuccaggcucuggagaaagauaaaccuucccuacgcgugauaucuuag

SEQ ID NO: 14924 - RNA, 1995 nt, Artificial Sequence
  Description of Artificial Sequence: Synthetic coding sequence
augccgcaagcuccaucaacuggcucuagccugauccgagaucccuccaucgcccauagaaauacccaaauccuauggaccgaggccgguagagaccucgcccaggauacuagauacacaggggaagaaucuuugaccauuuucguugacaagcgcaagcuguccaagagggccgagggguccgacucaacaacaaacaguuccucaguuacguuggagacuuuacaccaauuagcagcaucauacuuuauagacagggauucaacacuacgacgauugcaucacauacaaauagcauccacugccauaaaggugacugagacccgcacuggcccccuuggcuguucuaauuaugauaaucucgacuccguuucuagcguuuugguucagucucccgagaacaagauucagcugcagggcuuacagguuuuacugccagacuacuuacaggagcgauucguacaggcugcucuuucuuauaucgcguguaauucugaaggagaauuuauauguaaagaaaacgauuguuggugccauugcgguccuaaguucccggagugcaauugcccaucaauggacauucaggcuauggaggagaaucuccuacgcaucaccgaaacguggaaagcuuacaacagcgacuuugaagaauccgacgaauucaaacuguuuaugaaaagauugccaaugaauuauuuuuuaaacacuaguaccaucaugcaucuguggacuauggauucaaacuuccagcgccgauacgaacagcucgaaaacuccaugaaacaguuauuccugaaggcacagaaaauugugcacaagcucuucucccuaucuaaacgaugucacaagcagccucugauuucuuuacccaggcagaggaccagcaccuauugguuaacccggauccaguccuuucuauacugcaaugaaaaugggcuuuuaggcuccuucucugaggaaacgcacucuuguaccugccccaaugaucaagucguaugcacggcuuuccuccccuguaccguuggagaugcuucagccugccucaccugcgcccccgacaauagaacuagauguggcaccugcaacaccgguuacaugcugagucagggacucugcaagccugaaguagcugaauccacugaucacuauauaggguuugaaacugaucuucaggaucuggaaaugaaauaucugcugcagaagaccgaccggaggauugaaguacacgcuauuuucaucucgaaugauaugaggcugaauucuugguucgaccccucuuggagaaagcguaugcuccugaccuugaaauccaauaaauacaaaucuucucucguccauaugauucugggccuuuccuuacagauuugucuaaccaaaaauagcacucucgagcccgucuuagccgucuacgugaauccuuuuggcggcagccacagcgagucuugguuuaugcccgugaaugagaauaguuuccccgacugggaaagaacgaaacuugaccugccucugcagugcuauaacuggacccugacacuggggaauaaauggaagacauucuucgagaccgugcacaucuaccugagaucucgcauuaaauccaacggaccuaacggcaaugagucuauauacuaugaaccgcucgaguuuauugacccgucacgaaaucuuggcuauaugaagaucaauaacauccaaguuuucgguuauagcaugcauuucgacccugaggcaauccgcgacuugauacugcagcuagacuacccauauacacaaggcucucaggacucugcucuucuccaguugcuggagauuagagaucggguuaauaaacucucgccaccaggucagcgccgacuggaucuguuuucuugucugcuccgucaccgccugaaauuauccaccucugaaguugucaggauucaauccgcucuucaggccuucaacgcaaagcuccccaauaccauggacuaugauaccacuaagcuaugcucguag

SEQ ID NO: 14925 - RNA, 459 nt, Artificial Sequence; identical to SEQ ID NO: 13286
  Description of Artificial Sequence: Synthetic coding sequence

SEQ ID NO: 14926 - RNA, 696 nt, Artificial Sequence
  Description of Artificial Sequence: Synthetic coding sequence
auguuauauauaggcaucgccgaauacuuuuuuaaaucagccucauuugcccacuuuaccgcuggcguguucaaugugacccucuccacggaagaaauuucuaaucauuucguccagaauucucaaggauugggcaaugugcuuagcaggauagcugaaauauauauccucucccagccguuuauggucaggauuauggcuaccgagccaccuauuaucaaccugcagccuggaaacuuuacccuugacauuccugcuagcauuaugaugcuaacccaaccaaaaaauucaaccgucgaaacaauugugaguauggacuuuguggccagcaccucugucgguuuaguuauccucggacaacgacuagucugcucauugucccugaauagguuucgcuuagcccuucccgaguccaauagguccaauaucgagguccuucguuucgaaaacauucucucaaguaucuugcauuuuggagugcuuccucucgccaaugccaaguugcagcaaggcuuuccacucaguaacccacauaaguuccuuuucgugaacagcgacaucgaaguccuggagggguuucuccuaauuucaacggaccuaaaauaugagacuaguucaaagcaacaaccaagcuuccacgugugggaaggacuuaaucugauuagccgucaguggaggggcaagagugcaccauag

SEQ ID NO: 14927 - RNA, 1911 nt, Artificial Sequence
  Description of Artificial Sequence: Synthetic coding sequence
augacaacuuggagucugcggcggcggccggcccggacacuaggccuccuucuguugguaguccugggguucuuaguacucagacgcuuagauuggucaacacuugugccucuacgcuuaagacacaggcagcuuggauuacaggcuaaaggauggaauuuuaugcuggaagauucaacauuuuggauauucgguggaagcauccacuauuucagggugccccgagaguauuggcgggaccgauugcugaagaugaaagcaugcggacugaauacccugacaaccuacguuccguggaaccugcacgaaccugagcguggcaaguuugacuucucagguaaccuugaccuggaggcauuuguacugauggcagccgaaauugggcucuggguuauccugagacccgggccuuacauuuguagcgaaauggacuugggcggacuuccuucauggcuucuccaggaucccgggaugcgccugcgcacuacauacaaaggcuuuacugaagcagucgaccuuuacuuugaccaucugaugucaagagucguaccccugcaguauaaacggggagggccuauaauagcagugcaaguggaaaaugaauacggaucauauaacaaggauccugcauauaugccauacgugaaaaaggcacuagaggaucgugguaucgucgaacugcucuuaacuagcgacaauaaggacggacuaaguaagggcauugugcagggaguuuuggccacuauaaauuugcagaguacccaugaacuccaacucuuaacuaccuuccuguucaauguccaggggacgcagcccaaaaugguuauggaauauuggaccgggugguuugacuccuggggcggcccacacaauauucuggauagcucagagguuuuaaagacagugagugccaucgucgaugccgguucaucaauuaauuuauacauguuucacggaggaacuaacuuuggguuuaugaacggcgcaaugcauuuccaugacuauaaaucugaugucacaaguuacgauuacgaugcuguucuuacagaagccggagauuacaccgcgaaguauaugaaacugcgggauuuuuuugggagcaucucaggcauaccucugcccccaccaccugaccuccugccgaaaaugccguacgagccacugacaccuguucuguaccucucucugugggaugcccugaaguaucucggagaacccaucaagucagagaaaccuauaaacauggaaaaccugccagugaacggaggcaacggucagucauucggcuacauacuguaugagacaucuauuaccuccagcggaauacuguccggccaugugcacgaccgaggccagguuuuugucaacaccgugagcauuggauuuuuagauuauaaaacaacaaaaauugccgugccccucauccaggguuauaccgucuugcgcauccugguggaaaaucgaggaagggucaacuauggcgagaauaucgacgaccagcgaaagggacucauuggcaaccucuauuugaaugauuccccucugaaaaacuuccggaucuacagccucgacaugaagaaguccuuuuuccagagauucggccuggauaaguggagcagucugccagaaacaccuacucucccugcauucuuucucggcucccugaguaucagcucuaccccuugugacacuuuucugaaguuggaggguugggaaaaaggcguuguguucaucaauggucagaaccugggacguuacuggaauaucgggccacagaaaacacuguaucugccaggacccuggcuuucuuccgguaucaaucagguaauugucuuugaagaaaccauggccggacccgcacugcaauucacagaaaccccacaccuagguagaaaucaguauaucaaguag

SEQ ID NO: 14928 - RNA, 1374 nt, Artificial Sequence
  Description of Artificial Sequence: Synthetic coding sequence
augggguguucuuugccuuuauccuguauuaugguucgcagcguggcuugggcuggcuucaugguucuucugaugauaccuuggggguccgccgccaaacuggucuguuacuuuacuaauugggcucaguaucggcaaggggaggcccguuucuugccuaaggaccuggauccaucgcuuuguacccaucuaauauaugcauucgccggaaugaccaaccaucaacuaucgacgacagaguggaacgaugagacacuguaucaggaguuuaacggacugaaaaaaauguuuacagacaugguggccacagcuaauaaccggcagaccuuugucaauucugccauuagauuucugcgaaaauauucauucgauggucuugaucuggauugggaguacccaggaucccaaggcucucccgccgucgauaaggagcgguucacuacacuugugcaggaucuggccaacgcguuccagcaggaggcacagacuucagguaaggaaagguuauuacucuccgcugcuguaccagccggucaaaccuacgucgacgcaggcuacgaggucgacaagauagcccagaaccuugauuuugugaaccugauggccuacgauuuucaugggucuugggaaaaaguuaccggucauaauuccccacuuuacaaacgccaagaagagucuggggccgccgccagccucaacguggaugcugcgguccagcaguggcuacagaaaggaacacccgcuucuaaacuuauccugggaaugcccacauacggaagaagcuucacucucgcguccucauccgauacuagagugggcgcgcccgcuaccggcuccgguaccccgggacccuucacuaaggaaggcggaauguuggcuuauuacgaaguuuguucuuggaaaggcgccacuaaacagaggauucaggaccagaaagugccuuauauauuccgcgauaaccaauggguuggauuugaugacguugaguccuuuaagacaaaagucucguaucucaaacagaagggauuagggggggcaaugguuugggccuuggaccuugaugacuuugccgguuucagcuguaaccaagguagauauccucuaauccaaacucuucgccaggagcuuagccuuccauaccugccuuccgguacacccgagcucgaggugccaaaacccggacaaccauccgagccugagcacggcccaagucccggacaagacaccuucugucaagguaaagcagauggcuuauauccgaacccccgcgaacgguccaguuucuauuccugcgcagccgguaggcuguuccagcaaucuugcccaacaggccugguauuuuccaacagcuguaaauguugcaccuggaauuag

SEQ ID NO: 14929 - RNA, 1125 nt, Artificial Sequence
  Description of Artificial Sequence: Synthetic coding sequence
auguacguaagcacucgagagagauauaaaugguugagauuuucggaagauugccucuacuuaaacguguaugcccccgcucgagccccaggcgauccacaacuuccuguaauggugugguucccaggcggagcauucauuguuggcgcggccucuaguuaugagggcucugaucuggcugcuagagaaaagguagugcugguguuccuucagcauagacuuggcaucuuugguuuucuucgauggagggguaggacggacgacagccacgcccggggaaauuggggacuauuggaccagauggccgcacuucgguggguucaagaaaauaucgcagcauuugguggugaucccgggaaugucacguuguucgggcagagcgcuggugcaaugucuaucucuggacugaugauguccccucucgcaagcgggcucuuccacagagcgaucagucaaaguggcacggcucuuuuuagacuguuuaucacuuccaacccucucaaaguagcgaaaaaaguggcacaccuugcuggaugcaaccacaacucaacacaaauucuugugaauugcuuacgggcucugucugguacaaaggugaugcgaguuucaaacaaaaugcgguucuugcaacucaacuuucagagagauccugaggaaaucauuuggucgauguccccagugguggacgggguggugauucccgacgacccauugguacuccuaacucagggcaaagugucuagugugccuuacuugcugggcgugaauaaucucgaauuuaacuggcugcuccccuauauuaugaaauucccgcugaaccgccaggccaugagaaaagagaccauuacaaagaugcuguggagcacccguacucucuugaacaucaccaaagaacaggugccucugguagucgaagaguaccuggacaacguaaaugaacacgauuggaaaaugcugaggaauagaaugauggacauaguucaagacgcuaccuucguauacgcuacccuccaaaccgcacacuaccaucgcgagacgccuaugaugggaaucugcccagcaggccacgccacaacaagaaugaagucaaccuguucuuggauccucccacaagaaugggcguag

SEQ ID NO: 14930 - RNA, 384 nt, Artificial Sequence
  Description of Artificial Sequence: Synthetic coding sequence
augaagaccggacuguuuuuuuuaugccuucuuggcacugccgcagccauaccuacaaacgcccgccuguugucugaccauaguaagcccaccgccgagaccguagccccagauaacacugcuauuccaagccugcgcgcagaggcugaggagaacgagaaggagaccgcaguuucaaccgaagaugauucccaccacaaagccgaaaaaagcuccguucugaagagcaaagaagaaucgcaugaacaaagugccgagcaggggaagagcucaagccaggaguuaggauugaaggaucaagaagacagcgacggccaccucagcgugaaucuugaauacgccccaacagaaggcacccuggacauuaaggaggauaugaguuag

SEQ ID NO: 14931 - RNA, 285 nt, Artificial Sequence; identical to SEQ ID NO: 13292
  Description of Artificial Sequence: Synthetic coding sequence

SEQ ID NO: 14932 - RNA, 414 nt, Artificial Sequence
  Description of Artificial Sequence: Synthetic coding sequence
auggcugcgcucucaagagcucucggaccccuucggacgccugcuccuccccuguggaucggccucuuucuggucgcaaccggaucccagcagucucuagcacaaccacuccccggaaacacaaccgaagccaccccccgcucguuacgcgccuccggcucucugugcgguccacaugcgaaggcgccuuaccugugugaagccacacacgaacccgccgccgcccgaauucgagcacagguaccagauacucgcuggucucgcguggguggacaaagauuuuacucucgcguucucucuccccugcacagaggucccagcggccauacagaggcaucagcgcagaggucacacaugggcaaauugaaggagccacaaccccaggaucauaaacccggcuuaggagcauccuag

SEQ ID NO: 14933 - RNA, 228 nt, Artificial Sequence; identical to SEQ ID NO: 13294
  Description of Artificial Sequence: Synthetic coding sequence

SEQ ID NO: 14934 - RNA, 1491 nt, Artificial Sequence
  Description of Artificial Sequence: Synthetic coding sequence
auggccccugcuaggacuauggccagagcccgacuggccccggcagauuguuugaauuccuuuaccgcaggugucccuggcuucgucuuagauaccaacgccagcgugucaaacggcgcuacauucuuggaaucccccaccguuagaagaggcugggacugcguaagagccuguugcacaacccagaauugcaaucuugcucucgucgagcuacaacccgauagaggagaggaugccaucgcugccuguuuccugauuaacugucuguacgagcagaauuuuguaugcaaauucgcaccccgagagggcuuuauuaacuaccucaccagagaggucuaccggucuuauagacagcuucgaacacaggguuuuggaggaucuggcauacccaaggcaugggcugggauagaccugaaagugcaaccacaggagccacuuguauugaaggacguugagaacacggacuggcgguuacuucggggagacacagacguaagaguugagcgcaaggacccaaaccaggucgaacuauggggacugaaagagggcacauaccuguuccaacucacagugacuuccagcgaccaccccgaggauaccgccaaugugacaguuacaguucuguccacgaaacagaccgaggauuauugccuggcaucaaacaaggucggcaggugccgcggguccuucccuagaugguacuaugaucccacagagcaaauuugcaaaucauuuguauauggaggcugucucgggaauaaaaauaauuaucuuagagaagaggagugcauucuggcuugucguggcguucaggggggcccccugcgggggagcuccggugcccaggcaacauucccccaaggaccuaguauggaaagaagacaucccgugugcuccggcacaugccaaccaacucaguuccgaugcucuaauggcugcugcauagauaguuuccuagagugcgaugauacacccaacuguccggaugcuucugacgaagcggccugcgaaaaguacaccuccggcuuugaugaacugcagaggauucacuuuccuagcgauaagggucacugcgucgauuugcccgauacaggguuguguaaagagucuaucccuagaugguauuacaauccguucuccgagcauugcgcgagauucacauacgggggcuguuaugggaauaaaaacaacuucgaggaagaacagcaaugccuugaaagcuguagggggauuucuaaaaaagacgucuucggauugcggagagaaaucccgauaccaucaaccggaucagucgaaauggcagucgcaguuuuucugguuaucugcauuguaguaguuguagccauucugggcuacugcuuuuuuaagaaccagagaaaggauuuucacggucaccaucaucauccaccuccaacaccagccagcucaacagucagcacuacagaagauacugagcaccucguuuacaaccauaccacacggccacucuag

SEQ ID NO: 14935 - RNA, 528 nt, Artificial Sequence
  Description of Artificial Sequence: Synthetic coding sequence
augccacccggaacccgcgcaugucgugugcccaggccugguagacgcgcaccucggccuagaagagauggagagccugguggucaugggguggccccugccuccgcugaagaagugggagcgcggccaggucugcgagccguggcccggcugcucccucaacagcaccuccaggcaggauaugugugugaaagaaaagaccuccugguuaaugguugcugcaacguuaacguaccuagcacgaaacaguacuguugugacggaugcuggccaaauggcuguugcuccgccuacgaauacuguguguccuguugucugcagcccaacaaacagcuacuucucgaacgcuuccugaaucgcgccgcuguugccuuucaaaaucuguucauggcagucgaggaccauuucgaacugugcuuagccaaguguagaacauccucacagucgguccagcaugaaaauaccuaccgagauccaauugcgaaguauuguuauggggagucaccaccugagcuuuuuccagcuuag

SEQ ID NO: 14936 - RNA, 1881 nt, Artificial Sequence
  Description of Artificial Sequence: Synthetic coding sequence
auggaccuugugcugaaaagaugccuucuccaucuggcaguuaucggcgcacugcuggcugucggcgccaccaaagugcccagaaaccaggauuggcuaggcguuucuagacaacucaggacaaaagccuggaaccgacagcuguaccccgaguggacggaggcccaaagacuugauuguuggcgcgguggacaaguaagccuuaaggugucuaacgauggccccacucugauaggugcuaaugccucguuuaguaucgcccucaacuuuccaggcucacagaaagugcucccugacggucagguuauauggguuaauaauaccaucauuaauggcgaccagguguggggaggccagcccguauacccacaagaaaccgacgacgcgugcauuuucccagacggcgguccaugcccuaguggauccuggucacagaagcggaguuuugucuacguauggaagaccuggggucaguacuggcagguacucgguggcccugugaguggucuuucuaucggaaccggacgugccaugcugggaacacacaccauggagguaacugucuaucaucgaagagggagccgguccuacgugccucucgcucauucaucaucggcauuuacuauaaccgaucaggucccauucagcguuagcguuucacaguuacgcgcucuugacgguggcaauaagcauuuucugagaaaucagccuuugacguucgcuuugcagcugcaugaccccucaggcuaccucgccgaagcagaucuaaguuauacgugggauuucggagacucauccggcacacucaucucuagagcacuggucguaacccauacauaccuggagccaggucccgucaccgcucaggugguucuucaggcugcuauccccuuaacuucuugcggcuccucuccagugccaggaacuacugauggccacagaccgacugccgaagccccuaauacuacugccggccaaguccccacaacugagguggucgggaccacacccggccaggccccuacugcugagccuuccggaaccaccagcguccaggucccuacgacagagguaaucucaaccgccccugugcagaugccaaccgcggaaucaacugcagcccaaguuacuacaaccgaauggguggagaccacugcucgugagcuucccauuccagagcccgaagguccggaugcuucuuccauaaugucaacagaaucaaucacugguagucuggguccuuuacuggacgguaccgcaacccuucgucugguuaagcgccaggugccacuggacugugugcuuuauagguauggcucguucuccgugacucuggauaucguccagggaauugaauccgcugaaaucuuacaggcagugccaaguggggaaggcgaugcuuucgaacugacagucuccugccaagguggccucccgaaagaagccugcauggaaauuucuucacccggaugccagccgcccgcccagaggcugugucagccagugcucccaucccccgcaugucagcuuguucugcaccaaauacucaaaggcggguccggcacauacugucugaauguaagucuugcagacacuaacucccuugccgucgugucuacucaguuaauaaugcccguacccggcaucuugcugacuggccaagaagcgggacugggccaggucccucuaaucguggggauccuucugguguuaauggcugugguacuggcuagccugauauaucggcggcggcucaugaagcaggacuuuucuguuccucaacugccccacaguaguagccauuggcucagauuaccacgaaucuuuugcuccugcccuauuggcgaaaacagcccauuacuaucuggacaacaaguguag

SEQ ID NO: 14937 - RNA, 1611 nt, Artificial Sequence
  Description of Artificial Sequence: Synthetic coding sequence
augccuacucucugcucuaguuucggucuucaagugcuacuaccggaguaccucagagaacgguucguugcggcugcccuuucguauauaacauguucgagugagggcgaacuuguauguaaagagaacgacugcuggugcaaaugcagccccaccuuccccgagugcaauugccccgaugcagacauacaagcaauggaagauucccuccugcagauccaggauagcugggcgacucacaacaggcaguucgaggaaagcgaggaauuucaggcccuacucaaacgccugccugacgaccgguuucuuaauucaacggcuauuucucaguucugggcuauggauaccucauuacaacacagguaccagcaacuaggagcaggacucaaaguguuauucaaaaaaacccaucggauucugcgccggcucuuuaaucucugcaaaagaugccauagacaaccccgcuuuagguugccuaaagaguccuccccucgaagccucagcuauugguggaacaggauacaaagcuuguuguacugcggcgaaucuacuuuuccuggcacguuucuagaacagucucauuccugcaccuguccuuacgaucagaguucaugucagggccccauaccgugugcucugggugaaggacccgcgugugcccacugugcccccgacaacucuacaagaugcggcucuuguaacccugguuacguccuagcucaaggacuguguagacccgaggucgcagagagucuugagaacuuuuugggccuugaaaccgaccugcaggaccuggaauuaaaauacuugcugcagaaacaagauucacgcauugaaguacacagcauuuucaucucaaaugauaugagauuagguucaugguucgacccaagcuggaggaaaagaauguugcuuacccugaaaucaaauaaguacaaaccagguuuggugcacgugauguuagcucugucccuccagaucugcuugaccaaaaacaguacacucgaaccaguuauggcuaucuacgugaaccccuucggcgggucgcauucugaaaguugguucaugccugugaaugaggguagcuuccccgauugggaacgaacaaaugucgaugccgcugcacaaugucagaacuggacuauuacauuaggcaaccgauggaaaacauuuuuugagaccguccacgucuauuuacgauccagaaucaaaagccucgacgacucuuccaaugagacuaucuauuacgaaccccuugaaaugacagauccuaguaagaaucucggguauaugaaaauuaacacccuccagguguucgguuauucccuuccauuugauccagacgcaauuagagaccugauucuccagcuagauuaccccuauacacaggggucacaggacagcgcgcuacuucaguugauugagcucagggaccguguuaaccagcucaguccgccaggcaaaguuagguuagaccuuuucucaugccuucuaagacaccgccugaagcucgcuaacaacgaagucggacggauccagucuagccuuagggcauucaauagcaaauugccaaauccuguggaguacgaaacugggaaacucugcucauag

SEQ ID NO: 14938 - RNA, 423 nt, Artificial Sequence
  Description of Artificial Sequence: Synthetic coding sequence
augucccagagcauagaaguccucaaucuuaggacccaacgagauuuccaguacgugcuuaagauggaaacccagaugaagggacuaaaagccaaguucagacagaucgaagacgaccgcaagacucucaugaccaaacauuuccaggagcugaaagagaagauggacgaacugcugccccuaauucccgugcuagagcaauauaagacugacgcgaaauuaauuacacaguucaaggaggaaauacggaaucuuuccgcggugcugaccgguauccaagaagagaucggggccuaugacuacgaagaguugcaccagagaguguuaagccuggaaacuagauuacgggauuguaugaagaaacugauugaucuuaaaaaacggaaagaggaagagaagcgccagcagaagggggaggcauag

SEQ ID NO: 14939 - RNA, 1119 nt, Artificial Sequence
  Description of Artificial Sequence: Synthetic coding sequence
auggccuauauugaacagagaagaauuagccaugaaggcucuccuguuaagccaguugccaucagagaauuccagaaaacugaggauaugcgccgguaccuccaucaaaaccgagugcccgccgagcccucuaguuugcucagccuauccgcuucgcauaaccagcuuucucauaccgaccuggagcuacaucaaagacgcgagcagcuagucgaaagaacaaggagggaagcacagcucgcugcauugcaguacgaggaggagaagauucgcacaaagcagauccagcgagacgcuguucuagauuucguuaagcaaaaggcuucccaaucuccacagaagcagcacccuuuguuagacggaguggacggcgaaugcccuuuccccucaagacgcagccaacauaccgaugacagcgcacucuguauguccuuguccggccuaaaccaggucgggugugccgcuacccucccgcacucaucagccuucacaccucucaaaagugacgacaggccaaacgcccuuuugaguucuccugccaccgaaacaguccaccauuccccggccuacucuuucccagccgcuauucaacguaaccagccucagagaccagaaagcuuucuguuucgugccggcguccgugccgagacaaacaagggccaugcaucaccccugccccccagcgcugccccaacuaccgacagcacagacucuauaacaggacagaauuccagacaaagggaggaggaauuagaacucauugaccagcugcgaaaacacaucgaauacaggcugaagguuucccugccuugcgauuuaggugccgcacugaccgacggcgucguuuuaugucaccucgcuaaucacgucagaccucgaucagugccuucuauccacgucccaagccccgccguuccaaagcucacuauggcaaaaugucgacguaauguagagaauuuccuugaggccuguaggaagauuggugugccacaagaacagcucugucugccccugcacauacucgaggaaaaaggacuuucgcagguagcugucacaguccaagcacuucuugaauuagcaccuccuaaacagcaacaacaucaacuaucugcaguguag

SEQ ID NO: 14940 - RNA, 1242 nt, Artificial Sequence
  Description of Artificial Sequence: Synthetic coding sequence
auggagaacauguuacuguggcuuauuuuuuucaccccaggcuggacacucaucgacggcucagagauggaaugggauuuuauguggcaccuacggaagguaccaagaaucguuagugaacguacguuccacuugaccucccccgcauucgaagccgaugcaaagaugauggugaauacugugugcggaauugagugccagaaggagcuuccaacccccucccuuagcgaacucgaagacuacuugucuuaugaaacaguuuuugaaaacggcaccaggacucugacccgggugaaggugcaagaucuggugcucgagccuacacagaacaucacuacuaagggggucucggugcggagaaaaaggcagguguacgggacagacagccgauuuagcauuuuagacaaacgauuuuugacaaauuuuccauucaguaccgccguuaagcugucaaccgggugcagcggaauucucauaagcccacaacacguucugaccgcagcucauugcguccacgaugggaaagacuauguuaagggcucaaagaaguugaggguaggccucuuaaagaugcgcaacaaaucgggaggcaaaaaacggagagguucuaaacgguccaggcgugaggcaagcggaggugaucaaagggaggggacccgagagcaucugcgggagagagccaaagguggacggcgcagaaagaaguccggacgagggcagagaauagcugaggggagaccuaguuuucaguggaccaggguuaagaacacgcacaucccaaaaggcugggcgcgcgguggcaugggcgacgcgacucuagacuaugauuaugcucuguuggaauugaagcgugcccauaaaaaaaaguacauggaguuaggcauaucaccuacgauuaaaaagaugcccggaggaaugauacacuuuagcggguuugacaaugaucgcgcggaucaacuggucuacagguuuugcagcgugagugacgaaucaaaugauuuacuuuaucaguauugcgacgccgaaucugggaguacaggaagcggcguguaucuccgacugaaagaucccgacaaaaagaacuggaaaagaaagaucauugcggucuauucuggccaucaguggguggaugugcacggcguccagaaggacuauaauguggcaguaagaauaacaccccucaaauacgcacagauuugcuuauggauucaugggaaugacgcaaacugcgcuuacggguag

SEQ ID NO: 14941 - RNA, 2541 nt, Artificial Sequence
  Description of Artificial Sequence: Synthetic coding sequence
auguucaaguguuggaguguaguucucgugcuugguuucauauuucuggaaagcgaggggcggcccacaaaagaaggcggcuauggccuuaagucauaccagccuuugaugcgacugaggcacaaagagaagaaccaggaaaguaguagagugaagggguucaugauacaggauggcccguuuggaagcugcgaaaauaaauauugcggacucggccgacauugcgugacaucacgggaaacaggacaagcagagugcgccugcauggaucugugcaaaaggcauuauaagcccgugugcggcagcgauggcgaguuuuaugaaaaucauugugagguucacagagcagcuugucuaaagaaacagaagauaaccaucguucauaaugaagacugcuuuuucaagggggauaagugcaagacuacagaguauucaaaaaugaaaaauauguuacuggaucuucaaaaucaaaaauacauuaugcaggaaaaugaaaaccccaacggcgacgauaucagccgcaaaaaacugcugguggaucagauguucaaguauuuugacgcagauaguaauggccucguugauauuaacgaacucacacaggucauuaagcaggaggaacugggcaaagacuuauuugauugcacucuguacguucuccuuaaguacgaugauuuuaacgccgauaagcaccuagcccuggaagaguuuuaucgggccuuucagguuauacagcuaucacuuccugaggaucagaaauugaguauuacagccgccacaguaggacagucugccguuuuaaguugcgccauucaagguacccuacgaccaccaaucaucuggaagcgaaacaacauuauccuuaacaaccuggaucucgaggauauaaaugacuucggagacgaugggagccucuacauuaccaaaguuacgacaacgcacguugguaauuacaccuguuaugcugacggauaugagcaaguguaucagacccauauuuuccaagucaaugugccacccgugauccgcguuuacccagagucccaggccagggagcccggagugacugccucccuccgcugccacgcagagggaaucccgaaaccucagcucggauggcuaaagaauggcaucgacauaacacccaaacucuccaaacaguugacucuucaggccaauggaagcgaaguccauaucaguaaugugcgguaugaagacacgggugcuuacaccuguauugcuaagaaugaggcaggcguggaugaggauauuucuagucuguuuguggaagacucugcucggaagacauuggcuaauauuuuguggagagaggaggguuuaggcauugguaacauguuuuauguauuuuacgaggacggcauuaaaguuauccaacccauugagugcgaguuucagcgccauaucaagccaagugagaagcugcugggauuccaggacgaggugugcccaaaggccgaaggagaugaagugcagcguugcguuugggccucagcagugaacgucaaagauaaauuuauauauguugcgcagccuaccuuagaucggguacuaaucguugacgugcaaucgcagaagguaguccaggccgucagcacagaccccgugccagugaaauugcauuaugacaagagccaugaucagguauggguccuguccuggggcaccuuagagaaaaccuccccaacacuccaggucauuacucucgcuuccgggaacgugccccaucauaccauucauacccaacccguuggaaaacaguucgacagaguagaugauuucuuuauccccaccacaacucugauuauuacccauaugagauucgguuuuauucuucacaaggacgaggcugcucugcagaaaaucgauuuagagaccaugucuuacaucaagacgauuaaccuuaaagacuacaaaugcgugccccagagccuagcuuauacacaccuuggcggcuauuauuucaucgggugcaagccagauagcacaggugccgucagcccacaggucaugguggacggaguaacugauagcgugaucggcuucaacagcgaugucacgggaaccccauauguguccccagauggacauuacuugguaagcaucaaugacguuaaaggacucguaagggugcaguauaucacaaucagaggagagauucaggaggccuuugacaucuauacuaauuuacauauuuccgaccuggcuuuccaacccucauuuaccgaggcacaucaauauaauauuuaugguucaucaaguacacagaccgacguccuguuugucgagcuguccagcggcaagguuaagaugauaaagucuuugaaggaaccccugaaggcggaagaauggccauggaaucgcaagaaucggcagauccaagacucuggacuguucgggcaauaucuaaugaccccuucaaaagauucuuuauucauacuggauggaagacuuaauaaacuuaauugcgagauaacugaagucgagaaagggaauacugugaucugggugggggacgcguag

SEQ ID NO: 14942 - RNA, 582 nt, Artificial Sequence
  Description of Artificial Sequence: Synthetic coding sequence
auguuaggaguucucgaacugcugcugcucggagcggccuggcuggccggaccugcuaggggacagaaugagacagagccaaucgugcuagaagggaaaugcuuaguggugugugauucuaaccccaccuccgaccccacaggcaccgcccuuggcaucagcguuagaagugguucagccaaaguggcauucuccgcaauucgaucuacaaaucacgagcccagcgaaaugagcaaccgaacaaugaucaucuauuucgaccagguuuuagucaauaucgguaacaauuuugacucggagcgaaguacuuuuauugcgccaaggaaaggcaucuauucauuuaacuuccauguuguaaaaguauauaaucgccagacaauucagguuucccugauguuaaauggauggccugugaucucggccuucgcaggcgaccaagacgugacccgugaagcagcaaguaacgguguguugauacaaauggagaaaggagaccgagcauaucugaaacuggaaagaggcaacuugaugggaggguggaaauacuccaccuuuaguggguuccugguauucccccuauag

SEQ ID NO: 14943 - RNA, 813 nt, Artificial Sequence
  Description of Artificial Sequence: Synthetic coding sequence
augcacggcucauguucauucuuaaugcuucuacucccguuacuccuccuacuggucgccaccaccgguccaguaggggcucugacugaugaagaaaaacggcugaugguugaacugcauaaucucuaccgcgcacaagugucuccaaccgcuucagacaugcugcacaugagaugggacgaagaacuggccgccuucgcaaaggcauacgcaagacaaugcgucuggggacacaauaaagaacgaggcaggagaggcgagaaucuguuugccaucacugacgaaggcauggaugugccccuggcuauggaagaguggcaccacgaaagagaacauuauaauuuaucagcggcuacguguucuccuggucaaauguguggucacuacacccagguuguaugggcuaagacagagcgcaucggguguggaucccauuuuugugaaaagcuucagggagucgaggagaccaauauugaacugcugguguguaacuaugaaccaccaggaaauguaaagggcaagcgucccuaucaggaagguaccccaugcucacaaugcccaagcggcuaucacugcaagaauucacuuugugagccuauuggauccccagaagacgcccaagaccugccuuaccuuguuacugaagccccauccuuucgcgccacugaagccucugacucccguaagaugggagcggaggguccugacaagcccaguguggugucuggacucaauucagguccuggacacgugugggggccccuucucgguuuacuccuccuuccuccacuggugcuagcuggcauauucuag

SEQ ID NO: 14944 - RNA, 702 nt, Artificial Sequence
  Description of Artificial Sequence: Synthetic coding sequence
auggaucaggucuucaugauugacucuaaaugugaguccgguaaaggccguugcagcuuuaacccgaaugucaauacagucagcguuaugaucaacgaagagcucuucaguggaauguauauagacuucaugggcacagacgccgccauuuuucgcagccugacaaaaagaaacgcuguaagaacagaucagcauaauucgaaguggcucuccgagccaauguucguggacgcacacgugauccccgauggaaccgacccuaaugaugcuaaagucuacuucuucuucaaagaaaaauugaccgacaacaauagaagcaccaaacagauccacagcaugauagcuagaaucuguccaaaugauacgggcggacuacgaucacuagugaauaaguggacuacuuuccugaaggcgaggcuugucuguuccgucaccgacgaggacgguccugagacacacuuugaugaacuagaagacguuuuucuccuugaaaccgacaauccgcgcacgacacugguauacggcauuuucaccaccucuucuucuguguuuaagggaagugcugugugcguguaccaucugagcgacauccagacuguguucaacggaccuuucgcccauaaagaaggacccaaucaucaguuaaucucuuaccaaggucgaauucccuaucccaggccugggaccaauacguguguguag

SEQ ID NO: 14945 - RNA, 1368 nt, Artificial Sequence
  Description of Artificial Sequence: Synthetic coding sequence
augcuccauccagaaaccucucccggccgagggcaucuccuggccguucuccuagcacugcugggaacugcaugggcggagguuuggcccccccagcugcaggaacaagcucccauggcuggugcucuuaaucggaaagagaguuuccuccuccucucccuccacaauaggcuuagaucauggguccagccgcccgcagcggacaugagacgucuugauuggagugacucauuagcacagcuggcccaggcccgggcugcccuuugcggaauuccgacucccucccucgccagcggacuuuggagaacgcugcaagugggguggaacaugcaauugcugcccgcgggucuagcauccuucguagaagugguuucucugugguuugccgaaggccaaagauauagucaugccgccggcgagugugccaggaaugcuacaugcacgcauuauacucagcuuguaugggcaacaucuucacagcuggguugcggaagacaucuuugcucugcaggucaagcagcaaucgaagcguucgugugugccuauuccccaagagguaauugggaggugaacggcaaaaccauuguuccauauaagaagggggcauggugcucccuuugcacagcauccgucucuggaugcuuuaaagccugggaucaugccggcggccucugcgaagugccacgcaacccuugccgcaugucuugucagaaucaugguagauugaauauaaguacuugccacugccacuguccuccuggcuacaccgggcguuauugucagguucguugcucacuacagugcguucacgggcgauuucgugaggaggaguguuccugcgugugcgacauuggguauggcggagcacagugcgcaacuaagguucacuuuccuuuucacaccugcgaccugagaaucgauggcgauugcuucaugguaaguagugaagccgacaccuacuaccgggcuagaaugaaaugucaacgcaaaggaggcgugcucgcacagauuaagagucagaaaguacaggacauucuggcuuucuaccuagggagauuggagacaaccaaugaagugaucgacucggacuuugagacaaggaacuuuuggaucggacugacuuauaagacugcgaaagacucguuccggugggcuacaggcgagcaccaagcauuuacaaguuuugcauuuggccagcccgauaaucacggacugguguggcuuagcgcggccauggguuucggaaacugcguggaacuacaagcuucugcugcuuucaauuggaauaaucagcgcuguaaaacgaggaaccgcuauauuugucaauucgcccaagagcauauuucucgcugggggccagggagcuag

SEQ ID NO: 14946 - RNA, 462 nt, Artificial Sequence
  Description of Artificial Sequence: Synthetic coding sequence
auggccagauucuggguaugugucgccggggccggcuuuuuucuggcuuuucugguccuccauucuagauucugcggaaguccagugcugagaaauuuuacuuuugcugucucauggcgcacagaaaaaauacuguacaggcucgacguugguuggccaaaacauccugaauacuuuaccggaacaacuuucugcgucgcgguggacucucuuaauggccugguguauauuggccaaaggggggauaacauaccaaaaauccucguauuuacagaagacggauacuuucuacgugccuggaauuauacuguagacacaccccacgguaucuucgccgcuagcacuuuguacgagcaguccguuuggaucaccgaugugggcucagauuuuaugaucuuaugguugcauggagaaaaugggaccgguccagccaaguuuaacaucccccacagcgugaccuag

SEQ ID NO: 14947 - RNA, 375 nt, Artificial Sequence
  Description of Artificial Sequence: Synthetic coding sequence
auguggcgaugcccccucgggcuuuugcuucuguugccucuggccggccacuuagcacuuggugcucagcaggggagaggucggagagaacuggcuccuggacuccaucugaggggaauacgagaugccggagggagauacugccaggaacaggaccugugcuguagaggaagggcugaugacugugcacugccuuaccuuggagcuaucugcuacugcgaucucuucuguaaccgcacugugucugacuguugccccgacuuuugggauuucugucuugguguuccacccccuuucccuccaauccaagcgccagcccguagaaccgguucuggauccgucacaaagaaucaugccugguggauacagacuuag

SEQ ID NO: 14948 - RNA, 777 nt, Artificial Sequence
  Description of Artificial Sequence: Synthetic coding sequence
augaaaacacucuaucucgcugauacuuucccaacuaacuucagggacagugcgggugccaugaaacaaauaaacgauuacguugcuaagcagacaaaaggaaagauuguagauuuguugaaaaaucuggauaguaacgccguggucauaauggugaauuauaucuucuucaaggccaaaugggaaacaaguuucaaucacaaaggaacccaggagcaggauuucuaugugacaagcgaaacaguugugcgagucccuaugaugucacgugaagaucaauaccacuaccuuuuagacagaaaccugucaugcagagugguuggggugcccuaucaaggcaacgcaacugcacuguuuauucucccgagcgaaggcaagaugcagcagguagagaacggacuaucagagaaaacauugcgcaaauggcugaagauguucaaaaagagacaauuagaacuauaccuaccgaaauuuucaauugaggguuccuaccagcucgagaaaguccucccauccuuaggaaucuccaauguguucaccucccacgccgaucucagcggcauuucgaaucacagcaauauucagguuagcgagaugguccauaaggcugugguagaaguagacgaguccgggacgagagccgcagcugccacuggcacaauauuuacuuuucgcuccgcgcgccuuaauucacagagauuaguuuuuaacagacccuuccuuauguuuauaguggauaauaauauuuuguucuuaggaaaagugaaccggccuuag

SEQ ID NO: 14949 - RNA, 1731 nt, Artificial Sequence
  Description of Artificial Sequence: Synthetic coding sequence
augauuguauucggaugggccgucuuucucgccucaagaucacuuggccagggccuccugcucacucuggaagagcacauagcacacuuccuugguacugguggggcugcaacaacgaugggcaacucauguauuugccgggacgauaguggcaccgaugacaguguggacacccagcagcagcaggcagaaaacagcgccguccccacagccgacacgcggagccagccuagagauccaguucgaccuccuagaagggggagggguccucaugagccccgaaggaagaagcagaaugucgaugguuugguccucgauacuuuggccgugauaagaacacugguggauaacgaucaagagcccccauacucaaugauaacccugcaugagauggccgagacggaugaaggaugguuggaugugguacagagccugauuagaguaauuccacuugaggacccacucggaccggccguaauuacccugcuucuggaugaaugcccauugcccacuaaggaugcccuacagaaacuuacagaaauacucaaccugaacggggagguggccugucaggacaguagccacccugcuaaacacagaaauaccagcgcaguacucggguguuuagcugaaaaacuggcaggucccgcuagcaucggccuucugagcccuggaauccucgaguaccuucuacaaugccuuaaacugcagucucauccuaccgugaugcuuuuugccuuaauagcccuggagaaauucgcccagaccagcgagaacaaauugaccauuucugagucaucuaucagcgaccgucucgugaccuuagagucaugggcaaaugauccagacuaccugaaaagacaggugggcuucugugcacaguggucuuuagauaacuuguucuuaaaagaggggagacaacugacuuacgaaaagguaaaccucucaucgauucgagccaugcugaauuccaaugaugugagcgaguaucuuaagauuucaccacacggccucgaggcucgaugcgaugcauccuccuuugagagcgugaggugcaccuuuuguguggaugcaggcguaugguauuaugaaguuacgguggucacaagugggguuaugcagauagggugggcaacccgcgacagcaaguuucuuaaccacgaaggcuaugguauuggugaugacgaguauagcugugccuacgaugguugcaggcagcuaaucugguauaacgcgagaucaaaaccucauauccaccccuguuggaaggagggcgacacagugggcuuucugcuggaucuaaaugaaaaacaaaugauuuucuuucucaaugguaaucaguuaccacccgaaaagcaagucuucucauccaccguaucaggauuuuucgccgccgcuuccuuuauguccuaccagcaaugugaguuuaacuuuggagcaaaacccuucaaguacccuccuaguaugaaguucuccaccuucaacgauuacgccuuucugaccgcugaggagaagaucauacugccaagacauagaaggcuugcccugcucaaacaagugucaauaagggagaacugcuguaguuuauguugugacgaggucgccgacacacagcugaaaccaugugggcacagugaucucuguauggauugcgcacuucaguuagaaaccugcccccugugucgcaaagaaauaguaucccggauacgccagauaucacacauaucuuag

SEQ ID NO: 14950 - RNA, 1359 nt, Artificial Sequence
  Description of Artificial Sequence: Synthetic coding sequence
auggccgauaugcaccggggcuaugccgacucacccuccaaggcuggcgccgcuccauacguccaggcuuuugacucucuccuugccggccccguugccgaguaucuuaaaaucagcaaggaaauugggggcgacgugcagaaacacgcagagauggugcauacuggguugaagcuugaacgcgcccuccucgucacugcuagccagugccaacagcccgcagagaauaaguugagcgaccuuuuggccccaauuagugaacagauuaaggaagucauaacuuuucgggagaagaaccgggggagcaagcuguucaaccaucuguccgcgguguccgagaguauccaggcacucggaugggucgcaauggcucccaaaccugguccauaugucaaggaaaugaaugaugcugccauguucuacacuaacagggugcuaaaggaauauaaagauguugacaagaagcacgucgacugggucaaagcauaucucucuaucuggacagagcuacaggccuauauaaaggaauuucacacaacaggguuggcauggucaaaaacaggcccaguggccaaagaguuaagcggucugccaaguggccccucagccggauccuguccaccgccuccucccccuugccccccuccaccaccuguaagcacaauuucuuguagcuacgaaucugcaucacgcucaucucucuucgcacaaaucaaccaaggcgaguccaucacucaugcucucaagcacguaucugacgauaugaaaacgcacaagaaccccgcauugaaggcccaauccggaccugugcgcuccggcccaaaaccuuuuagugcaccuaaaccgcagaccucuccuucaccgaaacgagccacaaagaaggaaccugcuguguuggaauuagagggcaaaaaguggcggguagagaaccaagaaaacguuucaaaucuggugauugaggacacagagcuuaaacaggucgcguacaucuacaaaugugugaauacgacucugcaaaucaaaggaaagaucaacagcauuacuguggacaauugcaaaaagcugggcuuggucuuugaugaugucguggguauugucgaaauaauaaauagcaaagacguuaaggugcaggugauggguaaagugccaaccauaucgauuaacaagacagacgguugucaugcuuacuugucgaaaaauucuuuagacugugaaauuguaucagcuaaauccuccgagaugaacgugcugauuccaaccgaggggggugauuuuaacgaguuucccgucccugagcaguucaagacucuguggaauggacaaaagcucguaacuacaguuacggaaauugccggcuag

SEQ ID NO: 14951 - RNA, 1533 nt, Artificial Sequence
  Description of Artificial Sequence: Synthetic coding sequence
auggguagaccgacacaguggccuucccuacuguuacuucuccugcuaccugggcccccuccugucgccgggcuggaggacgcagccuucccucaccucggcgaaucgcuucaaccacugccacgggccuguccauuacguugcagcugcccucguguagacacaguagauugugauggacuggaucugcgcguauuuccugacaacauuacacgcgcugcacagcauuugucuuugcaaaauaaccaacuacaggaauuaccauacaaugaacugucucggcuuagcggacuacgcacccugaacuuacauaauaaucucauuuccucugaaggacucccagaugaagcauuugagucccuuacgcaacuccagcaccugugugucgcucacaauaagcuaucagucgccccccaguucuuacccaggagccugcgcgucgcugaccucgcugcuaaucaggugauggagauuuuccccuugacguucggugaaaaaccagcuuugcgguccguguaccuucauaacaaccagcucuccaaugccggucuucccccagaugccuuucgcgggucagaagcaaucgccacccugucgcuuucaaauaaccaacucucuuaucugccuccuuccuuacccccaucucucgagaggcuccaccugcagaacaaucugauuucuaaagugccacgaggagcguuaucacggcaaacccaacugcgcgaacucuaccuacagcauaaucagcuaaccgauucuggccuagaugcaaccaccuuuaguaaauuacacucguuggaauaccuggaucuaagucacaaucagcugacgacaguuccugcuggucucccccggacgcuugccauccugcacuuaggccgcaaucgcauacgacagguagaagcagcuagacuccacggagcccgcggauugagauaucuccugcugcaacauaaccaguuggggaguaguggacugccagccggugcccucaggccacuucgcggccugcauacgcuucaccuguacggaaauggccuggauagagugccacccgcacucccuagacgccuucgugcccugguccugccucacaaucacguugcagcucugggagcaagggaucuuguggcgacuccuggccugacugagcuaaaucuugccuauaauagacuggccucugcaagaguccaucaccgugcauucaggagauuacgugcuuuacgaucacucgaucuggcagggaaccaauuaaccaggcugccuaugggacugccaacuggucugcggacacugcaacugcagaggaaucagcuacgcauguuagaaccggagccgcuugccggccuggaccaacucagagagcuuucguuggcucauaaucggcugcgcgugggggauauaggccccggaacuuggcaugaacugcaagcucugcaggugcggcaucggcuggugucucauacuguaccuagagcuccacccaguccauguuuacccugucacguacccaauaucuuagucagcugguag

SEQ ID NO: 14952 - RNA, 114 nt, Artificial Sequence; identical to SEQ ID NO: 13313
  Description of Artificial Sequence: Synthetic coding sequence

SEQ ID NO: 14953 - RNA, 1266 nt, Artificial Sequence
  Description of Artificial Sequence: Synthetic coding sequence
augggcaggccgacucaauggcccucucuuuuacuucuguuguuacucccuggccccccaccuguggccggacuugaagacgcugccuucccacacuuaggcgaaucacuacagccccuaccucgagccugcccacuacgauguaguugccccagagucgauacgguugacugcgauggcuuagaccugaggguuuucccugauaauauuacacgagcggcacagcaccuaagccuccaaaacaaucagcugcaggaauuaccauauaacgagcugucccgucugagcggccugagaacucugaaccuccacaacaaucuuauuuccagugaaggccugccagacgaagccuuugagucucuuacacagcuccagcaucugugugucgcccauaacaagaauaaucucaucaguaaggugccaagaggugcccuauccaggcagacgcagcuucgcgagcucuaccuucaacauaaucaacucacugauaguggucuugaugccacaaccuuuucuaaacugcacucacuggaauaucuugauuugucccacaaucagcuuaccacuguccccgccggacuaccaaggacgcuugccauuuugcaucuggggagaaaccgaauuagacaagucgaagcugcucggcuccacggagcaagaggucuacgauaccuuuuacugcagcacaaccagcuaggcuccuccggacugccugcgggcgcucuccguccuuugcgcgguuuacauacgcuacaucuuuacggcaacggccuagaucggguuccaccugcccugccgcguagauugcgcgcccuuguccugccccacaaucauguggcugcgcucggggcccgggaccuagucgcaacccccggacuuaccgagcucaauuuggccuauaacaggcuagcauccgccaggguccaccacagggcauuucggcggcuacgugcucuucgcucucuugaccuggcgggcaaccaacugacuagacugccaauggguuugcccacuggccuccgaaccuuacaguugcagcggaaucagcugcggaugcucgaaccagaacccuuagccgggcuggaucaguugcgggaauuaucacuggcucacaauagauugagaguaggggacauuggacccggcacuuggcaugaauugcaggcacugcaggucagacaucgacucguuucucacacaguaccucgcgcucccccuagcccauguuuacccugucacgugcccaauauccugguuuccugguag

SEQ ID NO: 14954 - RNA, 993 nt, Artificial Sequence
  Description of Artificial Sequence: Synthetic coding sequence
auguccucauggucacgacagcgaccgaaaucaccgggggggauucagccacauguuagucgcacacuauuccuacuucuccuccucgcagcuagcgccugggggguaacucuuuccccaaaagauugucaaguguuucgcagcgaccauggcuccucuauauccugccagccaccugcagagauccccggcuacuuacccgccgauacuguucauuuggcuguggaguuuuuuaaucuuacccacuugccugcaaaucuguuacagggcgccucuaaacugcaggagcuccaccuaagcagcaauggcuuggaaucccuauccccugaauuccuccggccggucccucagcugagagugcuagaucuuacuaggaaugcccucguucucaaagaaaaucagcuggaagugcucgaagucucaugguuacacggacugaaagcccucgggcaccucgaccuaagcggaaaucgucugcgcaagcucccuccugguuuacuugcaaacuuuacucugcugaggacgcuggacuuaggcgagaaccaacuggagacacuccccccugacuugcuacguggaccgcuacaauuggaacgucuacaucuggaggguaacaagcuucagguccucggcaaagaccuucugcuuccucaaccugaucuccgcuacuuauuccuaaauggcaacaagcucgcccgcguggccgcuggcgcauuucaaggacuccggcagcuggacaugcuggacuugaguaacaauagucucgcgaguguaccagaaggacugugggcuucuuugggucagccgaacugggacaugcgugauggcuucgauaucuccggcaauccauggauuugugaccagaaccugagcgaccucuauagauggcugcaggcccagaaagauaagauguucucucagaaugauacacggugcgcaggacccgaagcggucaaaggucagacucucuuggcaguggcuaaaagucaguag

SEQ ID NO: 14955 - RNA, 1815 nt, Artificial Sequence
  Description of Artificial Sequence: Synthetic coding sequence
augaugagggccgugugggaagcacucgccgcccuugccgcgguugcuugccuaguuggcgccgugcgggggggacccggguuaucaauguuugcaggacaagccgcccagcccgacccaugcuccgaugagaacgggcauccacgucgaugcaucccugacuuuguaaaugccgcauucgggaaggaugucagagugucuucuaccugcggacgccccccggccagguauugugugguuuccgaacgaggcgaggaaaggcugagaaguugucaucuuugcaacgcaucagacccaaaaaaggcccaccccccugccuuccucaccgaucuaaauaauccgcauaauuuaaccuguuggcaaucagagaacuaucugcaguuuccucacaaugugacucugaccuuaagccugggcaagaaauucgagguaaccuacgucucacuucaauucuguucaccuagacccgaaucuauggcaauauacaaguccauggauuauggcagaacaugggugcccuuccaguucuacucaacucagugucggaaaauguauaauagaccucacagagccccaauuacuaagcagaaugaacaagaagcagucugcacagacucacacaccgauaugagaccacuuagugggggccuuauagcuuucaguacccucgauggccgaccauccgcacacgacuuugauaacagcccugugcuucaggacugggugacggcaacagacauuagaguggcguuuucccgacuucacacuuuuggggacgagaaugaggacgauuccgaguuagcgagagacucuuacuuuuaugccgugagcgaucugcaaguuggaggaagguguaaauguaacggacacgccgccagaugugugcgggauagggaugauucauuaguaugcgacugccgacacaacaccgccgggccugaaugcgauagaugcaaacccuuccauuaugaucggcccuggcagagagccaccgcaagagaggcaaacgaaugugucgccugcaauugcaacuuacaugccaggagaugucguuuuaacauggaauuguacaaauuaagcgggagaaagagcggaggcgugugccuuaauugucggcacaauacugcuggaagacauugccacuauuguaaagaaggauacuacagggauauggggaaacccaucacacaccggaaagccuguaaggccugugacugccauccugucggggccgccggaaagacaugcaaccagacuacaggacaguguccaugcaaagauggcguuaccggcaucacaugcaacagaugugcaaagggauaccagcagucacgaagucccaucgcccccugcauaaaaaucccagucgcccccccuaccaccgcugcaagcagcguugaagagccugaggacugugauucuuacugcaaagcgagcaaaggcaaauuaaagaucaauaugaagaaguacuguaagaaagauuaugcuguccaaauccacauccugaaggcagacaaggcaggggauugguggaaguuuacaguaaacauuauuuccguauacaaacagggaacaagcaggaucaggcgaggggaccagagucuguggauaaggagucgugauauugcuugcaaaugucccaaaaucaagccucuuaaaaaguauuuacugcugggcaacgccgaggacagcccagaucagagcgguaucguggcagauaaaucaucacucgucauacaguggcgugacaccugggcacgacggcugaggaaauuccagcagagggagaagaaagggaaguguaaaaaagcuuag

SEQ ID NO: 14956 - RNA, 948 nt, Artificial Sequence
  Description of Artificial Sequence: Synthetic coding sequence
auggggcaagaccgagaagaaacaaauauagaacuuuuagugugcaauuacgagcccccaggaaacgugaaagguaaaagacccuaccaagagggaacucccuguucucaaugcccaagcggauaccauuguaaaaauagcuuaugcgagccuaucggcuccccugaggacgcccaggaucugccauaucuugucacagaagccccaucauuuagagcaaccgaggccuccgauucucgcaagaugggaacacccuccuccuuggcaaccggcauuccagcauuucucgucacagagguguccggaucucuugccacuaaagcucugcccgcugucgaaacccaggccccgacguccuuagccaccaaagacccuccauccauggcuaccgaggccccaccauguguaacaaccgagguccccucuauucuggccgcucacucucuaccaucauuagacgaagaaccaguuaccuucccuaagaguacccacgucccuaucccaaaaagcgcagauaaagucacugacaagaccaaggucccguccagguccccugaaaacucgcuggacccgaagauguccuugacuggagcucgcgagcuguugccacacgcgcaggaggaagcugaagcggaggcggagcucccuccaagcagugaggugcucgcaucagucuuuccggcacaggauaagcccggcgaacugcaggcaacgcuagaucauacaggucacacuagcuccaagaguuuaccaaauuucccuaacacuucagcuaccgcaaacgcaacaggcggcagagcccuugcauuacaguccucacuuccuggggcagaagguccagauaaaccuagcgugguaagcggccugaacuccggaccuggacauguuuggggcccacuguugggacuguugcuccuuccuccucucguccucgccggcauauuuuag

SEQ ID NO: 14957 - RNA, 207 nt, Artificial Sequence; identical to SEQ ID NO: 13318
  Description of Artificial Sequence: Synthetic coding sequence

SEQ ID NO: 14958 - RNA, 3369 nt, Artificial Sequence
  Description of Artificial Sequence: Synthetic coding sequence
augagucuacaagagauguuccgcuuucccaugggacugcuccuuggcucaguucugcuggucgccucagcccccgccacccuggaaccacccggauguucuaauaaggaacagcaaguuacugugagucauaccuacaagauagacgugccuaaaucagcccuggugcagguagacgcggauccccagccccuaagcgacgacggcgccuccuuguuggccuugggcgaagcucgcgaagaacagaacauaaucuuuaggcacaacaucagacugcagacuccccagaaagauugcgagcuggcaggcagcgugcaagaccugcucgcuagggugaagaaacuggaggaggaaaugguggagaugaaagagcaauguuccgcccagagauguugucagggugucacggauuugucucgccacugcucaggacaugguacuuuuagcuuggaaacuuguagcugucacugcgaagaaggaagagagggcccagcuugcgagcggcuggccugcccuggggcguguucagggcaugggagguguguggacggccguugucucugucaugaacccuaugugggggcugauuguggauaucccgccuguccagaaaauuguucgggucauggagagugcguaaggggcgugugucagugucacgaagacuuuaugucugaggacuguagcgaaaagagaugccccggcgauuguaguggacacggauucugugacaccggggaaugcuauugugaggaggguuucaccggacuagacugcgcacaaguagugacuccccaggggcuacaacuguugaaaaauaccgaagacucacugcucguuagcugggagccaagcucacagguugaccacuaucucuuaucuuauuacccccugggaaaggaguuguccgggaagcaaauccaagugccaaaagaacagcauuccuacgagauacugggacuccucccaggcaccaaauacauugucacguugcgaaaugucaagaacgaagugagcucuagcccccagcacuugcuugccacaacagauuuggccguguuggguacagccugggucacggacgaaaccgagaauucccuggauguggagugggaaaacccaaguaccgaggucgacuacuacaaacugcgcuauggcccaaugaccggucaggagguugcugaggucacuguuccgaagucuuccgauccuaaguccagguaugauauaacaggucugcaccccggaacugaauauaagaucaccguugugccaaugaggggagagcuugagggcaagcccauacuccugaaugggaggacagaaauagauagcccgaccaauguugugacugaccgcgucaccgaggauacagcuacagucucuugggacccagugcaggcagugaucgacaaguaugugguaagauacacuucagcugacggagauacaaaggaaauggccgugcacaaggaugagucaaguaccgugcuaacgggacuuaaaccaggcgaagcuuauaagguuuacgugugggcagagaggggaaaccaaggcucaaagaaagcugacaccaacgcacuuacugaaauagacucccccgccaaucuggugaccgaucggguaacugaaaacacugccacaaucucuugggauccuguacaagcuaccaucgacagauacguggugagauauacuuccgcuaaagacggagagacccgugaggugcccguggggaaagaacaguccagcacugucuugaccggccugagacccggaguagaauauacaguccauguaugggcacaaaaaggcgcucaggaaaguaagaaggccgauacgaaagcacagacugauauugacucaccucaaaaucucgugacugauugggucacagagaacacugcaacggucaguugggauccugugcaggcuaccaucgaucgauauguaguccauuauacaucugccaauggagagacacgcgaaguacccgucgggaaggaacaaagcagcacaguacuuacagggcuuagaccggggauggaguacacaguccaugucugggcacaaaaaggaaaucaggaaaguaaaaaagcugacaccaaagcucagaccgagaucgaugguccaaaaaaucuugucacagauugggucacugagaacauggcaacuguauccugggaccccguucaggccacaauagacaaauacauggugagauauaccucagcugacggugagacaagagaagugcccgugggcaaagagcacucuucuacaguucuuaccggccuuagaccagggauggaauacauggugcacguuugggcgcaaaaaggagcacaggagaguaagaaagcagacacgaaagcccaaacggagcucgaccccccgaggaaucuccggccuucugcagugacucagaguggaggaauacugacauggacgccuccauccgcccaaauccauggcuacauccuuacauaccaauuuccagacggaacagugaaagaaaugcaacuuggcagagaagaccagcgguucgcccugcaaggcuuggagcagggggcaaccuauccuguuagccugguggcguuuaagggcgggcgucguucacguaacgugucaacaacccuuuccacaguuggcgcucgcuucccccauccaucggacugcucgcaaguucaacagaauucuaacgccgccucaggguuauauaccauauaucuucacggugaugcauccaggccguuacaagucuacugcgauauggaaacugacggaggugguuggauugucuuucagagacgaaauacuggccagcucgacuucuucaagcguuggaggaguuauguggagggguucggcgaucccaugaaagaauuuuggcuuggacuugacaaacuccauaaucugaccacuggaaccccggccagauacgaggugagagucgaccugcagacagccaaugaaagugcuuacgccauauaugauuuuuuccaagucgccucaaguaaagagagauauaaauugacagucggaaaguaucgagggaccgcuggcgaugccuugacuuaccauaauggguggaaguuuacuacauuugaccgcgauaacgacauagcccugucgaauugcgcauuaacacaucacggaggauggugguauaaaaauugucaccuggcaaaccccaacggaagauauggggaaaccaaacacucugaaggcgugaacugggaaccuuggaaggggcacgaauuuuccauaccguacguggagcucaagauuagaccucacggcuacagccgggagccuguguugggucggaaaaagagaacauugagggguagauugcguacauuuuag

SEQ ID NO: 14959 - RNA, 897 nt, Artificial Sequence
  Description of Artificial Sequence: Synthetic coding sequence
augcugcauccugagacaucgcccggucgcggucaucuucuggcuguccuucuagcacugcuuggcaccgcaugggcggagguguggccuccucagcugcaagaacaagcucccauggcgggagcccuuaaucgaaaagaaaguuuccuguugcuaucauuacauaaucguuuaaggaguuggguucagccaccugcugcagauaugaggcgccucgauuggagcgauucauugaacuggcugaagccuggcccguuauggaauccuaaccccgagccuggggugaggccuguugcacauccugcuucuggacuggagcacgccgccugcccaagagccuggcgaccguuauugaaguggagccugugguucgccgaaggucaaagauauagccacgccgccggagaaugcgcucguaacgccacuuguacucauuacacacaacuggugugggcuacuucuucccaguuaggcugugguaggcaccucugcucagccgggcaggccgcaauagaggccuuugugugugcauacuccccuagagguaacugggaaguuaauggaaagacaauuguuccuuauaagaaaggagccuggugcagucucuguacugcaucaguuaguggcugcuuuaaggcuugggaucacgcgggcgggcuaugcgaagugccaaggaacccgugccguaugagcugccagaaccauggacgucuuaauauuagcaccugucacugccacuguccuccggguuauacugggcgguacugucaaguucgguguucucugcaaugcgugcacggcagguuccgcgaggaagaauguucaugcgucugugacauuggauacgagccauccguucccccgagauguauuuuuccaucuacucccgucacauag

SEQ ID NO: 14960 - RNA, 1728 nt, Artificial Sequence
  Description of Artificial Sequence: Synthetic coding sequence
auggacuugguccuaaaaagaugcuugcugcaccucgcaguuaucggggcucugcuggcaguuggagcaacaaagggaagucaggugugggguggccagccuguguacccccaagaaacagacgaugcauguaucuucccagauggcggccccugcccuucuggcagcuggucacagaagcgcuccuuugucuacguauggaagacuuggggacaauacuggcagguacucggugggcccguuagcggccuguccauaggaaccggacgugcuaugcuggggacacacacgauggaagucaccguuuaucaccgccggggcucaagaucuuacgucccccuggcacacagcuccucugcauucacuauuaccgaucaggucccauucaguguuucugugucacaguuacgggcuuuagauggaggcaauaaacacuuuuuacggaaucagccgcuuaccuucgccuugcaguuacaugaucccuccggauaucucgccgaggcagaccucucauacacuugggacuuuggugauucuucuggcacccucauuucccgcgcgcugguggugacucacacauaccucgagccgggcccaguuacggcucaggucgugcuccaggcugccauaccccuaacaaguugugggagcuccccugugccagguaccacugauggccaccguccuaccgccgaggcacccaacacuacggccgggcaggugccaacaaccgaggucgugggaaccaccccgggucaggcaccuacagcugaaccuaguggaaccaccaguguccaggucccaacaacagagguaauuucaaccgcccccgugcagaugcccaccgcagaaucaaccggcaugaccccagagaaagugccuguaagugaagucaugggcacaacauuagcagagaugucaaccccagaagcgaccggcaugacgcccgcugaaguuaguauugucguucugucagggacuacagcagcccagguuacaacaacugaguggguagaaaccacagcacgugagcucccaauccccgagccagagggccccgacgccucuucaaucauguccaccgaaaguaucacugggucccucgggcccuugcuggacggcaccgccacccucagacugguuaagcgccaagugccccuagacugugugcuuuauagguacggaagcuuuagugucacccucgauauuguacaggggauugagucagccgagauccuccaggccgucccaucaggcgagggagaugcguucgaacuaaccguuuccugucaaggcggacucccaaaagaggcuugcauggagaucagcucaccuggcugccaaccgccagcccagcgucugugucagcccguccucccuucuccggccugucagcuugugcuucaucagauucucaaggguggaucuggaaccuacugccucaacgucucucuugccgauacaaacucucuugccguugugaguacucaacuuauuaugccagggcaggaagccggcuuaggccaggucccccuaaucguaggcauacugcucguacuuauggccgucguucuggccucccugaucuaucggagacgccuuaugaagcaagacuuuuccguuccacaguugccccauucaagcucccacuggcuccgccuuccccgaaucuucuguucguguccgaucggugagaacucuccucugcucagcggucagcaagucuag

SEQ ID NO: 14961 - RNA, 330 nt, Artificial Sequence
  Description of Artificial Sequence: Synthetic coding sequence
uagucaggacagucucugaaaagccucaaugccuccaguggucaccucgcacugauccuauccaguauauuuggccuguuacuucuaguccuuuucaucuuauuuuugaccugguguaggguccagaagcagaaacaccucccccugaggguguccacuagaagacguggcagucuggaagagaaccucuuucacgagauggagaccugccuaaaacgagaggacccacacggaacgagaacaagcgaugacacccccaaucacggcugugaagaugccucagauacaucccuucuggggguauuacccgccuccgaagccacuaaguag

SEQ ID NO: 14962 - RNA, 312 nt, Artificial Sequence
  Description of Artificial Sequence: Synthetic coding sequence
augucaggaaggggcaaaggagggaaaggccugggaaaaggcggagcuaaacgacacagaaaagugcuucgggacaacauucagggcaucacgaagccugcuauccggagacuugcuagaagaggcggagugaaaagaaucuccggccuuauuuacgaagagacaagaggggugcugaaaguuuuucuggagaacgugauucgcgacgcagugacguacacugagcacgcaaaacguaaaaccgugacggccauggacgugguuuacgcuuuaaaaagacaggguaggacacucuacgguuucggcggauag

SEQ ID NO: 14963 - RNA, 2889 nt, Artificial Sequence
  Description of Artificial Sequence: Synthetic coding sequence
auguugcgaagaccugcccccgcucucgccccugccgcccguuuacuucuugccggccuguugugcggcggaggaguuugggccgcccgagucaacaaacacaaaccauggcuggagcccaccuaccacgguaucgucaccgagaaugacaauaccgugcugcucgaucccccuuugauugcccuggacaaggaugccccgcucagauuugccgagaguuuugaagucacagugaccaaggaaggugaaaucugcggguuuaaaauacacggacaaaaugugccuuuugacgcugugguaguggauaagagcaccggagagggugucauuagauccaaggagaaguuggacugcgaacugcagaaggacuacagcuucacuauacaagccuacgacugcgggaagggcccagacgguaccaauguaaagaagucccauaaagccacaguccacauucagguaaaugacguaaacgaauaugccccuguuuuuaaggagaaaucauacaaagcuacaguuaucgaaggaaagcaauacgauucaauccugcggguggaagccgucgacgccgauuguucaccacaguuuucucagauuuguucuuacgaaaucaucacccccgacguccccuuuaccgucgacaaagauggauacauuaaaaacaccgaaaaauugaacuaugguaaagaacaucaguacaaauuaacaguaacugcuuaugauugugguaagaagcgcgcuaccgaagacguccuggucaaaaucucuaucaagcccacuugcacgccuggauggcagggcuggaauaaucgcaucgaguaugagcccggcaccggcgccuuggccguguuuccuaacauucaccucgaaacaugugaugaaccuguggccucugugcaggcgaccguggaauuggagaccucccacauuggaaagggcugcgaccgggauaccuauagugaaaaaagccuucacagacuuuguggcgcugccgccggcacugccgagcucuugccuucccccagugguucccugaauuggacaaugggccugcccacggauaauggacacgauucggaucagguguucgaguuuaacggcacccaggcaguaagaauccccgauggaguagucaguguuuccccaaaagaaccuuucacaauuuccguuuggaugcgucacgggccguucgggcgcaaaaaggaaaccauccugugcagcagugauaagaccgacaugaauaggcaucauuacucacuuuacguccacggcugccgacucauuuuuuuauuucgacaggacccuucugaggaaaagaaauacagacccgccgaguuucacuggaagcugaaccaggucugcgacgaagaauggcaccacuacgucuugaauguugaauucccauccgucaccuuauacguugacgguacuucucaugagcccuuuuccguuaccgaggacuauccccugcacccuagcaagaucgaaacgcaguuagugguuggggcaugcuggcagggaggugacuuacacaugacacaauucuuccgggggaaucuggcgggccugacccugaggaguggcaaacuagcagacaagaaggucaucgauugccucuauacuuguaaagaaggccuagaucuucaagugcuugaagauucaggaaggggugugcagauucaggcccacccaucucaacuugucuugacucucgagggggaagauuugggugaauuggacaaagcaaugcaacacaucucguauuugaacagcagacaauuuccuacaccaggaauucggcgguugaagauuaccuccacaauuaagugcuuuaacgaagcuacaugcauuagugugccucccgucgauggcuaugugaugguguugcagccggaggagccaaaaaucucucuuaguggaguccaccacuuugccagagccgcgucugaguucgaaucgucugaaggcguguuuuuguucccagaacugcguaucaucagcacaauaacccgcgagguugaaccagagggggacggggccgaagauccuacaguccaagaaucccuagugucagaagaaaucguucaugaucuggauacaugcgaaguuaccguggaaggcgaagaacucaaucaugaacaagagagucuugagguagauauggcgagacuacaacaaaaggguauagaagucaguuccuccgaauugggcaugacauucacaggggucgacacaauggcuucauacgaggaagucuuacaucugcugcgguauagaaacuggcaugcuagaagccugcucgaccgaaaauucaagcuuaucuguagcgaacucaauggccgguacauaucaaacgaauucaagguugagguuaaugucauacauacugcuaaucccauggagcaugccaaccacauggccgcucagccucaguucguccacccggaacauagauccuucgucgaccugucugggcacaacuuagccaacccgcacccauuugcagucgucccuucuacagcaacuguugucauagugguaugugugagcuuuuugguauuuaugauuauacucggagucuuucggauuagagccgcccacaggcgcacgaugcgcgaucaggauacaggaaaggaaaaugagauggacugggacgauucagcccugacgaucacaguuaacccuauggagacuuaugaggaucagcauagcagcgaggaagaagaagaggaggaagaagaagaggaaagugaggacggagaggaggaggacgauaucaccucugcugagagugagucuagcgaggaagaagagggggagcaaggugacccacagaaugccacaagacaacaacaacuggaaugggaugauagcacauuaucauacuag

SEQ ID NO: 14964 - RNA, 912 nt, Artificial Sequence
  Description of Artificial Sequence: Synthetic coding sequence
auguugcaccccgaaaccuccccuggucgcggacaucuacucgcugugcuguuggcucugcuggggacugccugggccgaaguguggccaccccaacugcaggagcaggcaccaauggcgggcgcccuaaaucguaaagaguccuuccuacuacuaucccuccacaaccggcuccgaaguuggguucagccuccagcugcagauaugagacgacucgacuggagugacucgcuggcucagcuggcgcaggcuagggcugcauuguguggcacgccaaccccgucucucgcuagcgggcuguggagaacccugcaggugggcuggaacaugcaacuucugcccgcgggcuugguuucauuuguggagguggugagccugugguucgccgagggucaacgauauucacaugcugcaggugagugcgcaagaaacgccacguguacccacuauacucagcucgucugggcuaccucuucucaacuggguuguggacgacaucuguguucagcgggccaagcugcgaucgaggcauuugugugugcuuauucccccagaggcaauugggagguuaauggaaagacaauaguucccuacaagaagggagcauggugcagccuguguacugccuccguuucuggaugcuuuaaggcgugggaucaugcagggggccugugcgaagucccaagaaauccaugccggaugaguugucagaaucauggccgacugaacauuucuacaugccauugccauugucccccuggcuauacaggacgguauugccaaguacguuguagucugcagugcgugcacggacgguucagggaagaagaguguuccugcgugugcgacaucggcuacggugaaccuucagugccaccucgaugcauauucccuuccaccccagugacuuag

SEQ ID NO: 14965 - RNA, 1356 nt, Artificial Sequence
  Description of Artificial Sequence: Synthetic coding sequence
auggaagcuacuggcacugacgagguugacaagcuuaagaccaaauuuauuuccgcauggaauaauaugaaauacagcugggugcucaaaacaaagaccuacuucucaagaaacuccccagugcuguuacuaggaaaauguuaccauuuuaaauaugaagaugaagauaagacacuuccagccgaaaguggcugcaccauagaagaucacguuauagcugggaauguggaagaguucagaaaggauuuuauuuccaggauuugguugaccuacagggaggaguuuccacaaaucgaaggcucagcccugacuacugacuguggcuggggcugcacccucagaaccggacagaugcugcucgcgcaaggucuuauccuucacuuccugggcagggcauggacauggccagacgcccucaauauugaaaacagcgacuccgaaucuuggacaucacacaccgucaagaaguucacagcaaguuuugaggcuagcuugucaggggagagagaauuuaaaacuccaacaauaucccugaaagaaacgaucggcaaguacagugacgaucacgaaaugcgaaaugagguuuaucaucggaaaauuaucucaugguuuggcgacuccccacuugcgcuguucggacugcaccaauuaauugaauauggaaaaaagagcggcaagaaggccggugacugguauggcccugcgguggucgcccacauccucagaaaagccgucgaagaagcuagacaccccgauuuacagggaauuaccaucuaugucgcccaggacuguaccguguacaauucugacguuaucgacaaacaguccgcaagcaugacuagugacaacgccgacgacaaggccguuauuauccuggugccuguacgccugggaggugagaggacaaacacugauuaccuggaauucgugaaagggauuuugaguuuggaauauuguguuggcauaauuggcggcaaaccaaaacaaagcuacuacuuugccgguuuucaagacgacuccuugauauacauggauccccacuauugucagaguuuugucgacguuuccaucaaagacuucccucuggagaccuuccacuguccuuccccaaaaaagaugagcuuccggaaaauggauccaaguuguaccaucggguuuuacuguagaaauguucaagacuucaaacgagcuagcgaggaaauuacuaaaaugcucaaguucaguucuaaagaaaaauauccgcuguucaccuucgucaacgggcacucacgggacuacgacuucacaaguacaacuaccaacgaggaagacuuauuuuccgaagacgaaaaaaagcagaaaaaaaaaaaaaaauag

SEQ ID NO: 14966 - RNA, 1557 nt, Artificial Sequence
  Description of Artificial Sequence: Synthetic coding sequence
augagaaccugggacuacagauggucuuuagcucugguggcacagacaggcgugcauuguugcaaucucucuagcuugcagccccuuccuccccgguuuaagcgcuucaguugucucucucuuuccaguggcugggacuacuccaauucagggaacaugaaaccaccccuuuuaguauucauuguaugcuugcucuggcugaaagauagccacugcgccccgacauggaaggauaaaacagcaauuucagagaaccucaagucuuucagugaagugggagagaucgacgcagacgaagagguuaagaaggcccugacagggaucaagcagaugaaaaucaugauggaacgaaaagaaaaagaacacacaaauuugaugagcacccuaaaaaaaugcagagaggagaaacaagaggccuuaaaacugcucaacgagguacaggagcauuuggaagaagaggagagacuuugcagagaaucucuggccgacuccuggggagaauguagguccuguuuagagaauaacuguaugcgaauauacaccacaugccagccuucuuggucaagcgucaagaacaagauugagcgguucuuccgaaagauuuaucaguuucucuuuccuuuucacgaagacaacgaaaaagaccugcccauuucagagaaauuaauugaagaagacgcccagcuaacacaaauggaagacguguucucccaacugacaguagaugugaacucacuguucaauagaucuuuuaauguauuuaggcagaugcagcaagaauucgaucagacuuuucagucacauuucauuagugacaccgaccucacagagcccuacuucuuuccagccuuuagcaaagaacccaugaccaaagccgaccucgagcagugcugggacaucccaaacuuuuuccaacuuuucugcaauuuuuccguuucuauuuaugaaucugucuccgaaacuaucacuaagaugcugaaagccaucgaggaucucccuaagcaagacaaagcacccgaccauggcggguuaauauccaaaaugcugcccggacaggauaggggacugugcggagaguuagaccagaacuuauccagaugcuuuaaauuccacgagaagugucagaaaugccaggcccaccucucagaggauugucccgaugugcccgcacuucauacugaguuggacgaagcgaucagguuggucaaugugucgaaccagcaauauggccagauucugcaaaugacccgcaagcacuuagaggauaccgcauauuuaguagagaagaugcggggccaauucggauggguaucugagcucgcuaaccaagcacccgaaacugagauuauuuucaauagcauccagguggugccacgaauccacgaaggcaauauuaguaagcaggacgaaaccaugaugacugaucucucuauacugcccuccucaaauuuuacauugaaaauucccuuagaggaaucagccgagucauccaacuucauuggcuacgucgucgcaaaagcccuucagcacuucaaagagcauuucaaaaccugguag

SEQ ID NO: 14967 - RNA, 1716 nt, Artificial Sequence
  Description of Artificial Sequence: Synthetic coding sequence
guugagaugagaaaguggagcuccgaaccaggaccugaaccggacacaguagaagccguuaucgaguauauguauaccggccggauccggguguccaccgguucagugcacgaaguucucgaacuggccgaucgcuuccuccugauuaggcuaaaggaguucugcggagaguuuuuaaaaaaaaaacugcaucugaguaauugcguugcuauucauucauuagcccacauguacacccugucacagcuagcacucaaggcagccgauaugauucgccggaauuuccauaaagucauucaagaugaagaauucuacacacucccuuuucaccucauuagggacuggcuuagcgaucuggagauuacuguggauuccgaggagguguuauuugagacagugcugaaauggguccagagaaacgcugaggaaagagaaagguauuucgaggaacucuuuaaacuucugagacugucccaaaugaaacccaccuaucugacgcggcauguuaaacccgagcgacugguggcuaauaaugaagucugcguuaaacucguggccgaugccguggagcgacaugccuuacgggccgagaauauccagucaggaaccugccaacacccuacaucacaugugucccuacucccaagauaugggcagaacauggaugugauuauggugaucgggggcguaagugaagggggcgacuacuugagcgaaugcgucgguuacuucgucgacgaggaccgaugggucaaccugccacacauccauaaucaucuggacgggcaugccguugcugucacugaauccuauguauauguugcaggcagcauggagccaggauuugcaaaaacuguagagagguauaaccccaaucuaaauaccugggaacacguuugcucucugaugacccguaagcauucuuucggucuuacugaaguaaaagguaaacuguauucgauuggcggacacggcaacuuuucucccggcuuuaaagauguuaccgucuacaauccagagcucgauaaguggcacaaucuggagucugcacccaagauucugcgagauguaaaagcccucgcgauugaagaucgcuuuguuuauauugcugcacgaacaccaguggaucgagauacugaagauggucugaaagcagugaucacaugcuacgacaccgagacacgacaguggcaggauguggagucccuuccccuuaucgacaauuacuguuucuuucagauguccguggucaauagcaauuuuuaccagacugcuagcuguugcccuaaaucauauugccuagagaaugaggaagcgguccgcaaaaucgccucgcaagugucugacgagauccuggaaaguuugccuccagaaguccugaguauugaaggagccgcaauuugcuacuauaaagacgacguuuuuaucaucggaggguggaaaaauuccgacgacauagauaaacaguacagaaaagaagccuacagauauugcgcugagcggaaaagauggaugcuguuaccuccaaugccgcagccccgguguagagccaccgcuugccacguccgaauacccuaccguuaccuccauggaacacaaagauauccuaugccucaaaaccucauguggcagaaagacaggauccggcagaugcaggaaauucacaggcacgcccucaacaugcgacgcguuccauccagucagauagaguguuag

SEQ ID NO: 14968 - RNA, 729 nt, Artificial Sequence
  Description of Artificial Sequence: Synthetic coding sequence
auguuaaaaaagaucucugucggaguggccggagaccucaacacugugaccaugaaacugggaugcguacuuauggcuugggcucucuaucucagucugggaguccugugggucgcccaaaugcuccuggccgccgggugucacgcagagcuguuuccugcgccuauucugagggcagucccuagcgcagaaccucaggcuggaucacccaugaccuugagcugucagaccaaauugccuuugcagcgguccgccgcacggcucuuauucaguuuuuauaaggauggaagaauugugcagucaagagggcuguccucagaauuccagauucccacagccuccgaggaccacaguggaaguuacuggugcgaagcagcgacagaagauaaucaggucuggaagcagucaccgcagcuugagauucgugugcagggagcaaguagcucagcggcaccaccaacauugaacccagccccacagaagucagccgcccccggaacugcacccgaagaagcacccggcccucuccccccuccccccaccccaaguuccgaagauccuggauucaguagcccacuugggaugcccgacccacaccuguaccaccaaaugggucuccuucugaaacacaugcaggaugugcgagugcuuuuaggacaucuucucauggaacuuagagaacucuccggccaccggaaaccgggaacgaccaaggcaaccgcagaguag

SEQ ID NO: 14969 - RNA, 1392 nt, Artificial Sequence
  Description of Artificial Sequence: Synthetic coding sequence
auguaugugucgaccagggagagauacaaguggcugagauuuagugaggauuguuuguaccugaauguguacgcaccugccagagcaccaggcgauccccaguuaccuguuauggugugguuccccggaggcgcuuuuauagugggggcugcuaguucuuacgagggcucugaccuagcagcaagagaaaaaguuguucugguguuccuccaacacagacugggaauuuuuggcuuucucagcaccgaugacucucaugcaagaggcaacuggggccugcuggaccagauggcugcccugcggugggugcaggagaauaucgccgcauuuggaggugauccagggaacgugacacuguuuggccaguccgcaggugcuaugucaauuucaggacuuaugaugagcccgcuugcaucugggcuguuccaucgugcgaucucccaaucaggaaccgcauuauucaggcucuuuauaaccaguaacccgcuaaaaguggcaaagaaagucgcgcaccuggcuggaugcaaucauaauucuacacagauccuagucaacuguuugcgcgcucugucugggaccaagguuaugagggugagcaacaagaugcgauucuuacaauugaacuuucagcgcgauccugaggaaaucaucugguccaugucuccagucguugacggcguggugauccccgaugauccgcuugugcuacugacacaggguaaagucucuaguguccccuacuugcuggggguuaacaaccuggaauuuaauuggcuccucccauacauaaugaaauucccucuaaaucgacaggcuaugagaaaagaaacuaucacaaaaaugcugugguccacccgcacacuacugaacauaacaaaggaacaagugccucuggugguggaagaauaccuggacaaugugaacgaacacgauuggaagaugcuccgcaaucgaaugauggauauuguucaagacgcuacuuuugucuacgccacccugcaaacagcucacuaccaucgugaugccggccucccaguuuaucuguaugaauuugagcaccacgcccguggaauaauugugaagccccggaccgacggugccgaccacggagaugaaauguacuuccuuuucggaggcccuuuugccacuggucugucgaugggcaaagagaaggcccucucccuacagaugaugaaauacugggcuaacuuugcacgcaccggaaauccaaacgacgguaaucucccauguuggccaagguauaacaaagaugaaaaguaucugcagcucgauuucacaacacgcgugggaaugaaguugaaagaaaagaaaauggccuuuuggaugucccuauaccagucccaaagacccgagaagcagcgacaguuuuag

SEQ ID NO: 14970 - RNA, 1215 nt, Artificial Sequence
  Description of Artificial Sequence: Synthetic coding sequence
auguuuuaucaugcauacgauucuuauuuggaaaaugcuuuucccuuugaugaacugaggccauugaccugugacggccacgacaccuggggcagcuuuucacucacacucaucgaugcacuugauacccugcucauucuggguaaugucucugaauuccagcgcgugguugagguauugcaggauuccguggacuuugacauugacgucaacgcuucuguauuugaaaccaacauccgagucgucgggggucuguuaagcgcucaucucuuaagcaagaaggcugggguggagguggaagccggauggcccugcagcggaccccucuuaagaauggcagaagaagccgcgcgaaagcucuugccugcguuucaaacuccuacgggaaugccuuacggcacugugaaccugcuucacggcguuaauccuggcgagacucccguaacuuguacugccggcaucgggaccuucauuguugaguuugcuacccuaucuucacucacaggggauccagucuuugaagauguggccagaguugcccucaugcgccugugggaaagccggagugauaucggguuggugggaaaucauauagacgugcugacuggcaaaugggucgcacaggaugcagguaucggggccggagucgacagcuacuucgaguaucugguuaaaggcgcuauuuugcugcaggauaaaaagcugauggccauguuccuggaauauaauaaggcuauuagaaacuauacccgauucgaugacugguaccuuugggugcagauguacaaaggaacugugagcaugcccguauuccaaucccuugaggcuuacuggccaggcuugcaaucauugauuggcgacauugauaaugcaaugcggaccuuccuaaauuacuauacuguguggaagcaauucggugggcugcccgaauuuuacaacauuccucaggguuauacgguugaaaaaagggagggcuauccacugcgcccggaauuaauugaaucagccauguaccuguaucgcgcuaccggagaccccacccugcuggaacuuggacgugacgccgucgaaaguaucgaaaaaauaagcaaaguggaaugugguuucgccaccgugucugucuguauggccccaaggacagggaagucccuaccauugcuguuaaaaucgcuuuucaagggucgagcuuuagguguucugaccuaccaacacuag

SEQ ID NO: 14971 - RNA, 1281 nt, Artificial Sequence
  Description of Artificial Sequence: Synthetic coding sequence
augggauggaccgacacacuugaaucugcggaagacauauuuuggaaacaggcagauuuuggcuaugcaagggaacgucucgaagaaaugcauguacucugucagccaaaagagaccucagacagcagcuuagucuguagucgguaccuucaguacugucgagcaacaaaccucuaucuugaucugagaaacauuaaacgaaaucacgaucgcuuuaaagaggacuuuuuccagagcggcgaaaucggaggccacuguaaacucgacauuaggacauugacgucagaaggccagaggaagucuccuuugcagagcugguuugcugaauugcaaucuuauacucaguugaacuucagaccuaucgaagacgccaaaugcgauauagucaucgagaagccaacauacuuuaugaaacuggaugcuggcguaaacauguaccaucauuucugcgauuuuauuaaccucuacaucacccagcacgugaauaacucauuuaguacagauguuuacauugucaugugggacacuagcucguacggauacggagaccuguucagcgauacauggaaugccuucaccgauuacgacguuauucaucugaaaaccuaugauaguaaaagaguuugcuuuaaggaagcuguguucucccucuugccuaggaugcgguacggucucuuuuauaauaccccucugauaagcggcugucaaaauacuggacucuuucgggccuucgcccagcauguguugcaucgacucaacauuacgcaggaaggaccaaaagacggcaagauacgcgugaccauacuggcccguucuacugaauaucgcaaaauccucaaucagaaugagcuggugaacgcccugaaaaccguaucaacauuugaagugcagauugucgacuacaaguaccgugaacugggcuuucucgaccagcugcggaucacccacaauacagacaucuucauuggaaugcacggagcaggacucacccaucuccucuuucugccugacugggccgccguguuugaacucuauaauugcgaggacgagcgcugcuaccucgaccuggccaggcuccgcggagugcacuauauuacguggaggaggcaaaauaaagucuucccucaagacaaaggacaccauccuaccuuaggcgaacacccaaaauuuacaaacuacucuuuugauguugaagaauucauguauuuaguacugcaggccgccgaccacguuuuacaacacccuaaauggcccuuuaaaaagaaacacgaugagcuguag

SEQ ID NO: 14972 - RNA, 1098 nt, Artificial Sequence
  Description of Artificial Sequence: Synthetic coding sequence
augaaacugggaugcguguuaauggcaugggcacucuaccuguccuugggcguucucuggguggcacagaugcugcuuguggccucuaguuuuagugcagccucuuuugagacccuccagugugaaggccccguguguacugaggagucuaguugucacaccgaggaugaucugacugaugcuagagaagcaggauuucaggugaaggcuuauacauucucagaaccuuuccauuugauagucucuuacgauugguugauauugcaaggcccugcgaagccaguuuuugagggggaccuguuaguccucagaugccaggcguggcaagacuggccacucacacaagucacguucuacagggauggauccgcacuggggcccccaggucccaauagggaauuuagcauaacagucguucagaaagcggacucuggacacuaucacuguagcgguaucuuucagucgccaggccccgguauucccgaaacugcuucagugguugcgauuacaguucaggaguuguuccccgcuccuauucugcgugcaguuccaucagcugagccccaagcuggcagcccuaugacccucagcugucaaacuaaacugcccuugcagagauccgccgcucgccuucuguuuagcuucuacaaagauggcaggaucguacagucaagaggauugagcagugaauuucagauucccacugcguccgaagaucacagcggcuccuacuggugcgaagccgcuaccgaggacaaccaaguuuggaaacaguccccccaacuggaaaucaggguccagggugccucgucaucugccgcuccuccuacguugaacccagccccucagaagucugccgcccccgguacagcgcccgaagaggcuccggguccccuuccuccgccgccuacaccauccucugaggacccuggauuuaguuccccucugggaaugccagacccccacuuguaucaccaaaugggauugcuacugaagcauaugcaggacguuagagugcuuuuaggucaccuuuuaauggaguuacgcgaacugucaggccaccguaaacccgguacuaccaaggcaacugcugaguag

SEQ ID NO: 14973 - RNA, 1407 nt, Artificial Sequence
  Description of Artificial Sequence: Synthetic coding sequence
augcgcuggauacucugcuggagccuuacuuugugucugauggcgcagacugcccugggggcccuucacaccaaacguccacaggucgugaccaaauauggaacccugcaaggaaaacagaugcacgucgggaaaacaccuauacaaguauuucuugguguacccuuuagccgaccuccucugggaauucucagauuugcaccacccgaaccccccgaacccuggaagggaaucagagacgccacgaccuacccccccggaugucugcaagagaguugggggcagcuggccucuauguacgugucaacaagagagcgcuauaaaugguuacgguuuuccgaggacugcuuguaccugaauguguacgcacccgcccgggcgcccggugauccacaacugcccguuauggugugguuccccggaggggccuuuaucguaggcgccgcaucuagcuaugaagggagcgaucuggccgcuagagaaaaaguugugcuaguuuuucugcagcaccgauugggaauauucggguuucuguccacagacgauucucacgccagaggaaacuggggcuuguuagaccagauggcugccuuaagguggguucaagagaauaucgccgcuuuuggcggagauccuggcaacguaacccuguuugggcagucugcuggagccauguccauuucaggccuuaugaugucuccacuugcuucuggccuguuccacagagccauaucucagucuggaacagcacucuuucggcucuucaucacaagcaauccccucaaggucgcaaaaaagguggcccaucuggcaggguguaaccacaacuccacacaaauauuggucaauugucuucgagcucugagcgggacuaagguuaugcgcgugucuaauaagaugagauuucugcagcugaacuuucagcgggaucccgaagagauaauuugguccaugucuccugugguagauggggucgugaucccagacgacccacucgugcugcugacccagggcaaggugagcuccguccccuaccuucucggcgugaacaacuuagaauuuaacuggcuccuucccuauaucaugaaauucccuuugaacagacaggccaugcgcaaggaaaccaucacuaagaugcucugguccacaaggacccugcuuaacauuacaaaggaacaagucccccugguggucgaagaguaccucgacaauguuaaugaacaugacuggaagaugcugcguaaccguaugauggacauaguucaggaugcaaccuucguauaugccacuuuacagacagcacauuaccacagagagacaccaaugaugggcaucugcccagccggacacgccacaacaaggaugaagagcaccuguucauggauucucccgcaggagugggcauag

SEQ ID NO: 14974 - RNA, 756 nt, Artificial Sequence
  Description of Artificial Sequence: Synthetic coding sequence
augucuucuuacggcuacggagaucuuuucagugauaccuggaaugcauuuacagacuaugauguaauacacuugaaaacuuacgauuccaagcgggucugcuuuaaagaagccguguucucauugcugccccgaaugcgcuaugggcucuuuuauaauacaccccuuauuuccggcugccaaaauacuggauuguuccgagccuuugcacagcacguccuucaccgacuuaacauaacacaggaagguccaaaggauggaaaaauuaggguuacaauuuuggcucgaaguaccgaauaucguaaaauacucaaucaaaaugaacugguaaaugcacuaaagaccguguccacauuugaggugcagaucgucgauuauaaauauagagagcuuggguuccuggaucagcuacgaaucacacacaauacagauaucuuuaucgggaugcacggcgcaggucucacacaccuguuguuucugcccgauugggccgcagucuuugaauuguacaacugcgaagacgaaagauguuaucucgaccuugcccggcugcguggaguacacuacauuacauggagaaggcagaacaagguauuuccacaggacaaagggcaccauccgacccuuggcgagcaucccaaauucacuaacuauucguucgauguagaggaauucauguaccugguccugcaagccgccgaccauguauuacaacaucccaaauggccauucaagaaaaaacaugacgaauuauag

SEQ ID NO: 14975 - RNA, 927 nt, Artificial Sequence
  Description of Artificial Sequence: Synthetic coding sequence
augauccccguugaacugcuccuuugcuaucuuuugcugcauccuguggaugccaccagcuacggaaaacagacaaauguacuuaugcauuuuccccuuucucuggagagucagacucccuccuccgauccccuaaguugccaauuccuccaucccaagucauuaccaggcuucucucacauggccccacuuccaaaauuucuugugucuuuggcccuacgaaaugcucuagaggaggcggguugccaggcagacguuugggcccugcaguugcaacuauaccgucagggcggugugaacgcgacccagguguuaauucaacacuuaaggggccuccagaaaggacgaaguacagagcgcaauguuucaguagaagcgcuggcuucagcacugcaauugcucgcccgagaacagcaaagcacagggagagugggaagaucccuuccuacagaggauugugagaaugagaaagaacaggcagugcauaacgugguucaguuauugccgggcgucgguaccuucuacaaucuagggacugcccuguauuaugccacccagaacugccuggggaaagcuagagaacgcggaagagacggugcaauugacuuaggcuaugaccugcugaugacgauggccgguaugagcgggggcccaaugggcuuggccauuagcgccgcccuuaagccugcauuacggucaggcguccagcagcuuauucaguacuaucaggaccagaaggacgcaaacauuagccaaccugaaaccaccaaagaagggcucagagccauuagcgacgugucagaucuugaagagaccacaaccuuagcuagcuuuaucucugaggucgugucgagcgcaccauauuggggaugggccaucauaaagaguuacgaucucgaccccggcgcagguucacucgagauuuag

SEQ ID NO: 14976 - RNA, 2862 nt, Artificial Sequence
  Description of Artificial Sequence: Synthetic coding sequence
augcgcguccuagccugcuuguuggccgcauuaguaggaauucaggcaguagagcgguuaagacuggccgacgguccgcacggaugugccgggcgcuuagagguguggcauggggggagguggggaaccgugugugaugauggcugggaucugagagacgcugcaguggcgugcaggcagcugggguguggcggagcuuuggccgcacccggaggggcauucuucggcgaaggagcugggccuguguggcuguccgaacuggccugucgcggcaacgagggacagcugggccugugucaccauagaggauggaaagcccacauuuguagccaugaagaggaugcagguguggugugugcuggccagagagucgcaaacucuagagaugauucaaccucgccguuagacggagcaccauggccagggcugcuccuggaacucucgccuucuaccgaggagccccuaguuacacaugcccccagacccgcugggaauccacagaacgcaagccggaagaagucaccacguccuaaacaggcaaaaucaacccgcgccccuuugcugaccaccggcgccccgagacaggaacgguugcgguuaguaucugggccgcacaggugugccgguagacucgaaguguggcacggcgggagguggggaacugugugugacgaugguugggauuuaagagacgcugcgguagcgugccgcgaacuaggauguggcggagccuuggcugcgcccgggggcgccagguuuggaccaggggccgggccgguguggauggacgauguggggugugggggcggagagcaggcacugcgugauugucccaggucucccugggggagguccaacugugaccauucggaagacgccgggcugguuuguaccgggccggcgccuagauuaaggcuagccgacgguccacaugggugcgcagggagacuggaaguguggcacgguggaagaugggggagcgugugcgacgacgccugggaccuaagagacgcggcaguggccugcagagaacucggaugcggcggcgcucucgccgcuccagggggggcuuuuuucggggagggcagugggccuaucauauuggacgaucugcgaugccgugggaacgagaccgcucuaagguuuuguccggcccgaccuuggggccagcaugacugccaccauagggaggaugcaggugccguaugcgacggaaugccccucgguuacgugccccccacugcgcccacagauucuaauaauuccacaccaagggaagccgccucacgcccaccuuccacuaugacaucacaagccccaggaacagcaggagucaguccaccacccgccucgccaaccguccugugggagccaggaccggaggccggaagcccucaauugagguuggucgcuggcccgaguaaaugcuccggcagacuugaagucuggcaugaucaaagaugggguaccgugugcgaugacucuugggauaugagagauucagcaguugucugccgcgaacucggcugcgggggcccgcaacagcccgauccagccgccggacgauuuggcuggggugccggaccuauaugguuggaugacgucggcugcgucggcacggaggcuagccuuagugauugcccugcugcacccuggggcaaacauaauugugcacacaaugaggacguggggguuacaugcacaggcccgcccggucuugauagcauuuccgauccauucaguugguccuggauaccaggccugggcagagauagggacgccuggcuaccuggcgaguuggcgaccaagccuucugcuaguguaacagccucaguccuugaaaaaacuacgacgaaagcaccuggaaaaaugccuaaaaguacuaaaaaguggguuacaaaaaacgccaaacgaccaaccacucaaccccccgugaugccuacaaccaagcacagccgggcccagucuccgccagaccucacaucccagacaacggcagcuuuaaccaccgaggcguccagacgaccaaccagcgaguuuacccggcgcccuaccaccgaagccccccagcgguggacuucucacacuacugcgacccuaacgccccaggcuccuagagagagaacuacaaaaacuauggcaaugcuaacgacccaaggaccacaggaaaugacgagcgaaucaacaaucaaauccauaccacaggccuccuuagagccauccgcagaaaucccagaaggaagcccggaaucucccaaggaucccgcccccuccccaagcgugucuacuacgggggaaagcgggcuguuuagagugagacuggccgacggccccaaucgcugcgcuggcagguuggagguauggcacgccggaagguggggaacagugugcgacgauaacugggauuuacgggacgcaacagucgccuguugggagcuggggugcggaaaagugcggccucguguuggaaaaacacacuacggcccagguacaggcccgauuuggcuugaugacaugggaugcaagggcucugaagcaagucugagcgauugcccaucgggugcuuggggaaaacacaauugugaucacgaagaagacguagggcugaccugcacaggguacacugauuaugaugauuacccuccauggaccugggacccuacuagcagagaagaucuagccaaaggaacaaccaccgcuggagucccagggcauacacuacccuggaggaccacacgucggcccggaagcucuagccccgcuauaagaagacugccagauacugaaccggaagcuggccugcgcgaaguuaugcuuuuggugcaaggacuucccggccugcaaagauuaccaucaccguag

SEQ ID NO: 14977 - RNA, 474 nt, Artificial Sequence
  Description of Artificial Sequence: Synthetic coding sequence
augcuuagaaccgaguccugucggcccagaucuccagcggggcaggucgcagcugccucaccauuacugcuacugcuguuacuccuggccuggugugcgggcgcauguagaggagcucccauccuaccucaaggccuucaacccgagcagcaacuucaacuguggaacgagaucgacgauacaugcuccucauuccucuccauugacagccaaccacaggccucaaacgcucuggaagaacuguguuucaugaucaugggcaugcugccaaaaccacaggagcaggaugagaaagacaacacaaaaagguccucggucguccaucccuugcuccaacuggucccucacuuacacgaaagaaggaugaaacgauucaggguagacgaggaguuccaaucuccauuugcaucucaaucccgaggcuauuuccuguuuaggccccguaauggaaggagaagugcaggguucauuuag

SEQ ID NO: 14978 - RNA, 1545 nt, Artificial Sequence
  Description of Artificial Sequence: Synthetic coding sequence
augccuucaacuguccugcccagcacugugcuuccuucccuguuaccuaccgcgggugccggauggagcaugcgguggauccucuguuggucucuuacauuaugucuuauggcgcagacugcacugggagcccugcacacuaaacgaccccaaguugucacaaaauauggaaccuugcaggggaaacagaugcaugugggaaagacacccauccagguauuccuuggugugccauucucuagacccccccuggguauucugagauucgcccccccggagccaccugagccguggaaaggaaucagggaugcuacaacuuaucccccagggugucuccaagaaaguuggggacaacuggccucaauguacguguccacuagagagcgguauaaaugguugcguuuuagcgaagauuguuuguaucuuaacgucuacgcccccgcccgcgcuccuggggauccucagcugccagugauggugugguuuccagguggagcauuuauugucggggcugccagcaguuaugaagggagcgacuuggccgcgcgagaaaaaguggucuuaguuuucuugcaacacagacucgguauuuucggauucuuaaguacugaugacagucacgcgcgcgguaacuggggucuccucgaccagauggcagcuuuacgguggguucaggaaaauauagcagcuuucggcggggauccugguaacgucacucucuuuggucagucugccggagcaaugucuaucagcggccugaugauguccccccuggccuccgguuuguuccacagagccauuucacaaagcgggaccgcccuuuuccgcuuguuuaucaccaguaauccacuaaaggucgcuaagaagguagcacaucucgccggaugcaaccauaauaguacucagauccugguaaacugucugagagcucugucuggaacaaaggugaugcgagugucaaauaagaugcgguuuuuacagcugaauuuucagcgugacccugaagagauuaucuggagcauguccccugugguugauggcguggugauuccugaugacccacuggugcugcugacccagggcaaggucucuuccgucccuuaucugcuaggagucaauaaucucgaguuuaacugguugcugcccuacaacaucaccaaagagcagguaccgcugguuguagaagaauaucuugauaacgucaaugagcacgauuggaagaugcugagaaaucgaaugauggauauaguacaagacgcgacauuuguauaugccacgcuacagacggcccauuaccacagaggacuaucaaugggaaaagagaaagcucuuagccuccaaaugaugaaguacugggcuaacuuugcccgcacagggaauccgaacgacgggaauuuaccuugcuggccaagauauaacaaggaugaaaaguaccuucagcucgauuuuacaacacggguagguaugaaguugaaagagaagaagauggcuuuuuggaugucucuauaccagucacaaaggccagaaaagcaacgccaguucuag

SEQ ID NO: 14979 - RNA, 1062 nt, Artificial Sequence
  Description of Artificial Sequence: Synthetic coding sequence
augucuaacccgacccagaccgacgccgauuccgacuuaguuggcgacguaugcgauacaaacgaagauuccgacggcgauggccaccaagacacaaaggauaauugcccccaguuaccaaacucuagucagcuggauuccgacaacgacgggcuaggcgacgaaugugauggagaugaugacaaugaugggauuccagacuacgucccuccuggacccgauaacuguagacuugugccgaauccaaaccaaaaggauagcgacgggaauggaguaggagacgugugcgaagaugacuucgauaacgacgccguuguugaccccuuagauguguguccugaaucagcagaaguuaccuuaaccgacuucagagccuaucagacugugguguuggacccggagggugaugcccagaucgauccuaauugggugguacuaaaccaggggauggaaauagugcaaaccaugaauagugauccuggauuggccgugggcuauaccgccuuuaauggaguggacuucgaaggaacuuuccaugucaauacuguaacagacgacgacuacgcugguuuucuauuuucauaccaggauucugggagauucuacgucguaauguggaaacagaccgaacaaaccuauuggcaggcaacccccuuucgcgccguagcacagccuggcuugcaacuuaaagcagugacauccgucuccgguccgggcgagcauuugcgaaacgcacuuuggcacaccggacacacuccagaccagguccgcuugcuauggacugaccccaggaacgugggcuggagagacaagacuucuuaucguuggcaacugcugcacagaccacaaguuggguacauccgggucaaauuguacgaaggcccucaacuaguugccgauagcggagugauuaucgauacgaguaugcgcggaggucggcuggggguauucuguuucagucaggagaauauuaucuggucuaauuuacaguacaggugcaacgauacaguuccugaggauuuugagccauuccggagacaacucuugcagggaaggguauag

SEQ ID NO: 14980 - RNA, 1074 nt, Artificial Sequence
  Description of Artificial Sequence: Synthetic coding sequence
auggagauugagcauacccucgaucagaugaucucaaaaguggguaaccauaucgacguguuaacuggaaaguggguggcucaggacgcaggaaucggugccgguguagauuccuauuucgaauauuuggugaaaggagcuauacuucuccaggacaaaaagcucauggcuauguuucucgaauacaauaaagccauacggaauuauacacgcuucgacgacugguacuuauggguccagauguacaaagggaccguuagcaugccaguguuucagucacuugaggcauacuggccuggcuuacagagccucaucggagauaucgacaacgccaugcgaaccuuucugaauuacuauacuguauggaagcaauucggcggacugcccgaauucuauaauauaccucagggcuauaccguggaaaagcgggagggcuauccacuucguccggagcucauugagagugccauguauuuguacagagcgacuggagauccuacauugcuggagcuggggcgagacgcggucgaaucuauugaaaagauaucuaaaguggaauguggauuugcaacuauuaaagaucuaagggaccauaaacuggauaacagaauggaaucuuucuuccucgcagagaccguuaaauaccuguaucugcuuuuugauccuaccaacuuuauucacaacaauggaagcaccuucgaugcggucauuacuccauacggcgaauguauucugggcgcugguggcuacauuuuuaacacugaggcgcacccuaucgauccugcugcguuacacugcugucaacgccugaaggaggaacaaugggaaguagaggaucuuaugcgagaguucuacagccugaaacggucccgaucuaaauuccagaaaaacacggucagcuccggaccgugggagccucccgccagaccaggaaccuuguuuucccccgaaaaccaugaccaggcacgugagaggaagccagccaaacagaaggucccccuguuauccugcccuucacaaccauucacgaguaagcuggcacugcugggacagguguucuuagauucaucauag

SEQ ID NO: 14981 - RNA, 1341 nt, Artificial Sequence
  Description of Artificial Sequence: Synthetic coding sequence
auguuacacccugagacuucucccggucgcggacaccugcucgcugugcugcuggcauuacugggcaccgcuugggccgagguauggccaccucaacugcaggagcaagccccaauggccggcgcccugaaccguaaagagucauuccugcugcuuagccuacacaaccgccugcgaagcuggguucaaccucccgccgcagauaugcgcaggcuggacuggucagacucacuggcucaauuggcucaggcacgagccgccuugugcggcauacccacccccucccucgcaucuggccucuggcggacucuucagguaggguggaacaugcaacuccuucccgccggucuugccucauuuguagagguagucuccuuaugguuugcagagggucaaagauauagucaugccgcaggcgaaugugccagaaacgcuaccugcacgcacuauacccaacucguaugggcuacuucuucucaacuaggaugcggaagacacuugugcagcgcagggcaagccgcgaucgaggcuuuugugugcgcauacucaccccgggggaauugggagguaaacgguaagaccaucguccccuauaaaaaaggggccugguguucauuguguacagcuagcguuucagguuguuuuaaagcaugggaccacgccggcggacucugugaggugccgagaaauccaugcagaaugucaugccaaaaccauggccggcuuaacauuuccacaugucauugucacugucccccaggauacaccggcagauacugucaaguccgguguucacuacaaugcguccacgggagauucagagaagaagaguguagcugcgugugcgacauugguuacggcggcgcacagugugccacuaaggugcacuucccuuuucauacgugcgaccuaagaauugauggagauuguuuuaugguaagcagcgaagccgacaccuacuauagagcucggaugaagugccaacgaaagggaggcguacuugcucagaucaagucgcagaaaguucaggacauucuagccuucuaucuaggucggcuggaaacuaccaaugaggucaucgacuccgauuuugaaacacgaaauuuuuggauaggauugacauauaagacagcgaaggauuccuucagaugggcaacuggagagcaucaggcuuucaccucuuucgcauucgggcagccagauaaucauggauuuggaaacuguguugagcuucaagcaucagcagcauuuaauuggaauaaucagcgguguaaaacccgaaaccgcuauaucugucaguuugcucaggagcauauaucuagaugggggccagguaguuag

SEQ ID NO: 14982 - RNA, 900 nt, Artificial Sequence
  Description of Artificial Sequence: Synthetic coding sequence
augggcggaccacgagcucuacuggcugcccugugggcuuuggaagccgcaggcacagcagcucucagaaucggcgcauuuaauauucaguccuucggcgauagcaaagugagcgauccugcuugugggagcaucaucgcaaaaauccucgccggauaugaucucgcacucguccaggaagugcgggaccccgauuuaucagcaguuucugcucugauggagcaaaucaacaguguuagcgagcaugaguacuccuucguaagcagucagccucuuggucgagaucaguauaaagagauguaccuguuuguguaucgaaaggacgcgguaucuguuguugauacuuacuuguacccugacccagaagauguuuucucucgagagccauuugugguuaaguuuagugcaccaggcacaggagaacgggccccaccacugccgucuagaagggcccugacuccccccccacuuccugccgcugcccaaaaccucguuuugauuccccugcaugccgccccucaccaggccgucgccgagauugacgcccuguacgauguguaccucgaugucauugacaaaugggggacugaugauaugcuguuuuuaggcgacuucaacgcagacugcuccuacgugcgcgcucaagauugggcagcgaucagacuacgcagcuccgaaguguuuaaauggcugauucccgacucagcugacacuacagugggaaauucagauugcgccuacgaccguauuguggcaugcggggcuagguugagaaggagucucaaaccacagagugcaacagugcaugauuuucaggaagaguucggucuggaucagacccaagcgcuugccaucucugaccacuuuccaguugaagucacacucaaauuucauagguag

SEQ ID NO: 14983 - RNA, 1458 nt, Artificial Sequence
  Description of Artificial Sequence: Synthetic coding sequence
auggacaacaauaaacacuguaagcaggauaauugucuguuaacgccgaauagcggccaggaggacgcagacaaugauggagucggagaucaaugugacgaugacgcagauggagacggaaucaagaauguggaagauaauugccggcucuuuccuaacaaggaccagcagaacagcgauaccgauaguuucggcgaugccugugacaacuguccuaaugugcccaacaaugaccaaaaagauaccgacggcaacggugaaggagaugccugcgacaaugauguggauggagauggaauuccuaauggauuggauaacugucccaaaguuccaaacccacugcagaccgaccgagacgaggaugguguaggggaugcuugugacuccugucccgagaugucaaaccccacccagaccgacgccgauucugacuuagugggcgacguaugugauacgaacgaagauagcgauggagacggacaccaggacacuaaagacaacugcccccagcugccaaacuccucucagcuugauagcgacaaugacggccuuggagaugagugugauggcgacgaugacaaugauggaaucccugacuacguaccccccggccccgauaacugccgcuugguuccaaaucccaaccagaaagacagcgauggcaauggagugggcgacguaugugaggacgacuuugacaaugacgcugugguggauccgcucgacguuuguccggaaagcgccgaggugacacuaacugacuucagggcauaccaaacuguggugcucgacccagaaggcgacgcccagaucgaucccaacuggguggucuugaaccagggcauggaaauagugcagacaaugaacagugauccuggcuuagccgucgguuauaccgcuuucaauggaguggacuucgaggguacuuuucacguuaacaccguaacagacgacgauuaugcagguuuucucuucucuuaucaggacucagggagauuuuauguugugauguggaagcagaccgaacagacauauuggcaggcaaccccauucagagcaguagcccagccuggccugcaacugaaggcuguuacuuccgucagcggacccggcgagcaucugcggaaugcucucuggcacacagggcacacucccgaucagguacgacugcuguggacugauccacgcaacgugggcuggagggacaagacaaguuauagauggcagcugcugcauaggccacagguggguuacauacgggucaaacuuuaugagggaccucaacucguugccgauuccggaguuauaauugacacaucuaugagagguggaagauugggaguguucuguuucucgcaggagaacaucauuuggucuaauuugcaauaucggugcaaugauaccguucccgaagauuucgagccauucagaaggcagcucuugcagggacgggucuag

SEQ ID NO: 14984 - RNA, 2358 nt, Artificial Sequence
  Description of Artificial Sequence: Synthetic coding sequence
augaagcacacacuggcacucuuggcuccauuacucggcuuaggguugggacuugcacugucacaacuggccgccggggcaaccgauuguaaauuucucggaccggcugagcaccugaccuuuaccccagcugcccgggccagauggcuggcuccccgcguucgggcuccaggauugcucgauucauuauacgguacagugagacgguuucucuccguggugcaacugaaccccuuucccagcgaacucgugaaagcgcugcuaaaugagcuggccucuguaaaagugaaugaaguaguuagauacgaagcuggguacguugucugugcggugauugcgggacuguaccuccugcucgugccgaccgcuggucuuugcuuuuguuguugccgcugccaccguaggugugguggacgggugaagacggaacauaaagccuuagcuugcgaacgcgccgccuugaugguguuccugcuacuuaccacccucuugcuacugauagguguugucugcgcuuuugugacaaaccagagaacacacgaacaaauggggccuucuaucgaagcuaugccagagacucugcuuagucuauggggauuagugagcgacguaccccaggaacuacaggcuguggcccagcaguuuucccugccccaggaacaagucagugaggaacuugauggagugggugugagcauaggaucugccauccauacucagcucagauccagcguuuauccuuuauuggcagcagucggcaguuugggacaagugcuucagguaagcguacaucaucugcaaacuuuaaacgccaccguggucgagcuucaagcaggacagcaggaccucgagccugccauuagagagcaucgggauaggcuccuugagcugcuucaagaggccagaugccagggcgacugcgcuggcgcccucaguugggcgcgaacacuugagcucggcgcagauuuuucccaggugccaucuguugaccauguccuccaccagcuuaaaggagugccagaggcgaacuucuccucaauggugcaagaagaaaauucuacauucaaugcucuccccgcucuagccgcaaugcagacaucuuccguggugcaggagcuaaaaaaggccguugcccagcaacccgagggggugaggacuuuggcugaaggguuuccgggccucgaagcagcgucgagaugggcccaagcccuucaggaaguggaagagagcagccguccauaccugcaggaagugcaacgcuaugagacguauagguggauaguagguuguguucucugcucuguagugcuuuuugugguucuguguaaccugcugggauugaauuuaggcaucuggggucuaucagcacgagacgacccaucucauccggaagccaaaggcgaggccggcgcaagguuucugauggccgggguuggauugucauuccucuucgccgcaccacugauucugcuaguguuugcaacuuuccuugucggggguaauguucaaacacucguuugccagagcugggaaaauggugaacuuuucgaauucgccgauacuccuggcaaucugccuccgagcaugaaucuuagucagcuguugggacugcgcaagaauauuucaauccaucaagcauaucagcaguguaaggagggggcugcauuguggaccgugcugcagcuuaacgauuccuaugaucuagaggaacaccucgacauuaaucagauccaaagacccgucgugaagacuucaauggaacaguuagcacaagaguugcaaggcuuggcucaggcccaggacaauagcguguuagggcaacgucuccaggaggaagcccagggcuugcgaaacuuacaccaggagaaaguugugccacagcagucacugguugccaaacugaaucuuagcgugagagcucuagagucguccgcaccaaacuuacagcuggaaacuuccgacgucuuggccaacguaaccuaccucaaaggagagcuuccggccugggcugcacgaaucuuacggaaugucucugaauguuuccuggcccgcgagaugggauauuuuucucaguacguugccugggugagagaagaggugacucaaagaaucgccaccugccagccacugagcggcgcacuggauaauucaagggugauacugugugacaugauggcugacccuuggaacgcuuuuugguucugucuagcguggugcacauucuuccucaucccuuccauuaucuucgcagucaagacauccaaauacuuuagacccaucagaaaaagacuuuccuccacaucuucagaggaaacccagcucuuccauauaccucgcguaacaucccucaagcuguag

SEQ ID NO: 14985 - RNA, 792 nt, Artificial Sequence
  Description of Artificial Sequence: Synthetic coding sequence
auggguagaguucuugaagaagcacgauucgcaguggccuuuacagaaucaaugaaagagauggcccaagcgcaauggaaagcacgccagaucagccuagcagucacuagcgccguccccguucagccacaugccaagggaaaaguguaugugcaaucucagggaaucgcgaccacccccaaugcugccuuuaauuggaauaccuuccuccagcggucggaaaucaaucagagcgccgauaaccugcacauuuuuuugcucauaugcggucugcgccaggugaaagacccauuguacuugguugacgcuuuuucugcuuggcaucaggaggagccuaacguacacuuggugauuguggguccagaaguagaccccgucuuuacgagggaagugaaggccaaggucaaacgagccgcaggaguuagauuaauuggagagaugccccaggaagaucuccacgcaguugucaagaacugcuuugcaguuguaaauucgucaguuucugaggggaugucugccgcuauucuggaggcaauggaucucgaaguuccuguucucgccagaaauaucccuggcaacgcugcggucgucaaacacgaggugacuggcuugcuguuuagcaauccacaagaauuugugcaucuagcgaaaagacucgugagugauccugcccuugaaaaggaaaucgucgugaauggaagagaguacguacguauguaccauagcuggcaaguugaacgagauacauaccagcagcucauaaggaagcuggaaggcagcacugaggauuag

SEQ ID NO: 14986 - RNA, 456 nt, Artificial Sequence
  Description of Artificial Sequence: Synthetic coding sequence
augaagacagcagugaugaaggaguuauauucauuucuccaccaccagaacagauauggcagcgaacaggaauuuguggacgaucucaagaacaugugguuuggacuguacagccgcggaaacgaagaaggcgacucaucaggauuugaacauguuuuuagcggcgaggugaagaagggaaaaguuacuggauuucacaauuggauccgguucuacuuggaggaaaaagaagggcugguggacuacuacucacacauuuacgacggcccaguccccgucaaaccaggaaggaucagccucaguuguccagacauuuaccucggacagguucaucucugggaauggcaagagguccaccggcauagccuacauuccguuuuccaccuuauagaauugcgcgccagaaaagggcacgagggcuccugugaaacagaagugcuuucuucgcuugacuag

SEQ ID NO: 14987 - RNA, 363 nt, Artificial Sequence
  Description of Artificial Sequence: Synthetic coding sequence
augcucccucaguggcuguugcugcuguuccuccuuuucuuuuuccucuuccuuuuaacacgaggaucccugucgcccacuaaauacaacuuauuagagcuuaaagaauccuguauaagaaaccaagacugcgagaccggcugcugccagcgagcaccggacaacugcgagucucacugugccgaaaaaggauccgaggguagucuaugccaaacucaaguguuuuucggacaguaccgcgccugucccugcuuaaggaacuugaccuguauuuacucuaaaaaugagaaauggcucuccauugcauaugguaggugucagaagauagguaggcaaaaacucgccaagaaaauguucuuuuag

SEQ ID NO: 14988 - RNA, 951 nt, Artificial Sequence
  Description of Artificial Sequence: Synthetic coding sequence
auggcugaggcugcacuggaagcuguacguuccgaauugagagaauucccugccgccgcuagagaacugugugucccccuggccgugccuuaccuugauaaaccuccuaccccacugcauuuuuacagggacuggguguguccuaaccggccauguaucaucagaaacgcauugcagcacuggccggcccugcagaaauggucucugcccuauuuccgcgcuacaguagguagcaccgaaguaagugucgcugugacaccagacggauaugcagacgcugugagaggagacagauucaugaugcccgcagaacgcagauuaccucucaguuucgugcuugaugucuuggaaggaagggcccagcauccuggugugcucuacgugcagaaacaauguagcaaccuccccucagaacucccacagcugcugccugauuuagagucccauguuccuugggccagcgaagcacugggcaagaugcccgacgccgucaauuuuuggcugggagaggcugccgccgugacaucgcugcacaaagaccacuaugagaaccuguauugugugguguccggagaaaaacauuuccucuuccacccgccauccgacagaccuuuuauaccuuacgagcuguacacuccggccacuuaccaguugacagaagaaggcaccuuuaaggucguggacgaggaggcaauggaaaaaguacccuggauuccccuggaccccuuggcuccugaccuggcccgcuacccaaguuauagucaagcccaggcucugcgcuguacugucagggccggugaaaugcuguaccucccugcccuaugguuucaucauguccagcagucccaagguugcauugccgugaauuuuugguacgacauggaauaugaucugaaauacucauacuuccagcucuuagauuccuuaaccaaagcaagcggacucgauuag

SEQ ID NO: 14989 - RNA, 657 nt, Artificial Sequence
  Description of Artificial Sequence: Synthetic coding sequence
augggacgcguguuccucacaggagaaaaggcaaauaguauucugaagcgauacccaagagcaaaugguuuuuucgaggagauccggcaagguaacauagagcgggagugcaaagaggaguucuguaccuuugaggaagcuagagaagcauuugagaacaaugaaaagacaaaggaguucuggagcaccuacaccaaagcucaacagggggaaucuaacagagggucugauugguuccaguuuuaucuuacuuucccauuaaucuucggccuguucauuauccuccucgucaucuuccucauuuggagaugcuucuuaagaaacaaaacgcgacgccagacagugaccgagggccauaucccuuucccacagcaucugaauaucaucaccccuccccccccgccagaugaaguguucgacagcaguggacuaucuccaggcuuccugggcuauguugugggacgcucugauucugucucuacacgccucuccaauugugaucccccuccaaccuaugaagaagcuacuggccaggugaaucugcagcggucugagacugagccacaucuugaccccccaccagaguacgaagacaucgugaauuccaauucagcaucugccauucccauggugccaguagugacgaccauaaaguag

SEQ ID NO: 14990 - RNA, 909 nt, Artificial Sequence
  Description of Artificial Sequence: Synthetic coding sequence
auggcaauguuucuggaauacaacaaggccauucggaacuauacccgcuucgacgacugguacuuauggguccaaauguauaaagggacgguuaguaugccaguauuucagaguuuagaagcuuauuggccaggauugcaaucucucaucggggauauugauaacgcuaugcgcacuuucuugaacuauuauacaguauggaagcaauuuggugguuuaccugaguuuuauaauauaccacagggauauaccguggaaaaacgcgagggguauccacuucggccugagcugauugagucagcaauguaucuguaucgcgcgaccggcgauccuacauuguuagagcugggacgugacgccguugaauccaucgagaagaucagcaaaguggagugcggcuuugcaaccaucaaagaucucagagaccauaagcuugacaaccgcauggagucguucuuucuagcugaaacaguuaaauacuuauaccugcuguucgacccuaccaacuuuauccauaacaacgguucuacguucgacgcaguaaucacucccuauggcgaauguauccugggcgcuggcggcuacauuuuuaacacugaggcccacccaauugacccugcugccuugcauugcugccagcgccucaaggaggaacagugggaaguggaggaucucaugagggaauucuauagucuaaagcggaguagaagcaaauuucagaaaaacacaguaucuucuggccccugggagccacccgcacgcccaggcacccucuuuucuccagaaaaccaugaccaggcgcgagaaaggaaaccugcuaaacagaaaguuccucuuuuaucuuguccuucacagccuuuuacaucaaaacuugccuugcucggccagguauuccucgacagcagcuag

SEQ ID NO: 14991 - RNA, 459 nt, Artificial Sequence
  Description of Artificial Sequence: Synthetic coding sequence
augcuuguugaugguccaagugaaagaccagcucugugcuuuuuacuccuggcuguugcuaugagcuuuuuugguagugcacuguccauagaugagacucgggcccaccugcuccuuaaggaaaagaugaugcgguuaggcggucgacuugugcucaacacaaaagaggaauuggcaaaugagcgccuuaugacacucaagauugcagaaaugaaagaagcuaugagaacacugauuuucccccccuccaugcacuucuuucaggcaaaacauuugauugagcgaagucagguauuuaacauccugagaaugaugccaaaaggugccgcacugcaucuccacgauauugggaucgucaccauggauugguuaguaagaaacgucaccuaccgcccgcauugucauaucugcuuuacaccuaggggaauuaugcaguuucgcuucgcucacccaacuuag

SEQ ID NO: 14992 - RNA, 3951 nt, Artificial Sequence
  Description of Artificial Sequence: Synthetic coding sequence
auggagccucgccuuuucuguuggacuacccuuuuccuccuagcaggauggugccuuccuggccuuccuugcccuucucggugucuguguuucaaaaguacuguccgcuguaugcaucucaugcuggaucacaucccccaagugccccagcaaacuaccguguuggaucuucgcuucaaucgcauaagagaaauucccgggucugccuucaaaaagcuuaaaaaccuuaauacccuacuccuuaacaauaaucacaucaggaaaauuagccguaaugcauuugaagguuuagaaaaccuuuuguauuuauaccuuuauaaaaacgagauacaugcucuggacaaacagacuuucaagggauuaaucucccucgagcaucuauauauccacuuuaaucagcuggaaaugcugcaacccgagacuuuuggugaccuguugagacuagaaaggcuguucuugcacaauaacaagcuuuccaagauaccagcuggcaguuucucaaaucuugauagccugaagagacugagacuugauucgaaugcuuuagugugcgauugugaucuuaugugguugggggagcuucugcaaggguucgcgcagcacggacauacucaggcggcugcaacuugugaguacccaagacgucugcacgguagagccguggcgucuguaacugucgaggaauuuaauugccagagcccacgcauaacuuucgaaccgcaggauguugaagucccauccggaaacaccgucuacuuuacaugccgcgccgagggcaauccuaagccugaaaucauuuggauucauaauaaccacucccuugacuuggaagacgauaccaggcugaacguguuugacgaugguaccuuaaugauuagaaauacgagagaaagugaucaaggcguuuaccaguguauggcaagaaacuccgcaggggaagcaaaaacccaaucagccaugcugcguuauucuucuuuaccggcuaagcccuccuucgugauccagccccaggauaccgagguacugauagguacaaguaccacacuugaaugcauggcuacuggacacccgcacccucuaauuaccuggacaagagacaacggccucgaguuggaugggucaagacauguggcaacaucauccggacuguacuuacagaacaucacacagcgagaucaugggcguuucacaugucaugccaauaauucccacgggacuguccaggcugccgcaaauaucaucgugcaggcuccuccccaauuuaccgucacuccgaaggaucaagucgugcuugaggagcacgcgguugaauggcuuugugaggccgauggaaaucccccaccagucaucguuuggaccaaaacuggaggucaguugccuguugaaggacagcacacgguccugucuaguggaacguugagaaucgacagagccgcccagcacgaccaggggcaauaugaaugccaagccguuucuucuuuaggagucaaaaagguuuccguccaguugaccgugaaacccaaagcucuagccguguuuacccagcucccccaagacacuucaguggaggucggaaaaaacauaaauauuuccugucaugcacagggagaaccccaaccuauaauaacguggaauaaggaggguguacaaauaaccgagucaggaaaguuccacguggacgacgaaggcacucugacaauauaugacgccgguuuucccgaccaaggacgguacgaauguguugcacgcaacucauucggacuggcaguuacaaacauguuucucaccguaacggccauucaaggccggcaagcuggggacgauuuugucgagucauccauccucgaugccguccaacgggucgacuccgccaucaauucaacccgccggcacuuauuuagucagaaaccacauacaucuucagaucucuuagcccaguuucacuacccaagggauccgcuuauuguugagauggcgcgagcgggugaaaucuucgaacacacacugcagcugauacgcgagcgagucaagcaggggcugaccguagacuuggaaggcaaagaguuccguuacaaugaccuggugagcccacgcucucugucucugauugcaaaucucucuggaugcaccgcacgccgaccgcugcccaacugcucaaauagauguuuucaugccaaauauagggcccacgauggaacgugcaacaaccugcaacagccgacauggggugcugcccugacagccuucgcucgccuccuccagccggcauaccgcgacggcauucgugcuccacgcgggcuaggauuaccuguggggucccgacagccauuaccccccccucgacugguugcuacugugugggcccgugccgccgcugugaccccugaccacagcuauacuagaaugcuuaugcacuggggaugguuucucgagcaugaccuagaucauacagugccugcucugucuaccgcaagauucucagacggucgccccugcuccagugucugcaccaacgacccuccaugcuuccccaugaacacacgccaugccgacccuaggggcacccaugcccccuguauguuguucgcacgaaguuccccugcuugugcauccggaagaccaagcgccaccgucgacuccgucuaugccagggaacagauuaaccagcagacagccuauaucgauggcucuaacguuuacgggucgucugagagagaaagucaagcccuccgcgaccccagugugccccgaggauugcucaaaacuggauuccccuggcccccaucaggaaaaccacuguugccauuuaguacgggcccaccuacagagugugcccgccaagaacaggagucaccgugcuuccuggccggagaucaccgggcaaacgaacaucuggcccuggccgcuaugcacacauugugguuucgagaacauaacaggauggccaccgaauugucugcgcuaaacccccauugggaaggaaacacugucuaccaggaggccagaaaaaucguuggagcggaacuccaacacauuaccuauagccacugguugccgaaggugcuuggcgaucccggaacccguaugcugcgaggcuauagaggauauaacccaaacgucaacgccgguaucauaaacucauucgcuacugcugcauuccgcuucggucauacacucauuaaucccauucuguacaggcugaacgccacacuuggugaaaucagcgaaggacacuuaccauuucauaaggcauuauucucucccagucgaauuaucaaagaaggcgguaucgacccugugcuucgcggacuguucggcguggcugccaaguggcgcgccccuaguuaccugcucagccccgagcugacucaaagacucuuuagugccgccuacagcgcugcuguggacagugcagcaaccaucauccagagaggcagggaucaugguaucccaccuuacguggacuuccgagucuucuguaaucucacgucaguaaaaaauuucgaggacuuacaaaaugaaaucaaagacucugaaaucaggcagaaacugcggaaacuuuauggaucuccaggagacaucgacuuauggccugccuugaugguggaagauuugauuccaggaacaagagucggcccuacccugauguguuuguucgugacccaguuccagcguuuaagagauggcgaucgcuuuugguacgagaaccccggaguauuuacuccugcucaguuaacacaguuaaagcaggccagccugucgagaguauugugcgacaacggcgauucaauccaacagguccaagcggacgucuuuguaaaggcugaauacccccaggauuaccuuaauuguagugaaaucccaaaaguggaucuaagaguguggcaggauugcugcgcagacaaacaggccgggggcacaccagaagcaggcagaguuuauagaugcuag

SEQ ID NO: 14993 - RNA, 891 nt, Artificial Sequence
  Description of Artificial Sequence: Synthetic coding sequence
auggauccaucaaagaucgcccauacugaguacccugugaacacuauaaucauacacgaagacuucgacaauaauucaaugucuaauaauauagcacuguuaaaaacugacaccgccaugcacuucggaaaucugguucaaagcaucuguuuccugggccgcaugcugcacaccccaccugugcuacaaaauugcuggguaaguggauggaacccuaccuccgcgacugggaaccauaugaccaugagcguacuaaggaaaauuuucgugaaagaccuugauauguguccauuauauaagcuccagaagacugaguguggaucucacaccaaagaggagacaaagacagcuugccugggcgacccuggcucuccaaugaugugucaauugcagcaguuugaccucuggguguugcgcggcguucugaauuucggcggcgaaaccugcccaggcuuauuccuguacacaaaaguugaggauuacucaaaauggauuacgucuaaggcugagcgcgcugggcccccccugagcagccugcaccacugggaaaaacuuaucucuuuuucucaccacggaccaaaugcuacuaugacccagaagacauauucagauucagaguugggacauguuggcaguuaccugcaggggcagagaagaacuaucacacacaguagauuggggaacagcucuagggacagcuuagacguacgcgagaaggauguuaaagagucugggaggagcccugaagcuagcgugcagccacuuuacuacgauuauuauggaggugaagucggugaaggucguauuuuugcuggccagaacagguuauaccagccugaggagauuaucuugguauccuucguucucguguuuuucuguaguucaauuuag

SEQ ID NO: 14994 - RNA, 2808 nt, Artificial Sequence
  Description of Artificial Sequence: Synthetic coding sequence
augaggaagccacgccgcaagucuaggcaaaacgccgaagguagacgaucucccagccccuacucacucaaguguucucccacacgggaaacccucacguaugcacaagcccagcgaauugucgaaguugacaucgacgguagacugcaccgaaucuccauauacgacccacucaagaucaucacagaagacgagcugacagcacaagacauuacagaaugcaauagcaauaaggaaaauucagagcagccucaguucccaggcaaauccaaaaagccuucuagcaaagguaagaaaaaggaaucaugcucuaaacacgccuccggcacauccuuucaccuuccucagccaucauuuaggaugguagauuccggcauccagccagaggcuccaccccugccagcugccuacuaucgcuacaucgagaaaccacccgaggaucuagacgccgagguagaguaugacauggaugaagaagauuuagcuuggcuggacaugguuaaugaaaaaagacgagucgacggacauagucuggugagcgcugacaccuuugaguuacuggucgauagauuggagaaagaauccuaucuggaaucaagaucaagcggagcucagcaaagucugauagaugaagaugccuuuuguugugucugucuagacgaugaaugucauaacagcaacgugauuuuauucugugauauauguaaccuggcuguccaccaggagugcuacggcguccccuacauucccgaaggucaguggcugugcagaugcugccugcaguccccuagcagaccgguugacugcauucucuguccgaauaagggaggcgccuuuaaacaaacuucugauggucauugggcgcacguaguaugugcuaucuggauaccugagguguguuucgccaacacgguuuuucuggagcccaucgaggggaucgauaauaucccucccgcaagauggaaacugacaugcuauauuugcaagcaaaaaggccuaggugccgccauccagugucacaagguaaacugcuauaccgccuuccacgucacaugugcacaaagagcugggcuuuuuaugaaaauagagcccaugagggaaacuagcuugaacggaacaauauuuaccguuaggaaaacggccuauugugaagcucacucaccccccggagccgcaaccgcacggagaaaaggugauuccccuaggagcaucucagaaaccggagaugaagaggguuuaaaggagggggacggagaggaggaggaagaggaggagguggaagaggaggaacaagaggcccaggguggagucuccggaagucucaaagguguuccuaagaaaagcaaaaugagucugaaacagaaaaucaaaaaagaaccagaggaggccggacaagauacccccaguacccugcccaugcuggccgugccucaaauaccaagcuaucgacuuaacaaaaucugcaguggauugaguuuucagcgcaagaaucaauuuaugcagcgucuucauaauuacuggcucuugaagcggcaggccagaaacggggugccacugauacgccgccuacacagucauuugcagagucaacguaacgccgagcaaagagaacaggaugagaaaaccucagcggucaaggaagagcugaaguauuggcagaaacugcggcacgauuuagagcgagcucgucuguugauugaacugauaagaaaaagggaaaaacugaaaagggagcaagugaagguccaacaggcugcuauggagcucgaacugaugccuuucaacguccuuuugcgcacgacacuugaucuacugcaggagaaggaccccgcacauaucuucgcugagccagucaaucuaagcgaagugccagacuaucucgaauuuauauccaagccgauggacuuuaguacaaugcggaggaaacuggagagccaucuguaccgaacccuggaggaauuugaagaagauuuuaaccucauugucaccaacugcaugaaguacaaugccaaagacacuauuuuucacagagcagcaguucgcuugagggauuuagggggugcaauuuuaaggcaugcucguaggcaggccgaaaacauuggauacgacccggagagaggaacacaucugcccgaauccccgaagcucgaggauuucuaccgguuuaguugggaggacgggaugacuaauggcuucggaaaacacaccgaaucuggauccgauagugagugcucguugggccugagcggugggcuggcuuuugaggcuuguagcggacucacaccaccaaagcgcucaagagggaaaccagcuuugucacgggugcccuucuuggaaggagucaacggcgauagugacuacaauggcucuggcagguccuugcuuuugcccuucgaagacaggggcgaucuggaaccucuggagcuagugugggcaaaguguagaggauacccaaguuacccagcauuaaucauagacccaaagaugcccagggaaggauugcuacauaacggagucccuauacccgucccaccccucgauguacugaaguugggcgaacagaagcaggccgaagcaggagagaaauuguuccuggugcucuucuucgacaacaaacggaccuggcaaugguuaccaagggauaaaguccucccacugggaguggaagauacuguugauaaacuuaagaugcuggaagggcgcaaaacuucuauccguaaguccgugcagguugccuaugauagggccaugauacaccucagcagaguccggggaccacacucauucguuacauccucuuaucuuuag

SEQ ID NO: 14995 - RNA, 270 nt, Artificial Sequence; identical to SEQ ID NO: 13356
  Description of Artificial Sequence: Synthetic coding sequence

SEQ ID NO: 14996 - RNA, 657 nt, Artificial Sequence
  Description of Artificial Sequence: Synthetic coding sequence
auggggcgagucuuccucacuggggaaaaagccaacagcauauugaaaagauacccaagggcgaacggauucuucgaggaaauuagacaggguaauauagagagggagugcaaggaggaauuuugcacuuuugaagaagcccgcgaggcuuucgagaauaaugagaagacgaaggaguuuugguccacguacaccaaggcccagcagggagaauccaauaggggcucagacugguuucaguuuuacuuaacuuuuccacugauauucggccuguucaucauccuacuugugaucuucuuaauauggcgcuguuuuuugaggaacaaaacacggcggcagacagucaccgaaggacauauaccauucccccaacaccuaaauauaauuaccccgccaccaccaccugaugaaguguuugacucaagcggacucaguccgggauuccuuggcuaugucguggguagauccgacuccguguccacuaggcugagcaacugcgacccuccgccaacauaugaagaggcuacugggcaaguuaaucuccagaggucugagacagagccgcaccuggauccgccaccugaauacgaggauauugugaauagcaacagugcauccgcaauuccaaugguuccagucgucacuaccaucaaauag

SEQ ID NO: 14997 - RNA, 540 nt, Artificial Sequence
  Description of Artificial Sequence: Synthetic coding sequence
augucccuuggccccgaaguuuuccugggcccaccugaggcgcagucauuuuuaagcucacauacccgcauaccucgagcaaaucacugggaccuggaacugcucacccccggcaauuuggagcgagaaugccuggaggaacgauguucuugggaagaagcuagggaguacuuugaggacaauacacugacagaaagguuuugggaaucuuacaucuauaacgguaaggggggcaggggcaggguugauguugcaucccucgccguaggguuaacagguggaauucuucugauugugcuggcuggcuugggcgccuucugguaucugagauggcgccagcacagaggccaacaaccauguccccaggaagccggacugaucuccccccuuagcccucuuaacccucuuggaccuccuaccccucucccccccccaccucccccuccaccugggcugccaaccuacgaacaagccuuggccgccuccggugugcaugacgcuccuccucccccuuacacaucccuucggcguccccacuag

SEQ ID NO: 14998 - RNA, 765 nt, Artificial Sequence
  Description of Artificial Sequence: Synthetic coding sequence
augacacuagaagacaucgugcagagggaagugugggguacgguugucgcucgcggagccccugcccccccagguccugugccaacaagaggagcugccagucggcggcugagcguguccccagcgucuacuucagagaccagucuguaccaggugcucuugggcgcucgucaguuagugcagcccgguccucacgccauguaugcaagagugcgacagguagagucuaacccacuuuaucaagggacagcuaguagugcagauguugcccugguagagcuggaggcccccgucccguuuaccaauuauauccugcccgugugccugccagacccaaguguuauuuucgagacagguaugaacuguugggugacaggcugggguucaccaagugaggaagaccugcuucccgagccucguauacuucaaaaguuagccgugccuauuauagauaccccaaaaugcaaccuauuguauagcaaagacacugaauuugguuaucagcccaagacaauuaaaaacgacaugcuaugugcagguuucgaggaggggaaaaaggaugcguguaagggcgauucaggcgguccacucgucuguuuggucgggcaaucuuggcugcaagccgggguuauuucguggggagaaggcugugcacggcaaaaucgccccgguguauauauccgcgugacagcccaccauaauuggauucaucgcaucauuccuaaauugcaguuucaaccugccagacuagguggacagaaauag

SEQ ID NO: 14999 - RNA, 1899 nt, Artificial Sequence
  Description of Artificial Sequence: Synthetic coding sequence
augacgcccccgguuuuaacaacugcggaaacaucgguaaaaccuagcgugagcgccuucacacacagcccacccgaaaacacaaccggcaucucaagcacaaucucuuuccacucccguacuuuaaauuugacagacguaaucgaagagcucgcccaggcaucgacacaaacuuuaaagucuacaaucgccuccgagaccacccuaucgucuaagucacaucagucgaccaccacccgaaaggcaaucauccggcauucuacuauuccaccuuuccuuuccagcuccgcaacucugaugccugugccuaucaguccuccuuucacucagagggccgucaccgauaauguugcaacuccgauuagcggccuuaugaccaauacaguugucaagcuucacgagucuagcagacauaacgcaaagccccagcagcuuguugcugagguagccacuagcccuaaagugcaccccaacgccaaguuuaccauaggaaccacucacuuuauuuauagcaauuuacuccacucuaccccuaugccagcucucacaacagugaaaucucaaaacuccaaacugacuccaucaccaugggcagaaaaucaguuuuggcacaaacccuauuccgaaaucgcagagaaaggcaagaaaccugaagucaguaugcuggcgacgacuggcuuaucggaagcaacaacccuuguuucagacugggacggccaaaagaacacuaagaagucagacuuugacaagaagccugugcaagaggcgaccacuagcaaacuuuugccauuugacucauuaagccgcuauauuuucgaaaagccuaggauuguaggugggaaagccgcgaguuucaccauuccugccaauuccgacgcuuuccucccaugugaagccgucggaaacccucucccgaccauacauuggacucgcguacccuccggauuagaccuuuccaaacggaaacagaacagcagaguacaagugcuccccaaugguacacugagcauccaaagaguggaaauccaggaccgcggccaguauuuguguuccgccucuaaucuauucggcaccgaccacuuacauguuaccuugagcguaguuucuuacccaccacggauuuuggagagacgcaccaaagaaaucaccgugcacucaggcuccacuguagaguuaaaaugcagagcugaaggcagacccucccccacagugacuuggauccuggcuaaccagaccguggugucagaaaguagccaaggcagccgucaagccgucguuacuguggaugguacucuuguguuacauaaucuuagcauuuaugauagaggcuucuauaagugugucgcuuccaauccuggagggcaggauucauuacugguaaaaauccaagugauugccgcaccaccagucauucuggagcagcggagacaggugauaguaggcaccuggggcgagucauuaaaguuacccuguacagcuaaagggacuccucaaccuagcguuuacuggguuuugucagauggcacagaagucaaaccccuccaguucacaaacucaaaacucuuccuuuuuagcaacgggacucuguacauccgcaauuuagccuccagcgaucgcggaacuuacgaaugcaucgcaaccucuucaacaggguccgaaaggcgcgucgugauguuaacuauggaagaacgcgucaccuccccccggauugaagcugcaucgcagaaacggaccgagguuaauuucggagauaaacugcuucuaaacugcucagccacaggggagccgaaaccccagaucauguggcgacuacccaguaaagcaguuguugaucagcagcauagaguggcugccgguucuacaucaacccucauggaccccugccugcuugaccaauag

SEQ ID NO: 15000 - RNA, 681 nt, Artificial Sequence
  Description of Artificial Sequence: Synthetic coding sequence
auggacaucauuguccuacuucccaaggggcacugcacuaagauccaagaauuacagaugaccaccgugcugaaacaaaauguccaugucuucggcguagaggggaauucugaugagcucgaugaaccuauuaaaacaguguuugcugaugucgccuuuguuaagaagcacaaccugaugucucucaauagcauuaauuggucuagaguccugguccagauggcccaccauuucuucgcauauuuccagugcacgccuucucucgauacucacccguuaccacuuguagaggugguagugccaacaggggcagccggaaaucuugcugcugguuauaucgcccagaaaauugguuuaccgauccgccuugugguugcagucaacaggaacgauaucauccauagaacagugcaacagggagacuucagucuguccgaggccgucaagucaacgcucgccuccgcuauggauauucaggugcccuauaacauggaacggguguucuggcuacucuccgggucugauucacagguuacacgagcccucauggaacaauucgaacgcacacagagcgugaaccucccuaaagagcugcacuccaagcauucuccugugcucccucgaccuugccuaugcucacaggugcccgguucaugcccaggcuguuggccagauccauag

SEQ ID NO: 15001 - RNA, 729 nt, Artificial Sequence
  Description of Artificial Sequence: Synthetic coding sequence
auguuucagacggggggacucauuguauucuacggacuacuugcucagacacuuccccugaacgucaacccugcacuccccuuauccccaaccggcuuggcugguucacucacuaaugcgcugucaaauggucuccugagcgguggccuguuaggcaucuuagaaaaucucccucugcuugacauucucaagccagguggcggaacuucagggggccugcucgggggucuauuagguaaaguaacuagugucauuccaggccucaauaauaucaucgauaucaaagugaccgauccccagcuacuggaacuuggccuugugcagucuccugacggacaucgguuguaugugacuaucccccucgggauuaagcuccaggucaacacaccacuuguuggcgcaagccuccuaagacuugccgugaaacuugauauuaccgcagaaauucucgccgucagagauaagcaggagcguauccaccucguuuugggcgacuguacacacucaccaggcagccuucaaaucucccugcucgacgguuugggcccccucccgauccagggcuugcuggauagucugacuggcaucuugaauaaagugcucccggagcuagugcaaggaaacguuuguccacuuguaaaugaaguacuccgcggcuuggacauuacacuggugcaugauaucgucaacauguuaauucacggauugcaauuugucaucaaaguguag

SEQ ID NO: 15002 - RNA, 1422 nt, Artificial Sequence
  Description of Artificial Sequence: Synthetic coding sequence
auguccuuggaggcuagucuauguucauuagaggaaugugccgcauuucagccaaguagcccauccccccugcagccucaagguccagugaagucuaauaauaucgucacuguuaccggcaucucucucugccuguuuauaauuauagccaccguccugaucacucucuggagaagguucggacgcccagcuaaguguuccacaccagccaggcauaauaguauacacaguccuucauucagaaaaaauucagacgaagagaauauuugugaauugucugaacaacguggcuccuuuuccgauggcggcgaugguccuaccggaagcccaggcgacacaggcauaccacuuaccuaucguagaucagguccagucccuccggaagaugaugcaagcggcucugagaguuuccagucaaacgcccagaaaauuauccccccauuauuuagcuaccgccuugcucagcagcaguugaaggaaaugaagaaaaagggacuuacagagacgaccaaaguuuaccacgugagucaguccccacuuacggacacugcuauagacgcagcgcccagcgcaccccuugacuuggaaucuccugaagaagcugccgccaauaaauuuagaaucaaaagucccuuucccgaacagcccgcaguguccgcuggcgaacggccccccucccgucuggaucucaaugucacgcaagcauccugcgcuauuuccccaagucaaacgcuaauccguaaaucucaggcccgccauguuggaucccgggggggucccuccgaacguagucaugcucggaacgcccacuuucgccgaacagcauccuuccaugaagcuagacaggcccgcccauuuagagagagaagcaugagcacccuuacaccucgucaagcaccugcauacucaucaagaacacgaacuugcgaacaggccgaagaucgcuuucggccacagucacggggggcucaccuguuuccugagaaauuggagcauuuccaagaggccuccgggacgcgcggaccccugaauccacucccaaaauccuauacacucggccagccucugaggaaacccgaccucggcgaucaucaggcaggucucguugccggaauagagagaacugaaccgcaucgcgcacgcagaggacccucuccaagccacaagucagugucucguaagcaaaguagccccauuagccccaaagauaauuaccagagagugaguucccucagcccuucucagugucguaaggacaagugucagucuuuccccacacaccccgaauuugcuuucuaugacaauacaucuuucggacugaccgaagcagaacaaagaaugcuugauuuacccggauauuuuggaucaaaugaagaggaugagacaacuaguacccuguccguggaaaaacuggucauuuag

SEQ ID NO: 15003 - RNA, 2310 nt, Artificial Sequence
  Description of Artificial Sequence: Synthetic coding sequence
augcucagcaagaaagggaucuuccccuggauacuaaccuguauauccgaggaaauggcauucagaacuaucuguguucugguuggaguuuucauuuguagcaucugcguaaagggauccucucagccccaagcgcgcgucuaccucacuuucgaugaacuacgugagacgaaaacuuccgaauacuucagucuaucucaccacccacuugacuaucgaauucugcuuauggacgaggaucaggauagaauauacguaggaagcaaggaccauauucugaguuuaaacauuaauaauaucucccaggaggcccucagcguauuuuggccugcuucaaccaucaaagucgaggaaugcaagauggcuggaaaggacccuacccauggcugugggaacuuugugagagugauucagaccuucaauaggacacaccucuauguaugcggcuccggcgcuuuuucccccguguguaccuaccugaaucguggacgacggucugaagaucaaguauucaugauugacuccaagugugaaaguggcaagggacgguguucuuucaaucccaaugugaauacaguuucaguuaugauuaaugaggagcuguucagcggaauguauauagacuuuauggguacugacgccgcaauuuucagaagucuuacaaagagaaacgccgucaggaccgaccaacacaacucuaaguggcugucugaaccuauguucguggaugcacacguaauacccgauggaaccgacccuaaugacgcgaagguguauuuuuucuuuaaggagaagcuaacugauaauaauaggagcacaaaacaaauccacucuaugauugcaagaaucugccccaaugacacuggagggcugcguucucugguaaauaaauggaccacauuucugaaggcuagauugguguguucuguaacagaugaagacggccccgagacucacuucgaugaacuagaagacguguuccugcucgaaaccgauaacccucggaccacccuuguguacggcauauucaccacuucuucuucaguuuuuaagggcuccgcuguuugcguguaccaccucucggauauccaaaccgucuuuaaugguccauucgcccauaaagaagguccaaaccaucaacucauuaguuaccaaggacgaauuccauauccacgucccggcaccugcccaggaggagccuucaccccuaacaugagaaccacuaaggaguuuccagacgauguggucacauucauucgcaaccacccccugauguauaauagcauauacccuauucacaaaagaccucugaucguuagaauugggacagauuacaaauacacaaagaucgccguagaucggguuaaugccgcagauggaagguaucaugugcuguuucugggcaccgacaggggcacugugcagaaaguagugguguugccaaccaauaauagcguguccggcgagcuuauccuggaggaacuggaaguauucaagaaucacgcuccgauuacuacuaugaagauaagcucaaaaaaacagcagcuguaugucucgucuaaugagggugucucucaagugagccuccaucgcugccacauauacgggacugccugcgcugauugcugccuugcccgggaccccuacugcgccugggauggccacuccuguucgcgcuucuacccuacaggaaaaagacggucacgucgccaggaugugagacacggcaacccccugacacaguguagaggguucaaucuaaaagccuauaggaacgccgcugaaauuguucaauacggggugaaaaauaacaccacuuucuuggaaugugcccccaagucuccacaagccuccauaaaauggcuucuucaaaaggauaaagacaggcguaaagaagugaaauuaaaugagagaaucauagcaacuucccaaggacugcugauaagguccguccaaggcucagaccaagggcuguaccacugcauugcaacugagaacucuuuuaagcagacuaucgcaaagaucaauuucaagguacucgacuccgaaaugguggccguggugacggauaaauggagcccauggaccugggccucuucugucagagcucuccccuuccauccaaaagauauuaugggcgccuuuucccacagugaaaugcaaaugauaaaucaauauuguaaagacacccgccagcagcaccaacaaggagacgaaucccagaaaaugaggggagacuacggaaagcuuaaggccuugaucaacucucguaaaucgcggaauagaaggaaccagcugccugaaaguuag

SEQ ID NO: 15004 - RNA, 942 nt, Artificial Sequence
  Description of Artificial Sequence: Synthetic coding sequence
augccaggcuggcuaacucuuccaacccugugucgauuccuccuaugggcuuuuacaauauuucacaaagcgcaaggugaccccgcaagccacccaggaacuaccccacccucauauaaagugagguggucuaagguugaacccggcgagcugagagaaacgcugauacucauuacaaauggucugcacgccagggguuacggaccacuuggagggagggcucguaugagacgcgggcauagguuagacgccucauugguuauagcuggcgucaggcuggaggacgaagggcgguaccguugcgaguugauuaauggaaucgaggacgaaucugucgcucuuacauugucucuugaaggagugguuuucccuuaccaaccuagcagaggaagauaccaguuuaauuauuacgaagcuaagcaggcuugcgaggagcaggauggcagguuagcaacuuauagucaguuauaccaagccuggacugaaggacuggacugguguaaugcuggcuggcugcuugagggcucaguaagauaucccguucuaacagcuagagcgcccugcggcggccgcggaagacccgguaucaggaguuauggaccuagagaucgaaugagagacagguacgaugccuucugcuucacuagugcucuugcuggccagguguucuuugugcccggccgacugacucuuagcgaagcucacgccgcuugccgaagaaggggggccguggucgccaaagugggccaccuguaugccgccuggaaguuuagcggccucgaccagugugacggaggcuggcucgcagacgggagcgugcgguuucccauuacuacacccagacccagaugcggaggacugcccgauccugguguacgauccuucggauucccccgcccacagcaggccgccuauggaacauauuguuacgccgagaauuag

SEQ ID NO: 15005 - RNA, 1089 nt, Artificial Sequence
  Description of Artificial Sequence: Synthetic coding sequence
auggcauggaccuucgaaugcucucgcacuaccagcccggagccgcuaaguacuagcccuugccguacgacuucaucaaggaacucacccaccaugucuuguccugcuagugucgccugcgagccaucuacauccaccaccacgucuaguccuccaaaagccugucucacccgcccgucuuccccuucuccaucuugcagcacuuccgccuggcacaacaaaaauaaccugauuucgaaaguacccagaggggcucucuccaggcaaacccaacucagggagcuguaucuucaacacaaccagcugacagacucagggcuggacgcaaccaccuucucuaagcugcauucacucgaauaccuggacuuaucccacaaucaacuuacaaccgugcccgcaggccugccacgaacccuggcaauucuccaucucggucggaacagaaucagacaggucgaggccgcuagacugcacggcgcuagaggacucagguaccuucuccuccagcauaaucaacuuggcagcucaggccugccagcgggagcucuucgcccauugcggggguugcacacccuccaucuuuacggaaauggcuuggauagagugcccccugcucuucccagacgauuacgcgcccugguccucccucacaaccauguugcugcuuuaggugcuagagaccuggucgcaacgccuggccucacugaacugaaucucgcuuauaaucgccucgccuccgccagaguccaccaccgcgcguuuaggcgcuugcgagcacugcgcagccucgaccuugccggcaaccagcucacucgccuccccaugggccugccaacugggcugcgaacgcuucaguugcagcggaaccagcugagaauguuggagccagaaccgcuggccggacuggaucaacuccgggaacuuagucuggcccacaacagauugcgggugggggauaucgguccaggaacauggcaugaauuacaagcauuacagguuagacacagauuaguuucucauaccgucccacgggcuccacccucuccuugccuccccugucacgugccgaacauacuggugagcugguag

SEQ ID NO: 15006 - RNA, 900 nt, Artificial Sequence
  Description of Artificial Sequence: Synthetic coding sequence
augcuccacccagaaacaagucccggaagaggccacuuacucgcuguauugcuagccuugcuaggaaccgcuugggcagaagucuggccuccccagcuucaggagcaggcccccauggccggggcauuaaacagaaaagaguccuuccuccugcuuagucugcauaaccggcuccgcucgugggugcagccucccgccgcugacaugagaagacuggacuggucugauucacuggcucagcucgcccagggcucuccacuguggaauccuaaucccgaacccggugucagaccugucgcucaucccgcgagcggccuugaacaugcagcagcuccccgagccuggugcccuuugagcaaguggagccugugguuugccgagggucagagguauucacaugccgcuggggagugugccaggaacgcaacaugcacucacuauacacagcucguuugggccaccagcagccaacucggaugcggacgccacuuaugcagugccgggcaggcagcaauugaagccuuugugugcgcuuacucgccaagaggcaauugggaaguaaacggaaaaacaaucgucccuuacaagaagggcgccugguguagucuuugcacugccucagugucagguugcuuuaaggcuugggaucacgccggaggacuuugcgaaguaccucggaauccuugcagaaugucaugccagaaccacggacgucuaaauauuuccaccugccacugucacugucccccuggcuauaccggucguuacugccaaguuagguguuccuugcaaugugugcacggccgcuuucgcgaggaggagugcagcugugugugcgauauaggcuacgaacccaguguacccccgaggugcauuuuccccucaacaccugugacuuag

SEQ ID NO: 15007 - RNA, 1047 nt, Artificial Sequence
  Description of Artificial Sequence: Synthetic coding sequence
augcuugauacuaaucugauucuguugccccuuuuccaguuuauugucccaaaggaauggaauucuaaguacaggccugucuguauccacuuggcugguacuggagaucaucauuacuggagacgucgcacuuuaauggcacgcccaaugauuaaagaggcuaggauggcuucucuguugcuggagaaccccuauuacggcugccgaaaaccuaaagaucaagugcgaucuagccugaagaacguguccgauuuauuugugauggguggagcccugguucucgagagugccgcuuuguuacacugguuggaacgcgagggguauggcccuuuagguaugacagggauuucuauggggggccacauggccucuuuggcagucucuaauuggccaaaaccaaugccacugauaccuugcuugucuuggucuacagcaucaggcgucuucacaaccacugauucuuuuaaaaugggacaggaauucguuaagcacuucaccagcagcgccgacaaacucacaaaccucaaccuggucucccgcacccucaaccuggacauaucuaaucagguggucagucagaaaccagccgauugucauaauagcaguaaaaccuccgugagugccacuagcgagggacuacuacugcaagauaccucuaaaaugaaaagauucaaccagaccuuaagcacaaacaaaucgggauauacaagccguaauccucagaguuaccaccuccucaguaaagagcagucaagaaacaguuuaagaaaggagucacugaucuuuaugaagggaguaauggacgaauguacacauguggcgaauuucagugucccagucgacccuucacugauuauuguggugcaagcaaaggaggaugccuauauaccaagaaccggggugcggucacugcaggaaauuuggcccgguugcgagauacgguaucuggagggugggcauaucagugcuuauuuauucaaacaaggguuauucagacaagcaauuuacgacgccuuugaucgauuuuuacauaaguaugcgaacuag

SEQ ID NO: 15008 - RNA, 1044 nt, Artificial Sequence
  Description of Artificial Sequence: Synthetic coding sequence
augcgugcaugcauaucccucguucuagcugugcugugcggccuggcuugggcggaccucuacucggccccaaccucaugucaggggaggugcuaugaagcauuugacaaacaccaucagugccauuguaaugcucgaugucaggaauuuggcaauuguuguaaggacuucgagucuuuguguagcgaccacgagguaagucauucaagugacgccaucaccaaagaagagauccagagcaucagcgagaaaauuuacagagcagauacaaauaaggcccagaaggaagacauuguguugaacucccagaacugcaucagcccuucagagacacgaaaccagguugaccggugucccaaaccacuguuuaccuauguaaaugagaaacuguuuaguaagccaacauacgccgcuuuuauuaaccuucuaaauaauuaucaaagagcaacaggccauggcgagcauuuuucagcucaggaacucgccgagcaggaugccuuccuaagagaaauuaugaagacugcugucaugaaggaacuguauucuuuuuuacaccaccagaauagauacggcagcgagcaggaguuugucgacgaucuuaagaacaugugguuuggccuguauucucgcggcaaugaggaaggcgauucgucaggauucgaacacguguuuagcggggagguuaagaagggaaaggugaccggguuucauaacuggauacgauucuacuuagaggagaaagagggacugguugacuacuauucacauaucuacgacggaccaugggacagcuauccagauguucuagcuaugcaguucaacugggacgguuauuauaaggagguagguucggcuuuuauugggucuuccccagaguuugaauuugcgcuauacucucuaugcuuuaucgcccggcccgguaagguuugccagcucucccucgguggauacccccucgcugucaggacauacaccugggacaaaucuacauauggcaauggaaaaaaguauaucgcgacagcuuacaucgucuccucaaccuag

SEQ ID NO: 15009 - RNA, 864 nt, Artificial Sequence
  Description of Artificial Sequence: Synthetic coding sequence
augcucaaaaaaaucucugucggcguugccggggaucucaacacagugaccaugaaacucggcugcguccucauggcaugggcccuuuacuuaucucugggggucuuauggguagcgcagauguuguuagcagccuccuucgagacauugcagugugagggcccuguuugcaccgaagaaagcucuugucacacagaggacgaccugaccgaugcccgggaggccggguuccaggugaaagcauauaccuucagugagccauuccaccuaaucgucucguaugaacuuuuucccgccccuaucuugagagcagucccuucugccgaaccccaggccgggagcccgaugacccugagcugucaaacuaaacugccccugcagagaagcgccgcccgccuacuuuucucuuucuacaaagacggucggauuguccaaagucgcggacuuucaucagaguuucagauucccacggcuuccgaagaucacagugguaguuauuggugcgaagcugccaccgaagauaaucagguguggaagcaaucgccucaacuggagaucagaguacagggcgcuuccuccagcgccgcccccccgacacuaaauccugcaccccagaagucagccgcuccugguacugcaccugaagaggcacccggaccuuuaccgccuccccccacgccaaguagugaagaucccgguuuuaguucuccccucggaaugcccgacccucaucuuuaccaucagaugggccuacugcugaagcacaugcaggacguaagagugcugcugggucaccuacuuauggaacucagggaacucaguggacaucggaaaccuggcacuacuaaagcaaccgcggaguag

SEQ ID NO: 15010 - RNA, 1815 nt, Artificial Sequence
  Description of Artificial Sequence: Synthetic coding sequence
augaugcgcgcuguuugggaagccuuagcggcacuugccgccgucgcgugccuggucggcgcaguucgcggaggacccggccugucgauguucgcuggacaagccgcccagccugacccgugcagugacgagaauggacauccuaggagauguaucccagauuuugugaaugcugccuucggcaaagacguccgggucucuucaaccugcggucgcccucccgcccgauauugcgucgugagugagcguggagaagagagacugcgaaguugucauuuguguaaugccucugaucccaagaaagcccacccuccugccuuucugaccgaccugaauaacccccacaaccugacuugcuggcagucagaaaauuaccuucaguucccucacaacgugacccugacacuuagccuagggaagaaguuugaagucacauacgugucccugcaauuuugcucaccucggcccgaauccauggcaaucuauaaaucaauggauuauggcagaaccuggguaccuuuucaauuuuauaguacgcagugccgcaagauguauaaccgcccccaccgagcacccauaacgaagcaaaacgaacaagaggcuguauguacugauucccacaccgacaugcgcccgcuuucugguggccucaucgccuuuagcacccuggacggcagacccuccgcacaugacuuugauaauucaccagugcuucaggauugggucacagccacugacaucaggguggcuuuuucucggcugcauacuuucggugaugagaacgaagacgacagcgagcucgcaagggauucuuauuuuuaugccguauccgauuugcaagugggcggcaggugcaaaugcaauggccacgcagccagauguguaagagacagagacgacucauugguuugcgacugcaggcauaacacugcuggcccagaaugugaucgcugcaaacccuuucauuaugaccgcccauggcagcgugccaccgccagagaggcaaacgaaugcgucgcauguaacugcaaucugcacgcucgacgaugccgguucaauauggaauuguacaaauuaaguggucggaaaucagguggcgugugcuugaacugcagacacaacaccgcaggacgccacugccauuauuguaaggaagguuacuaucgagauauggguaagccuaucacucauaggaaagcuugcaaagcuugcgacugucacccaguaggagcggcaggcaagacuuguaaucagacuacgggccaaugccccugcaaggauggcgugaccggcauuaccugcaaucgcugugccaagggguaucagcaaucaagaucacccauagcucccuguauuaagauuccaguggcccccccgacgacugccgccucgaguguugaggaaccugaggacugcgacucauacuguaaagcuuccaaagguaagcugaagauaaacaugaagaaauauugcaagaaagacuacgcuguucagauccacauccucaaagcugauaaggccggcgacugguggaaguucacuguuaacauaauuagcgucuauaaacaggggacuucacgaauuagaaggggggaucagaguuuguggauccggucaagagacaucgccuguaaaugcccaaaaaucaaaccucucaagaaauauuuguugcucgggaacgccgaagauucacccgaccagucaggaauuguggccgacaaaucuagccucguuauccaguggcgagauacaugggcaaggcgucugcggaaguuccaacagagagaaaagaaggguaaguguaaaaaggcuuag

SEQ ID NO: 15011 - RNA, 1005 nt, Artificial Sequence
  Description of Artificial Sequence: Synthetic coding sequence
augaggagcgcaggcgggcgcggagagauuaaagugcggagagaauuacagcccucuaagcaggugagcggacugaccaaucacgcucguacuggacaggagaaacgaaaccugcagcggcugguguuagaaaccccuucacagaauaucuucuuuaguccugucagcgucaguacgucuuuagcuauguugucccugggugcccauagugugacaaaaacacaaauacuccagggccugggauuuaaccuaacucacacccccgaauccgcgauacaccaaggauuucagcaccuggugcauucacucaccguaccguccaaagauuugacacuaaagaugggaucugcacuguucguuaaaaaggaacuccagcuucaagccaauuuuuuagggaacgugaaaaggcuuuacgaggccgaaguguucagcaccgauuuuucuaaucccucuauugcccaggcucguauuaacucucacgugaagaagaagacccaggggaaaguaguagacauuauccaaggacuggaucugcuuaccgcgaugguacuagucaaucacauauuuuucaaggcaaagugggaaaagcccuuucauccagaauauacaagaaagaauuuccccuuucuggucggggaacaggucacagugcaugugccaaugaugcaccagaaggaacaauucgcuuucgggguggauacggaacuuaacugcuucguacuucaaauggacuauaaaggcgacgcggucgcuuuuuucgugcugccuagcaaggguaagaugagacagcuggaacaggcucugagcgccaggacacucaggaaauggucacacucacuccagaaaagauggauagaagucuuuauccccagguucagcauuucugcuucauacaaucuggagaccauccugccuaaaaugggaauccaaaacguguuugacaaaaaugcagacuucucuggaauugccaaaagagacucucuccaaguguccaaagugagcuag

SEQ ID NO: 15012 - RNA, 1065 nt, Artificial Sequence
  Description of Artificial Sequence: Synthetic coding sequence
auggccccagcacgcagacccgcaggcgcucgacuccuguuaguguacgcuggccuuuuggcugcugccgccgccggcuuaggaucacccgaacccggagccccguccagaucacgcgcacggcgggaaccaccccccgggaacgagcugccuagaggucccggcgagagcagagcagggcccgcagcucgcccgccugaaccuacagccgaacgagcccauagcguggauccaagagacgcauggaugcuauuuguccgccagucugauaagggggucaauggcaaaaaaagauccagaggcaaggcgaagaaacugaaguucggucucccaggacccccugguccuccggggccucaaggaccuccuggaccuaucauuccccccgaagcucugcugaaggaguuccaacugcugcugaaaggagccguccgacagagggaacgcgcugagcccgagccaugcacuugcggaccggcuggaccaguggcggcuucacuggcucccgugagcgcaacagcaggugaagaugacgaugacguaguuggagauguucuugccuuacuggccgccccucuggcaccaggcccuagggcacccagaguugaggccgccuuucugugucggcucagacgcgacgcccucguggagcggagagccuugcacgagcuggggguauauuauuugccagacgcugaaggggcuuuucggagaggaccaggacugaacuuaaccaguggacaguaccgugccccaguagcaggauuuuaugcucucgccgcuacccuccacguggcacugggugaaccaccacgaagaggacccccucgaccucgcgaucacuugagacugcuuauuuguauacagucuaggugucagaggaaugccagccuugaggccaucaugggucucgaaagcuccagcgagcucuuuaccaucaguguuaaugggguguuguacuuacagaugggccaguggaccucagucuuuuuagauaaugcaucugguuguagccucacuguccgcucaggaucccacuuuucagccgugcuguuaggcgucuag

SEQ ID NO: 15013 - RNA, 2685 nt, Artificial Sequence
  Description of Artificial Sequence: Synthetic coding sequence
augagucugccccgcuguuguccccauccgcuucgucccgaaggcaguggugcgaugggcccagaagcucucucaucuuugcuccuacucuugcucguggccucuggcgaugccgauaugaagggacauuucgauccggcuaaaugucgauacgcccucggcaugcaagauagaaccauccccgacucugacaucucugcuaguucauccugguccgacuccacugcugcucggcauuccaggcuggaauccucagauggcgacggcgcauggugucccgccgggaguguguuuccuaaagaggaagaguaccuucaggucgaucuucagcggcuccaucucguugcauuaguggguacucagggcagacacgcuggugggcuggguaaggaguuuagucgaagcuaucggcugagauauucacgugauggacggcgauggaugggauggaaggacaggugggggcaagaaguaauuucuggcaaugaagaccccgaaggaguuguacucaaggaccuagggccaccaaugguggcucggcuugugcgguuuuaccccagagccgaccgcguaaugagcgugugucuacgcguagaguuguauggcugccuuuggagagaugggcuacugagcuauacggcaccugucggccagacaauguaucuauccgaggcagucuaccucaacgauagcacuuaugauggucacacagugggaggcuugcaauacggcggacugggucagcuggcagaugguguaguggggcuggaugacuuuaggaagucacaagagcuaagaguguggccaggguacgacuacguugguuggaguaaccacaguuuuucaucuggauacguggagauggaguucgaauuugaucgacugagagcauuccaggcgaugcaaguacauuguaacaauaugcauacuuuaggagcccgguugccugguggcguggaauguagauucagaagaggaccagccauggcgugggagggcgagccuaugaggcacaaucucggcggcaacuugggugauccaagggcaagagccguaaguguuccgcucggcgguagaguugcccgcuuucugcaguguagauuccucuuugccggaccuuggcuguuguuuagcgagaucuccuucauuucugacguagugaacaacucaucccccgccuugggggggacguuuccacccgcucccugguggcccccaggacccccacccacaaacuuuagcucucuggaacuggagcccagagggcagcaacccgucgcuaaagcagaaggcagucccacugcaauccucaucgguugcuugguagcuaucauucuguuacugcuccucauuaucgcgcugaugcuauggcguuuacauuggaggagacugcuuucaaaggcugagcguagagucuuggaagaagaguugacuguacaucuguccguuccgggagacacaauacugauuaacaaucgccccggaccuagggaaccuccgcccuaucaagaaccucguccucgcggaaacccgccacacagcgcuccaugcguucccaacggcucugcauacucaggagacuacauggaacccgaaaaaccaggcgccccgcugcuccccccaccuccccaaaacagugugccacacuaugccgaagcggauaucgugacucugcagggggucaccggugggaacacauaugcgguccccgcccugcccccaggugccgucggcgacggccccccccgcguagacuuuccacggucacggcuuagauucaaagaaaaacuaggcgagggccaguucggagaggugcaccugugugagguugauuccccccaggaccuugucucguuggacuuuccacucaacgucagaaaaggacaucccuugcucgucgcgguuaagauccuccguccagacgccaccaagaaugcccgcaacgacuuuuugaaggaagugaagaucaugucuagguugaaagauccaaacaucauaagacugcugggagugugcguccaagacgacccucuguguaugauaacugauuacauggagaacggugacuuaaaucaguuuuuauccgcccaucaauuagaagauaaagcagcugaaggcgcuccuggugacggacaggcagcccaaggaccuaccauuagcuauccaaugcuucuacacguggcagcucaaaucgcaucaggcaugcgauaucuggccacacugaacuucguccauagagaccucgccacaaggaacugccucgugggggagaacuucacaauuaagauugccgacuuugggaugucuaggaaucuguaugcuggugacuacuauaggguucaggguagggcugugcuaccaauccgcuggauggccugggaguguauccucauggguaaguucacuacugccuccgacgugugggcuuucggcguuaccuuaugggaggugcugaugcuuugucgcgcucagccuuucggacagcucacagacgaacagguaauagaaaaugcuggcgaauuuuuucgcgaccaaggccgccaggucuaccucuccagacccccugcuuguccacaaggccucuacgaauugaugcugcgauguuggagucgggaauccgagcagcgcccgcccuucucccagcuccauagauuccuggcagaagacgcguugaacacugucuag

SEQ ID NO: 15014 - RNA, 2685 nt, Artificial Sequence
  Description of Artificial Sequence: Synthetic coding sequence
augucccugccccgauguugcccgcauccguugcguccugaaggaaguggcgcaauggggccugaagcacuuagcucccuccuuuuacuucuccucguagcuucuggcgaugccgacaugaagggucacuucgauccagcaaaaugccguuacgcuuugggcaugcaggauaggacaaucccugauucggauauuagcgcuucaaguucuugguccgauagcacagcugcaagacacagcagacucgagucgagcgauggugauggagccuggugucccgccggaaguguuuucccaaaagaagaagaguaccuccagguggacuugcaaagacugcauuugguggcucucguggguacucaggggagacaugcaggcggauugggcaaggaguucuccagaagcuauagacuuagauacucccgggaugggagaagauggauggguuggaaggacagauggggccaggaagugauaagcgguaacgaggaccccgagggaguugucuugaaggaucuggggcccccaauggucgcccgccuggugcguuuuuauccacgagcugaucgaguuaugucagugugucugagagucgaacucuauggcuguuuauggagggacggauugcucucauauacugcaccaguaggccagaccauguaccucagugaggcaguguauuugaaugacucaacuuacgacggacauacaguggggggauugcaauacggaggacuagggcaauuagcggacggggucguagggcuggacgacuuccggaagagucaggaguuacgaguguggcccggauacgacuacguuggauggagcaaccacuccuucagcaguggauauguggaaauggaguucgaguucgacaggcugagagcuuuucaggccaugcagguccacuguaacaauaugcauacucugggggcuaggcucccagguggagucgagugcagauucagaagagguccagcaauggccugggagggagagccaaugcgccacaaccuggguggaaaccucggagauccuagggcacgcgcugugucugucccccuaggaggucgaguugcgcguuuucugcagugucgguuccuguucgccggacccuggcugcuguuuucugaaauuagcuuuauaucugacgugguaaacaacucuucgcccgcacuaggaggcacauuuccaccugcgccuugguggccgcccgguccucccccuacgaauuuuaguagucuggaguuggagccaaggggccagcaaccgguugcuaaagcugaaggcucuccaaccgccauccugauaggaugccuaguugcaauuauauuacuucuguuguugauaauugcccucaugcuguggagacugcacuggagacguuuacugagcaaagccgagcggagaguuuuagaggaagagcugaccgugcauuuaucagugccaggugacacaaucuuaaucaauaaucgcccuggcccccgcgaaccuccaccauaccaggaaccuaggccaagaggcaacccuccgcauucugcacccugcgugccaaacggauccgccuacuccggugacuauauggaaccagagaagccuggugccccucuccugccuccuccuccucagaauucaguaccccacuacgcagaagccgauauagugacccuacagggugugacaggagggaauaccuaugcuguuccagcucuuccaccuggcgcuguuggagacggcccgcccaggguagauuucccccggagcagguuaagauucaaagagaaacucggugaagggcaauucggcgaggugcaucugugugaagucgacuccccacaagaucugguuagucuugauuuuccgcugaauguucguaaggggcacccacuauuaguggcugugaagauccugcgucccgacgcaacaaaaaacgcaaggaacgauuuuuugaaggaggucaaaaucauguccagacucaaagacccaaauaucauacgccuguuaggaguuugugugcaagacgacccucucuguaugauuacagauuauauggaaaauggcgaccugaaccaguuuuugucagcucaccagcuugaagacaaagccgcugagggugccccaggcgauggacaggcugcccaaggacccaccauauccuaucccaugcugcugcauguggcggcccagauugccagcgguaugcgauacuuggcuacacuuaauuucguccauagggaccucgcuacaaggaauugucugguuggagaaaauuucacgauuaaaauugcagauuucggaaugagucggaaucucuacgcuggugacuauuauagaguucaaggacgagcugugcucccuauacgguggauggcaugggaguguauucuaaugggcaaauuuacaacugccuccgacgugugggcauuugggguuacucuaugggaagugcucauguugugucgugcucagccuuucggacagcugacggaugagcagguuaucgagaaugcgggugaguuuuucagagaccagggaagacaaguauaucugucacguccacccgccugcccacaaggacuguacgagcuuaugcugcgcugcuggucucgugaaucggaacagcggcccccguucucccaauugcauagauuccuugcugaagaugcacugaauaccguguag

SEQ ID NO: 15015 - RNA, 2886 nt, Artificial Sequence
  Description of Artificial Sequence: Synthetic coding sequence
augcuuuugcucuuacugcuggcuccacuguuucuucgaccaccgggagcugguggugcucagacucccaacgccacuucugaaggcugucagaucauucauccaccgugggaaggcgggauaagguaccgugguuuaacucgggaucaggugaaggccauaaacuuucucccaguggacuaugagaucgaguauguguguaggggcgaacgagaagucgugggaccaaagguucggaaaugucuggcaaauggaagcuggacugacauggacacaccuagccgaugugugaggauuuguucaaagucuuacuuaacgcucgaaaauggcaaagucuuucuuaccgguggggaccucccugcacucgauggcgcucgcgucgacuucaggugugauccagacuuucaucugguuggaaguagccgguccauaugcucgcagggucaguggagcacucccaagccucauugccaggucaacaggacuccccauucagagcgccgagccguuuauauuggcgcguuguucccuaugucugguggauggcccgguggacaggcgugucagcccgcuguugagauggcccuugaggacguuaacucucggcgugacauacuucccgacuacgagcugaagcuuauccaccacgacagcaagugcgacccuggccaagcgaccaaguaucuuuaugaauugcuguacaacgauccgauuaaaauuauccuaaugccaggaugcucuucugugaguacauugguggccgaagcugcccguauguggaacuugaucgugcucuccuacgggucuaguagcccugccuuaaguaacagacagcgcuuuccaacuuucuuuaggacccauccuucagccaccuugcauaaucccaccagagugaaacucuuugagaaguggggcuggaagaaaaucgcuacuauacagcagacuacggaggucuucaccaguacccuugacgaccuugaagagcgagugaaggaagcggggauugagauuaccuuuagacagucguuuuuuucagacccagcugugcccguuaaaaaucuuaaacgccaagaugcacgaauuauagucggcuuauucuaugaaacugaggcaaggaaaguguuuugcgaggucuacaaggaaagacuguuuggaaaaaaguauguuugguucuuaaucgggugguacgcugacaauugguuuaagauuuacgauccuucgaucaacugcacaguggacgaaaugacugaggcuguugagggacauauuacuacagagauugugaugcuuaauccugcaaauacuaggaguauuuccaacaugacuucccaggaauucguggaaaagcucacaaaacgacuaaaacgccacccagaagaaacgggaggauuccaggaagcaccucuggccuacgaugcuaucugggcucucgcccuugcacucaacaaaacuucaggaggaggcgguagauccggggugagacucgaagacuuuaacuauaacaaccaaaccaucaccgaccagauauacagggccaugaauaguuccagcuucgagggcgugaguggacacguuguguuugacgcuucagguucccggauggcuuggaccuuaauugaacagcuccaaggugggucauacaagaaaauuggguauuaugauucuaccaaggacgaucuuagcugguccaaaacagacaaauggauugguggaagcccccccgcagaucaaacccuggucaucaagaccuucagguuccugagucaaaagcucuucauuagugugagugugcuguccucucuugguaucguccucgcuguaguuugucuuuccuuuaauaucuauaauucgcacguucgguauauacaaaacucccagccaaauuugaauaaccugacugccguugguugcucccucgcucuggcagccguauucccucucggccucgacggcuaccacauuggacgcaaucaguuuccguucguuugccaagcccgguugugguugcuuggacucggguuuagccuuggcuaugguuccauguucaccaagauuugguggguccauaccguauucacaaagaaggaagagaagaaagaauggagaaaaacucuggaaccauggaagcuuuacgcaacagugggcuugcuuguggggauggacgugcugaccuuggcgauuuggcagaucguggacccucuucaucggaccauugaaaccuucgcaaaagaggagccuaaggaagauaucgacguguccauuuugccccagcucgaacacuguucaagccgaaaaaugaauacauggcugggaauuuucuauggcuauaaagggcuccuucuacugcucggcaucuucuuagcauaugaaacuaaaucugucagcaccgaaaaaaucaaugaucacagggccgucggaauggcaauuuacaacguugcaguacuaugcuuaaucaccgccccgguuaccaugauucugucuucucaacaggacgcugcguuugcauuugcuucccuggccauaguguucaguuccuauauuacacucgucguacuguucgugcccaaaaugcgccggcucaucacccgcggggaauggcagagcgaggcccaggauacuaugaagacggguagcuccacuaacaauaaugaggaagaaaagaguagacugcuggaaaaggaaaaucgggagcuugaaaagaucaucgccgagaaagaggagagaguaucagaacuacgucaccaacugcagaguaggcagcaguuaagaucccgacgccaccccccaacaccaccagaaccuuccggcggucucccacguggccccccagaacccccagaucgccucuccugcgacggcucacgggugcauuugcuguauaaauag

SEQ ID NO: 15016 - RNA, 2559 nt, Artificial Sequence
  Description of Artificial Sequence: Synthetic coding sequence
augcugccaacagaaguaccccaaucucaccccggaccaucugccuugcucuugcuucagcugcuucuucccccaacuucugcuuucuuuccuaauaucuggucccugcuugcagcccccggaagcaucacccaccaagaccucacugaggaagcagcacuuaacgugacguuacaguuguuucuugaacagccucccccaggcaggccaccccugcgacuggaagacuuucugggccggacccuucucgcagaugaccuguuugccgcuuauuucggccccgguuccagcagacgauucagagcagcuuuaggcgaggugucucgggccaacgcugcacaggacuuccuuccaacauccaggaacgaccccgauuugcauuucgaugccgaacgccucgggcaagggagagcuagacuugucggugcccugagagagacagugguugccgcuagggcccuugaccauacccucgcucggcagcgcuugggcgccgcacugcaugcacuccaagacuucuacucucacucuaacugggucgaguuaggggaacagcaaccccacccucaucuguuguggccacgccaggaguuacaaaauuuagcucagguggccgauccuacauguagcgauugcgaggagcuguccugcccuagaaacuggcuuggcuucacccuccuaaccuccggguauuucggcacccacccccccaaacccccaggcaaauguucucauggugggcacuucgaucggaguucaucccagccucccaggggcggcauaaauaaagacucuacuucgcccggcuuuucaccgcaccacauguuacaucugcaggcagcaaaauuggcauuguuagcaagcauacaggcuuuuucucuacuuaggucccgacugggggacagggauuuuaguagauuacucgacaucacgccugccucuucccucaguuuuguccuugauacgacuggaagcaugggcgaagaaaucaacgcggccaaaauucaagccagacaucucguugaacagcggcgcgggucccccauggaaccggugcacuauguccucgugccguuucacgaccccggguuuggcccaguguuuacuaccagcgaccccgauuccuuuuggcagcaauuaaaugagauacaugcauugggaggcggcgaugagccagaaaugugccuaucagcucuacaacuugcucuccuccacacccccccccucagcgacaucuuuguuuuuacagacgccucuccaaaagacgcguuccugaccaaccaagucgaaucccuuacccaagaaagacgcugucgaguuaccuuccucgugaccgaggacaccagccguguucaaggaagagcccgccgcgaaauccuguccccacucagguuugagcccuauaaggcgguggcacucgcaagcgguggggaggugauuuuuacaaaggaucaacacauuagggauguugcugccauuguaggcgagucuauggccgcacucguuacucucccguuggauccuccaguagucguaccaggucagccucucguuuucaguguggacgggcugcugcaaaaaaucacggugcgaauccauggagauaucagcagcuuuuggaucaaaaauccugcaggcgugucacaagggcaggaagaaggggguggaccucucggacauacacgccgguucgggcaauuuuggauggugacaauggacgaccccccccagacugggacaugggaaauucaggucacugcagaagauacacccggcguucgcguacaagcccaaacaucucuggauuuccucuuccacuucggaaucccuauggaggauggcccacaccccggacuauaucccuuaacucagcccguggcaggacuucagacucagcuccucguggagguaacugggcucgggucacgcgcgaaccccggugacccacaaccucacuuuucucacguaauccugcguggaguccccgaaggagccgagcucggccaggugcccuuagagccagugggaccuccugagcgcggacuccuugcagccucacuguccccuacccuguuaaguaccccucgaccuuucucacuggaguugaucggccaggaugcugccgguaggcgacuccaccgcgcugcuccucaaccaucuacggucgucccugucuuacuugagcugucaggacccucugguuuucucgcccccgggagcaaggucccuuuaagucugaggauugccaguuucuccgguccacaagaucucgaucucagaaccuucgucaacccauccuucucucuuacauccaaccucagcagagcacauuuggaauugaaugagagugcguggggcagacuuuggcuugaagugccugauucggcugcgccggauagcguagucaugguuacggugacagcuggaggaagagaagcuaaucccgucccaccuacccaugcauuuuugagauuacucgugagcgccccugcuccucaaguucgcaaccacuacuuuccaucucagggucccgcccaccacccauacaggcucauuuag

SEQ ID NO: 15017 - RNA, 756 nt, Artificial Sequence
  Description of Artificial Sequence: Synthetic coding sequence
augccccaucuagccucucucuucacugcuucguccagguguugcccccaucccuugcgaccugaaggaucuggggcuauggggccugaggcccuuucaucauugcugcugcuccuucugguugccucuggagaugcugauaugaagggacauuucgacccugcaaaauguagauaugcacugggaaugcaagacaggaccauacccgauagcgacaucuccgccuccucaaguuggucagauucgaccgccgccagacauucacgacucgagucaagcgacggagacggcgcuuggugcccagcgggcucaguguucccuaaagaggaggaguauuuacagguggaccuacaacguuuacaucuggucgcccucgugggcacucagggccgacacgcuggcggcuuggguaaagaguucucacggucauaccgguugagauauuccagggauggcaggcguuggaugggauggaaagauagaugggggcaggaagugaucucggguaaugaagauccugaaggagugguuuuaaaagauuuaggcccaccaauggucgcaagguuggugagguuuuacccacgggcugaucgggugaugagcgucuguuugagaguggaacuguauggcugucuguggcggggagaauggcugucauuucuaggaauuugcuuccuguccagaggacuugagggcggagaguguggagagugggccucucggauacccaguccggcagggaaacuaagucuguag

SEQ ID NO: 15018 - RNA, 726 nt, Artificial Sequence
  Description of Artificial Sequence: Synthetic coding sequence
augaaauucauccugcucugggcacuuuuaaauuugacgguggccuuggcauucaaucccgauuauacagucuccucuacgccacccuaccuuguuuaucucaaaucugauuaccuucccugugccggcguauugauucauccacugugggugauuacugcagcccauugcaaucuuccgaagcugcgcguuauucuggguguaaccauaccugccgacaguaaugagaaacaucuccaagugauaggauaugaaaagaugauacaucacccucauuuuuccgugaccaguauugaccacgacauuaugcuaaucaaacugaagaccgaagcagaauugaacgacuacgugaaacuggccaaucuccccuaccagacuauuucagaaaacacuauguguagcguguccaccuggucuuacaacguuugugauaucuauaaggaaccagacagucuccaaacagugaauaucagugucauuagcaagccccaauguagggaugcuuacaaaacuuacaacaucacggaaaauauguuaugugucggaaucgugccgggcaggcggcagccauguaaagagguaucagcagcaccggcuaucugcaauggcaugcuacaaggcauccucucauuugccgacgguugcguucuaagagcagacguaggaauuuacgcaaaaauuuuuuauuacauccccuggauugaaaacguuauacagaauaacuag

SEQ ID NO: 15019 - RNA, 1536 nt, Artificial Sequence
  Description of Artificial Sequence: Synthetic coding sequence
auggccaagggacucucgguacagaacgauaagcaccccgguuaccagccagcacugcuacuuucaccuggagccccucuguuugccgacggaccagcuuaugcccuguuacauuuauugcugcacgaggggaaagcugaaauggcagaucaagccgccgccuggcugacucggcaggguuccuuccaagggggcuuccggucaacucaggauacagugauugccuuggacgcauuaagcgcuuacuggaucgcuucccacaccaccgaggaaagaggguuaaacgugacccugaguaguaccggccgcaaugguuucaaaagucaugcacugcagcugaacaaucgacaaauccgaggucuugaagaggagcugcaguucagccuugggagcaaaaucaauguaaaagucggagggaauaguaagggcacacucaaagugcugcggacuuacaauguucuggauaugaaaaauacuaccugccaagaucuacagauagaaguaacagugaaaggacacguugaguacacaauggaggcgaaugaagauuacgaggacuacgaauacgacgagcugcccgccaaggacgaucccgacgcuccucugcaacccgugacuccauugcagcuguuugagggcagaaggaacagacgcaggagggaagcaccaaaggucgucgaagaacaggagagccgaguacauuauaccguuuguauauggagaaacgggaaagugggucugucuggcauggcuaucgcagaugugacgcuacuguccggcuuucacgcucugagagcagaucuugaaaagcuuaccagccuuuccgacagguauguuucccauuucgagacugaaggcccucacgucuuauuguacuuugacagcgugccaacaucaagagagugcguuggauucgaagcaguccaggaggucccaguagggcucguccagcccgccuccgcuacacuauaugacuauuacaaccccgaacgcagauguuccgucuuuuacggcgcuccaagcaaaagucgccuauuagccacccuguguuccgccgaaguuugccaaugugcagagggcaaaugucccagacagagacgcgcccuggaacggggucugcaggacgaagacgguuaucguaugaaguucgcguguuacuacccacgcguugaguacggauuccaggucaaggugcuacgcgaggacucuagagccgccuuccgccucuucgagacaaagauuacccaaguacuccauuuuacaaaagauguaaaggccgcagccaaucagaugcgaaauuuucugguccgugccucuugucgguuaagacuugaaccuggaaaggaguaucuuaucaugggccucgauggcgcaacuuacgaccuggaaggacauccacaauauuuacuagauucuaacaguuggauagaagagaugccauccgaaaggcucugccgguccacacgccagcgggcagcuugcgcacagcuaaaugauuuucuucaagaauacggaacucagggcugccaaguauag

SEQ ID NO: 15020 - RNA, 2067 nt, Artificial Sequence
  Description of Artificial Sequence: Synthetic coding sequence
augcuucccaccgaagucccgcagucccaucccggucccucugcauugcuguuauugcaacuucuccuuccaccuacuuccgccuucuucccaaacauuuggagccuauuggcagccccaggauccaucacacaccaggaccucaccgaggaggccgcucucaauguuacccuucaacuguuccucgaacaaccgccaccuggccgccccccuuugcgguuggaagauuuccucggacggacacuccuggcggacgaccuuuucgcagcuuacuuuggaccaggcucaagccgacgguucagagccgcucuaggagaagugagucgagcuaaugcagcccaggauuuccugccuacuucuaggaaugacccagaucuacauuuugaugccgaacgcuuaggccagggcagagccagacuugucggcgccuugcgugaaacggugguggccgcccgcgcacucgaccauacccuugcacggcaacgacuaggagccgcacuucacgcccugcaggacuucuacagucacucuaacuggguagaacugggcgagcagcagccucacccacacuugcuguggcccaggcaggaacuacagaaucuggcacaggucgcagacccaaccugcuccgauugcgaggaauuaaguugcccgcgcaacugguuaggguucacauugcugacauccggauacuucggcacccaucccccaaaaccucccgggaaauguagccacggcggccauuucgaccguucaucaucccaaccuccccgcggcggcaucaauaaggacucaacuucaccaggauuuuccccacaucauauguuacacuugcaagccgccaaauuagcacugcucgcuagcauccaggccuucucccugcugagaucacggcucggggaucgggauuuuucaagacuacuggauauuacacccgcaaguucucugucauucguacuggacaccacuggcucuaugggggaggaaaucaacgcagcgaaaauacaggcgcgccacuugguugagcagagaaggggcucaccuauggagcccguacauuacguuuuagugccuuuucaugacccuggauucggcccagucuucacaacaagcgacccggacucuuuuuggcagcaauugaacgaaauacaugcucucggagguggggacgagcccgaaaugugucuguccgcacuucagcuggcccuucuccauacuccaccucuauccgacaucuuuguuuucaccgacgccucucccaaagaugcuuuucugacgaaucaggucgagagucuaacccaagaaagacggugcagggucacuuuuuuggugaccgaagauacaucucgcgugcaaggucgggccaggcgagaaauccugucuccccuuagauuugaacccuacaaagccguggcauuggcaagcgggggcgaaguuauuuuuaccaaggaucaacacauucgggacguugcugcgauugucggugagucaauggcagcccuggugacccucccauuagauccuccagugguuguacccgggcagccucuuguuuuuagcgucgauggcuugcuucagaaaaucacggugagaauacauggagauauuucaagcuuuuggaucaaaaacccagcaggcguuucucaaggccaggaggaggggggagguccucuaggucacacacgucguuuuggccaguuuuggaugguaacuauggacgacccaccgcagaccggcacgugggaaauucagguaacagcagaagacaccccuggagugagggugcaggcucagacuucccuggacuuccuguuucacuuugguauaccuauggaggaugguccccacccuggguuguacccccuuacgcagccaguggccggccuccagacccagcuccugguagagucucagucuuggggaucuuccgcagcguuuuuaccucggcacccuaguaggggaccccgcggaugucgcacgaggcccggcgccuugggugcaagaggaacaucaggggcuagaucaccccggucccuagccgucgcucaugcagccgugcacccuuag

SEQ ID NO: 15021 - RNA, 2559 nt, Artificial Sequence
  Description of Artificial Sequence: Synthetic coding sequence
augcugccuacagaagucccacagucacacccaggaccuucugcucuacuuuugcuucaguuacuccucccacccacauccgccuuuuuccccaauauuuggucccugcuagcagcccccggaucaaucacacaccaggaccucacugaggaggcagcccuuaauguuacacugcaauuguucuuagagcaaccaccgcccgggagaccgccuuuacggcucgaagacuuccugggccgcacgcuacuagcugaugaccuuuucgcugcauacuucggaccaggcaguucaagacgguucagggcagcccuaggagaggugagucgggcaaacgcggcccaagacuuucugcccacuucaagaaaugaucccgaccuucacuucgacgcggagaggcucggucaggguagagcaagacucguaggagcacucagagagacaguuguagccgcacgugcucuggaccacacacuggcuagacaacgacugggugcggccuugcacgcucugcaggauuuuuauagccacucgaacugggucgagcucggugagcaacagccccauccccaucuguuauggccgcgacaggagcugcaaaaccuagcccaaguugcggaccccacguguagcgacugugaagaacuguccuguccucgaaacugguuaggauucacacugcuuacgagcggcuauuucggcacccauccccccaaacccccaggaaaaugcucccacggugggcacuucgauaggucaagcagccagccuccacguggugggaucaacaaggauagcacuucucccggcuucaguccacaucauaugcuccauuuacaggcagccaaacuugcccuccuggccucuauucaagcguucucccugcugaggagcagacucggugacagggacuuuagccggcuacuggacauuaccccagccuccucccucaguuucguuuuggauacuacaggcucaaugggcgaagagauuaacgccgcgaagauucaagcccgccaccugguugaacaacgcagaggcaguccgauggagccugugcauuacguucuugucccauuccacgacccaggcuucgguccuguuuuuacuaccuccgacccugacuccuucuggcaacagcugaacgaaauacacgcccucggggggggugaugaaccugagaugugccucuccgccuuacaacuggcacuacugcauacacccccccuuucagauauuuucguguucacugacgccagcccaaaggaugccuucuugaccaaucagguagagaguuugacccaggagaggagaugucgggugacguuccuggugaccgaggauacuuccagaguccaaggacgcgcccgcagggagauacugucaccgcuaagauucgaaccuuacaaggcuguagcccuggcaaguggaggagaggugauauuuacuaaagaccagcauauuagagauguggcugccaucguaggugagucuauggccgcccugguuacacugccccucgaccccccaguuguggugcccggacaaccucuaguuuuuucagucgauggccugcuucagaagauuaccguacgcauccauggugauaucagcuccuucuggauaaaaaaccccgccgggguuagccagggccaggaagagggaggaggcccucucggacauacuagaagauuuggccaguucuggauggucacuauggaugaccccccacagaccggaaccugggagauccagguuacagcagaagacacacccggcguccgagugcaggcccaaaccucauuggauuuucucuuucacuucgggauucccauggaagauggaccccacccaggacuguacccucugacccaaccaguagccggccuucagacucaacuguugguggaggugaccggccucggcagcagagccaaccccggagacccccaaccgcauuuuagccauguuaucuugagagggguucccgagggagcugaacugggccaggucccuuuagagcccguuggacccccugaacgaggauugcuggcugccagccucuccccaacccuacucuccacccccaggccuuuuucucuugagcucauuggacaagaugccgccggaagaagacugcaucgcgcggcuccucaacccuccacaguagugccaguucuguuagaacucucaggcccaucaggcuuucuagcccccgguuccaaagugccuuuaucauuacgcauugcauccuuuucaggaccucaggacuuagaccugagaaccuuugucaauccgucuuucucccucaccagcaacuugagccgugcacacuuggagcugaaugaaucagcauggggacggcuguggcuagaggugcccgauucugccgcccccgacuccguugugauggucaccgugacugccggcggaagggaagccaauccagugccccccacccacgcguuccugcgcuugcuuguuucugccccagcuccccaaguucguaaccacuauuuccccagccagggcccugcacaucauccauauaggcugaucuag

SEQ ID NO: 15022 - RNA, 1737 nt, Artificial Sequence
  Description of Artificial Sequence: Synthetic coding sequence
augcuguugcuuuuacuguuagccccccuuuuccucaggccuccaggcgcugggggagcucagacuccaaaugcaacauccgaagggugccagauuauacacccgccaugggaaggcggaaucagguacagaggacugacgagagaccaggugaaagcuauaaauuuucugcccguggauuacgagauugaauacgugugcagaggagaacgugaaguggugggccccaaagugagaaagugccuagcgaacggcucuuggacagauauggauacccccucaaggugcgugcggauuugcucuaaaagcuaccuaacucuggagaacggcaagguauuucugacgggcggggaucuuccggcacucgauggugcucgcguggauuuccgcugugaccccgacuuucaucuugucggcagcucuagaagcauuugcucccagggacaaugguccaccccuaagccccacugccaggucaauaggacuccucauuccgagcguagagcaguuuauauuggcgcccuuuuuccaaugagugguggauggcccggcggccaggcuugucagccagcuguagagauggccuuagaggaugugaauucgagaagagauauccugccagacuacgaguugaaauugauacaucaugauuccaagugcgacccaggacaggcaacgaaguauuuguaugagcugcuguacaaugauccuauuaaaauuauucucaugccaggauguucaucuguguccacuuuaguugcugaagcggcaagaauguggaaucugaucguauuguccuacggcaguucuagccccgcccuuagcaaccgccagcguuuuccaacuuucuuucggacucacccaagcgcaacacuacauaaucccaccagaguuaaacuguuugaaaaaugggguuggaaaaagaucgcuacaauucaacagacaacugaaguguucacuagcacacucgaugaucuggaagagagaguaaaagaggcugguaucgaaaucaccuuccgccaguccuucuucucggaucccgcugucccugugaagaaucugaaaaggcaggacgcucgcauuauagucggacuguucuacgaaacugaagccagaaaaguguucugcgagguuuacaaagaacgacuguucgguaagaaauacguuugguuccugauugguugguacgccgacaacugguucaaaauauacgacccaucaaucaauuguaccguggaugagaugaccgaggcagucgaaggacacauuacaacugaaaucgucaugcugaacccugcaaacacccgaaguauuucaaacaugacuagucaggaguucguugagaagcuuaccaagagacugaagagacacccagaagagacuggcgguuuccaggaagcuccccuagcauaugacgcgaucugggcacuugcucuggcccucaauaagaccagcggaggcgguggaagaaguggcguucgguuggaggauuuuaauuacaauaaucaaacuaucaccgaccaaaucuauagagccaugaauucaucaucuuucgagggcguuucuggccacgugguuuucgacgcaucuggaagcaggauggcauggacauuaauugaacaacuccagggggguuccuacaagaaaauugguuacuacgauucuacaaaagaugaucuaagcuggucuaaaaccgauaaguggauagucauuucucgcacucauuccccaacguag

SEQ ID NO: 15023 - RNA, 1326 nt, Artificial Sequence
  Description of Artificial Sequence: Synthetic coding sequence
auggaauucgaauucgaucgacugagagcuuuucaggcaaugcaaguccauugcaacaacaugcauacacuuggagcacgacugccaggaggcgucgaaugucguuuuaggagaggccccgcaauggccugggaaggcgagcccaugcggcauaauuugggcggcaaucugggggacccaagggcacgagcagugucagucccucugggcggucgaguggcucgguuccugcaaugucgcuuccuguucgcaggcccguggcugcuguucagcgaaaucuccuucauuucugaugugguaaauaauuccucuccagcccuuggaggcacuuuccccccagccccgugguggcccccagguccccccccuaccaauuucucaucacuggaacucgaaccacgcggccaacaaccuguggccaaagccgaggggagucccaccgcuauacucauaggcuguuugguggcaaucauucuguugcuccugcugaucauugcccucauguuguggagguugcauuggagacgccugcugagcaaagugcucgagucccauccacgcaccaggucaccuggccuaguaggcaucagacccacacccuugcccgugaguccgauggcacuccgaugcuguagccccauucaacccaccgccuccuucuggccauuaaccccagucccgcuugaggcgcgcgcgccgccgcacccccccggacccaacccccccacaccgaggggugucacugggggaaauacauacgcugugccugcucugccccccggcgcuguuggagacggacccccaagaguggauuuuccaagaucaagacugcgauucaaggagaagcucggugaaggccaguuuggcgaaguacauuugugugaaguggauagcccucaagaccugguauccuuagacuuuccacuuaaugugagaaaaggacacccccuccucgucgcugugaaaauauugaggccagacgcaacuaagaacgcacggaaugauuuccugaaggaagugaaaauuaugagucgacugaaagauccgaauauuauuagacuccucggcgugugcguacaggaugacccucuuugcaugauuacugacuauauggaaaauggagacuuaaaucaauuccucagcgcccaccagcucgaagacaaggcggcggagggugccccaggggacgggcaggcugcgcagggaccaaccauaucuuauccaaugcuacuccaugucgccgcccaaauagccuccggaaugcgguaccucgcaacucugaauuucgugcacuuuuggggcgaaaggcaccgcuuucugcauuag

SEQ ID NO: 15024 - RNA, 2685 nt, Artificial Sequence
  Description of Artificial Sequence: Synthetic coding sequence
augucucuccccagauguugcccccacccccugaggccagagggcuccggagccaugggaccugaagcccuuucgucgcugcugcugcuucuccuuguggccaguggagacgccgauaugaaagggcacuucgauccugcuaaaugccguuacgcacugggcaugcaagacagaacgauccccgacucggacaucucugcaucgucuaguuggucugauucaacagcugcuagacacucacgccuggaaucuuccgauggcgauggcgcuuggugcccagcuggaagcguuuuuccaaaggaagaggaguauuuacaggucgaccuucagcgccugcaccucguugcgcuggucgguacgcaggguagacacgcugggggacuugguaaagaauuuagccgcucuuacagacuaagauauucacgggauggcaggcgguggaugggguggaaagaucgcuggggacaggaagugauuuccgguaacgaagauccugaaggcguugugcugaaagauuuagggccccccauggucgcgagacucguaagguucuauccccgcgcugaccggguuaugagcguuugccugcgaguggaguuguauggaugccuuuggagggaugggcugcugucuuacaccgcacccgugggucagaccauguauuuaucugaagcgguguaucugaaugacuccacauacgacggucauacuguggguggcuugcaguacgggggacucggacaacucgcggaugggguggucggauuggacgauuuucgaaaaucccaagaacuuagagucuggccuggcuacgauuacgugggaugguccaaucacucuuucucaucgggguaugucgagauggaauucgaauuugaccggcuucgcgcuuuccaagccaugcaggugcauuguaauaauaugcacacacuaggggcccggcugccagguggaguggaguguagguuucggcgggguccagcuauggcaugggagggagagcccaugaggcacaacuuggguggcaaucugggcgauccaagagcacgcgcagugucaguuccacucggcggcagaguagcgcguuuucugcaguguagguuccucuucgccgggcccuggcuguuguuuucugaaaucucuuucauaucagauguuguuaacaauuccuccccugcucuaggaggcacuuucccgcccgcuccuugguggccacccgguccccccccuaccaacuucucuucacuugagcuagagccacgcggacagcaaccagucgcuaaagcagaaggaagccccaccgcuauacucauuggcugcuugguugcuauaauacuucugcuccuccucauuauagcgcugauguuguggcggcugcacuggcggaggcugcugagcaaggcugaacgacggguucuggaagaggaacucacugugcaucuuaguguccccggcgauacuauacuaauaaauaauaggccaggcccucgcgagccaccaccguaucaggagccccgcccaagagguaauccgccacauuccgcccccugugugccuaacgggucggccuacucgggugacuauauggaaccagagaagccaggagcucccuuacugcccccacccccgcagaacucagugccacacuaugccgaagcagacaucguaacacuccagggcgugacaggcggcaacaccuaugccguuccugcccuccccccgggcgcagucggugauggccccccacggguugauuucccaaggagcagauugagauuuaaggaaaaacugggagagggccaauucggggaagugcaucugugugaggucgacagcccccaggaccuugucaguuuggauuuuccucugaaugugaggaagggccauccccuccuugucgcugucaaaauuuugagaccagaugccaccaaaaacgccagaaacgacuuccuuaaagaagugaagauuaugucccgguuaaaggaucccaauaucauuagacuacucggcguuugcgugcaggacgauccauuguguaugauuaccgacuacauggaaaauggugaucugaaccaguuccucagcgcacaucaguuagaggacaaggcugcugagggagccccaggagacgggcaggcggcacaggggccaacaaucagcuauccuauguuacugcacgucgcagcacaaaucgcaucagggaugagauauuuggccacucugaacuuuguccauagggaucuugcaacccguaauugccucgugggcgagaacuuuaccauaaaaaucgccgacuuuggaaugucacggaaucuauaugcuggagauuauuaccgaguacagggucgggcagucuugccgauucgguggauggccugggaaugcauucuuauggguaaauucacaacugccuccgacgucugggcuuuuggagugacacucugggagguguugauguuaugucgcgcccaacccuuuggccaauugacagaugagcagguuauugaaaaugcaggcgaauucuucagagaucagggaagacagguguaccucucaagaccgccggcgugcccccaaggccucuacgagcuuaugcugagaugcugguccagggaaucagagcaacggcccccuuucucgcagcuucacagguucuuagcggaggaugcucugaacaccguauag

SEQ ID NO: 15025 - RNA, 216 nt, Artificial Sequence; identical to SEQ ID NO: 13386
  Description of Artificial Sequence: Synthetic coding sequence

SEQ ID NO: 15026 - RNA, 2760 nt, Artificial Sequence
  Description of Artificial Sequence: Synthetic coding sequence
auggguccggaagcccugagcagucuucucuuacuacuucucgucgcuagcggugaugccgauaugaagggacauuucgauccugccaagugcagauacgcccuugguaugcaagacagaacaauaccagauuccgacaucucagccucaucaagcuggucugauaguacagcggccagacacucucgacuggagagcagcgauggcgacggggccuggugcccugcggggucaguuuucccaaaagaagaagaguaucuccagguagauuugcagcgccugcaccuuguggcacugguaggaacccaaggacgacaugcuggaggacugggcaaggaauuuagcagaagcuaccggcugagguauaguagagacggccgacgguggaugggcuggaaagacaggugggggcaggagguuauuagcggaaacgaggacccugaaggagucgucuuaaaggacuuggggccccccaugguagcucggcuuguuagauuuuauccuagagccgaucgugugaugucagucugccugagaguggagcucuacggauguuuauggcgggacggauuguuaagcuauacagcuccugugggccagacaauguaccucuccgaagccgucuaucucaacgauaguacauaugacggacauaccgucgguggacugcaguauggagggcuggggcaacuggcugauggaguggugggccucgacgacuuucggaaaucucaggaauuaagagucuggccaggauacgacuaugugggauggagcaaccauagcuucucuucaggguauguggaaauggaguucgaguuugaucgguuaagagcguuucaggcuaugcagguucauugcaauaacaugcacacacugggcgcacgucucccugguggcguagagugcagauuccgcaggggccccgcuauggccugggaaggcgaacccaugaggcacaaccugggaggcaaucucggcgacccacgggcccgugcuguuagugugccacuuggcggaaggguugcccgguuucuccaauguagauuccucuucgcagggcccuggcuuuuauucuccgaaaucuccuuuauuucggacgucguaaacaacucuuccccagcacucggcggaaccuucccucccgcaccaugguggccaccaggacccccccccacaaacuuuucuucccuugagcucgagccacgcggccagcaacccgucgcaaaagccgagggaucuccgaccgccauccugauuggaugucugguugcuaucauacuuuugcuacugcucauuauagcucuuaugcucuggcgacugcacuggcgccggcuccucucuaaggcugaacgucgcguucucgaggaggagcucaccgugcaucugucuguacccggagauacaauucugaucaauaaucggccugggccuagagaacccccacccuaccaagagccccgaccacguggaaacccuccccacagcgccccuugugugccuaacgguucugcucugcuucugucaaauccugcuuaccgucuguugcuugcuacauaugcgcgcccaccacgggguccaggccccccuaccccagccugggcaaagccaacuaauacccaagcguauucuggcgauuacauggaaccugagaaaccuggcgccccgcugcuccccccaccuccacagaauuccguaccccauuaugccgaagccgauauugugacccugcagggagugaccggcggcaauaccuacgccguacccgcccuuccuccuggagccguuggagacggucccccccguguugauuucccaaggucuagacuaagguuuaaggagaaacuaggcgaagggcaauuuggugaggugcaccuaugugagguagacucaccacaggaucuugugucccucgacuuuccccugaaugugcgaaagggucacccucuccugguggcggugaagauucugagacccgaugcuaccaagaacgccagcuucagucuguucagccggaacgauuuccugaaagaagugaagauuaugucacguuuaaaggacccuaauauuauucgccuucugggcgugugcguccaagacgauccacuuuguaugauuacugacuacauggagaauggagauuuaaaccaguuucugucugcacaucaacuggaagauaaagccgccgagggagcuccaggagaugggcaggcagcccagggcccaacuauuuccuacccuaugcugcugcacgucgccgcucagaucgcuaguggaaugcgcuaucucgccacucuaaacuuuguucacagggacuuagccacacguaauugcuuaguuggugaaaauuucacaaucaaaaucgcagauuucggcaugucuagaaacuuguaugcgggugauuauuaccggguccagggucgcgcaguccugccuauuagguggauggcuugggagugcaucuugaugggaaaguuuaccacugccucagacguuugggccuucggcguaacccucugggagguauugaugcuuugucgugcccagccauucggacagcuuacagacgaacaaguaaucgaaaacgccggggaauucuucagagaucagggucgacagguguaucugucccggccaccugcaugcccacagggauuguacgaacucaugcugcgcuguuggaguagggagagugaacagcggcccccguucucccaguuacaucguuuccucgccgaagacgcauugaauacaguuuag

SEQ ID NO: 15027 - RNA, 447 nt, Artificial Sequence
  Description of Artificial Sequence: Synthetic coding sequence
augcagaccuuucccguggccggagcauuagacccugcaauucucgacacuuccuccccucaggcuuuauacacuguacuccugaucguguugguuaugaugagccugguguucggcaaauucguaccugugaauugggaaccuccucagccgcugccauuuccaaaauaucugcgaugcuaucgcugccucuuagaaaccaaagagcugggcugucuucucggaucugauaucugucugacaccagccggcuccucauguauuaccuugcauaaaaagaacucaaguggauccgacgugauggucucugauugccgcucuaaagaacagaugagcgauugcucgaauacccgaaccucucccgucucuggauuuuggaucuucucacaauacuguuuccucgauuuuugcaacgacccccagaauaggggccucuacacaccuuag

SEQ ID NO: 15028 - RNA, 5097 nt, Artificial Sequence
  Description of Artificial Sequence: Synthetic coding sequence
augagacugcuguggggacucauuugggcaucuucauucuucacgcugucauugcaaaaaccucggcuacuccuguucucucccucuguuguacaucucggggugccgcugagugugggcguccaguugcaagacgugccucgaggucaggucgugaaagguagcgucuuucugagaaacccgucccgaaacaaugugccuuguagucccaagguggacuuuaccuuaucaucugaacgcgauuuugcucuacuaucccuccaggugccccugaaggacgccaaauccugcggacuucaucagcuucugagagggccagaaguucagcugguugcacacucccccuggcugaaggacucacuuuccagaacaaccaauauucagggcaucaaucuucucuucaguuccagacgaggccacuuauuucuccagaccgaucagcccauauauaacccgggccagcgagugcguuauaggguguuugcauuagaccagaaaaugcgcccaaguaccgauacuaucacugugaugguggaaaacucccacgggcuuagaguccggaaaaaggaaguguauaugccaucuaguaucuuccaggacgauuuugucauaccagauaucucagagcccggcacuuggaagauuucugcccgcuuuagugauggucucgaaagcaauagcucaacccaguucgaagugaagaaauauguccugccuaauuucgagguuaagaucacccccgguaaaccguacauccuuacugugccaggucacuuggacgagaugcagcuggacauccaggcaagauauaucuauggcaaaccuguacagggcgucgccuacgugcgauucggacuucucgacgaagaugggaaaaaaacauucuuuagaggacuggagagucagacaaaacuagucaaugggcagucacacauuucccuguccaaagccgaauuucaagaugcgcuggagaagcucaacaugggcaucacagaccuacaggggcucagacuguaugucgcugcugcaaucauagaauacccuggaggggagauggaagaggcagaacucacaucaugguauuucgucagcucaccauucagccuagacuuaaguaagacaaaaagacaucuuguccccggagcuccuuuccugcugcaagcucuuguccgcgaaauguccggcucacccgcaucuggcauccccgugaaaguguccgccacaguaaguaguccaggaucggugcccgaagugcaggauauccagcaaaauaccgacggaucuggacaggugucuauucccauaaucaucccacagaccauuucagaacugcaacuauccguauccgcuggcaguccccacccugccauugcccgguugacaguggcugcgccacccuccggagguccugguuuccuaagcauugaacgaccugacucucggccuccuagaguaggagacacucuuaaccuuaaccugagagcuguuggcucaggugcuaccuucagccauuauuauuacaugauuuuauccagaggccaaauuguguucaugaacagagagccaaaaaggacacugacaucuguaagcguuuucguugaccaucacuuagcacccucauucuauuuuguggccuuuuauuaucacggagaccaucccguggccaacagccuaagaguggacguccaggccggggccugcgaaggcaaauuagagcugagcguugacggagcaaagcaauauagaaacggggagaguguuaaacuccaccuagagacagauucacucgcacucguugcucuuggcgcacuggacaccgccuuguacgcggcuggcucuaagucacauaagccacuaaacauggggaaagucuuugaggcuaugaauuccuacgaucucggauguggacccggagggggggacagugcccuccaaguuuuucaagccgccggccuggcuuucagcgacggagaccaauggaccuuauccaggaaacgccugucauguccuaaggagaaaacaacccgaaaaaagcguaacgugaacuuucagaaagcaaucaaugaaaaguugggucaguaugcaaguccuacugcuaagagguguugccaggacggcgucacaagacuaccuaugaugagauccugcgagcagcgcgcagcccggguccaacagccugacugccgcgaaccuuuucuaagcugcugucaguuugcugaaagccugagaaagaaguccagagauaaaggacaagccggacuacaacgggcacuggaaauucuucaggaggaagauuuaauagacgaagacgauaucccaguccgcuccuuuuucccugaaaauuggcuuuggagagucgaaaccguggaucgcuuccagauucuaacucugugguugccagauucauugacuaccugggagauacacgggcuuucucuaucaaaaaccaaaggacuaugcguagcuacucccguucaguuaaggguguuuagagaguuccacuugcaccugagauugcccaugaguguucgcagguucgaacaacuugaacugagacccguuuuauauaauuaccuggauaagaacuugacuguaucuguacaugugaguccaguagagggacuguguuuagcagggggaggaggacucgcccaacaggugcuggugccugccggcucugcucguccaguggccuucuccguugugccaacagcagcugcagcggugucacuaaagguaguugcuagaggcagcuuugaauuuccggugggcgaugcgguguccaaagugcuccaaauagaaaaggaaggcgcaauccacagagaagagcugguguaugaacugaauccgcucgaucaccggggccguacccuagagauuccuggaaauucugacccaaacaugauccccgauggugauuucaauagcuaugugagagugaccgcuuccgacccucucgacacguugggcagcgaaggggcccugucaccaggugguguggcaucccugcugcguuugccaagaggguguggggaacaaacaaugaucuaucucgccccaacacuggccgccucacgguaccuagacaagacagagcaauggagcacccuccccccggagacaaaagaccacgcuguugaucuuauucaaaaaggguauaugagaauccagcaguuucguaaggcugacgggagcuacgccgcauggcuuagucgaggaucuagcaccuggcugaccgcauuuguucuaaaaguucuuucucuagcacaggaacaggucgggggcucaccagagaaauuacaagaaacaucuaauuggcugcucucucagcaacaggcggacggcagcuuccaggaccugucccccguaauccauagauccaugcaaggaggacuuguuggcaaugacgagacaguggcccugacagcauucguuacgauugcuuugcaccauggcuuggcaguguuccaagacgagggugcggaaccucugaagcagagaguugaagcuuccauuucuaaagccuccucauuuuugggcgaaaaggcuagcgccggacuccugggggcccacgcugcagcaauuacugccuaugcccucacccucacaaaagccccugcagaccucagggguguggcacacaacaaccuaauggcuauggcucaagagaccggcgauaacuuguacuggggcucuguuacaggaagucagagcaaugcuguuucaccuacacccgcucccagaaauccuucugacccaaugccucaggcucccgcccucuggaucgaaacgaccgcauacgcacugcuacaccucuugcugcaugaaggcaaggcagaaauggcugaucaggccgcagcuuggcugacucgucaagguuccuuccagggcggcuuccggucuacacaggauacaguuaucgccuuggaugcauugagugccuacuggauugcuucucacaccaccgaggagcgcggauugaacgugacccugucaucuacuggccguaaugguuuuaagucccacgccuugcaacuuaacaacagacagauuaggggguuagaggaggaguuacaguucucccugggcagcaagaucaacgucaaggucggcgggaauucuaaaggaacuuugaagguccuacgcaccuacaacgugcucgacaugaagaacacuacaugccaagaccugcagaucgagguuacuguuaagggccacguggaguauacgauggaggccaaugaagauuacgaggauuaugaguaugacgagcuaccagcuaaagaugacccagacgcaccccuucaacccguuacaccccuccaacuguuugagggacggagaaaucggaggagacgcgaagcgcccaaacugacgucccugagugauagauaugucucccauuucgaaacagaaggcccacacgugcugcuguauuuugauaguguccccacgucucgggaaugugucggcuucgaggcugugcaggaagucccagugggcuugguccaaccagcauccgccacucucuaugauuacuacaacccagaacgccgauguagcgucuucuauggugcaccauccaaaucccgccuucuagcaacucugugcucagccgaaguuugccaaugugcagagggcaagugcccccgccagagaagagcccuggagcgcggacuccaagacgaggacggauaccggaugaaguuugcuuguuacuacccuagaguugaguacgguuuccagguaaagguacuaagagaggauagcagggcggcuuuucgccuguuugagaccaaaauuacccagguuuugcauuucacuaaggaugugaaagcugccgcuaaccaaaugagaaauuuccuggugcgcgcaucguguagacugcguuuggagccaggcaaggaauaucuaauuaugggauuggauggagcaacuuaugaccucgaaggccacccacaguaccuauuagauuccaauucuuggaucgaagagaugccaucagagagauugugccggucuacaaggcagagagcagcaugugcccaguugaacgacuucuuacaggaguacgggacccagggcugucaggucuag

SEQ ID NO: 15029 - RNA, 1986 nt, Artificial Sequence
  Description of Artificial Sequence: Synthetic coding sequence
auggaccucguucucaagaggugucuccuucaucuagcggugauuggagcguuauuagccgucggugcaacuaaggucccucguaaccaggauugguuggguguguccagacagcuaagaacgaaggcuuggaaccggcaacuguaccccgaauggaccgaagcgcagaggcuugacugcuggcgaggaggccaggucagccugaaaguuaguaaugacgguccuacacugaucggcgcaaaugccucuuucuccauugcauugaauuuucccggcucucaaaagguccuaccggauggccaagugauuuggguuaauaacacaaucauuaauggcagccagguguggggaggacaaccaguuuacccccaagaaaccgaugacgcauguauuuuuccugaugguggaccauguccuucugggucauggagccagaaacgguccuucguguacguauggaagacauggggacaguauuggcaggugcuugguggcccugugaguggccucagcauuggcacgggacgggcuaugcuuggaacccauacuauggaagucacgguguaucacaggagagggagccguucuuacguuccgcuggcucauucuuccuccgcguuuaccauuacagaucaggucccguuuagcguaucuguuagccagcugagagcccuagauggcggaaauaaacacuuuuugcgcaaccaaccucugacuuuugcucuccaauugcaugacccaucuggguaccuggcagaggccgacuugucuuacaccugggacuuuggcgauagcucagggacgcuaauuucacgcgcccucguggucacucacaccuaccuugaaccaggacccgugacggcacagguugugcuacaggcagcuauaccacuaacuagcugcgguagcucuccaguccccgggaccacagauggacaucgcccaaccgccgaggcucccaauaccacugcgggucaagugccuacgaccgagguaguuggaacaacuccaggacaggcccccacggcugagcccucgggcacaacaucagugcaaguccccaccaccgaagugaucuccaccgccccaguccagaugccuaccgccgagagcacuggcaugacacccgaaaaggugccuguuagcgaagucaugggaacaacucuggccgaaaugucuaccccugaagccaccggcaugaccccugccgaagucucaauagugguccuaaguggcacaacggccgcccaagucacgaccacagaauggguggagaccaccgccagggaacuuccuauucccgaacccgagggaccagaugcuucaagcauuaugagcacagaaucuauuacagggagccuuggacccuuacuugacgggacggcaacccugagguuagucaagcggcaaguuccucucgauugcguuuuguauagauauggaucauuuucagucacgcucgauauuguucagggaaucgaaucugcugaaauuuugcaagccguuccaaguggggagggggacgccuucgaacugacuguguccugccagggggggcugcccaaagaggccugcauggagaucaguucuccugggugucagccaccugcucaaagacucugucaaccuguuuuaccuucuccugccugucaacuggugcuucaucaaauuuugaagggggggagcgggaccuacuguuuaaauguuagucuagccgacaccaacucacucgcugucguauccacccaacucauuaugccaggucaggaagccggccugggacaggugccacugaucguggguauccugcuaguacucauggcuguaguguuggcaagccugaucuacaggagaagacugaugaaacaagauuuuaguguuccucagcugccccauuccuccucucacuggcuaagacuuccucgaauuuucuguucuugucccauuggagagaauuccccuuuacuguccggacagcaaguguag

SEQ ID NO: 15030 - RNA, 516 nt, Artificial Sequence
  Description of Artificial Sequence: Synthetic coding sequence
augaggcacaaucuuggaggcaaccucggcgacccccgugcacgggccguuagcguuccacuuggaggccgaguggccagauuuuugcagugccguuuucuuuuugcaggaccaugguugcuguucucagagaucuccuuuaucuccgauguggucaauaacuccucuccagcucugggcggcaccuucccuccggcccccugguggccucccgguccuccucccaccaacuuuuccagucuagaacuggagccccgcggucaacaaccuguggccaaggccgagggcagcccuacagcuauucuaauuggaugccuuguggcuauuauacuccugcugcuguuaauaaucgcacugaugcuguggcgauugcacuggaggaggcuccucucuaagguccuagagucacacccccgaacaaggaguccuggacuggucgguauuagacccaccccucuuccugucucuccaauggcacucguccaccucugcgaagucgacucuccucaggauuag

SEQ ID NO: 15031 - RNA, 1986 nt, Artificial Sequence
  Description of Artificial Sequence: Synthetic coding sequence
auggauuuggugcuuaagagaugucuccuacacuuagccgugaucggcgcccuccuggccguuggggccacuaagguccccaggaaucaagacuggcuggggguaagcagacaguuacgcacaaaggcuuggaacagacagcuuuacccugaguggacagaggcccaacgucuggauugcuggagaggaggacaggugucauuaaaaguuucgaacgacgggcccacccuaauuggggcaaacgccagcuucucuauugcccuuaacuuuccugguucucagaaggucuuacccgauggccaggugauuuggguuaauaauaccaucaucaacggaucacaggucugggguggucagcccguauauccccaggaaacagaugaugcauguaucuuucccgaugguggcccuugucccucugggucuuggagucagaagagguccuucguguacgucuggaagaccugggggcaguacuggcaggucuugggggggccagucucuggucugucaauuggaacggguagagcaauguuaggaacgcacacuauggagguaacgguguaucacagaagaggaagcagaucuuacgugccacucgcacauagcucuuccgccuuuaccauuacagaccagguuccuuucagugugucaguaucccaacugcgggcacuggaugggggcaauaaacauuuccuucgcaaucagccccugacauucgcccuacagcuucacgacccuucuggauauuuggccgaggccgaucuaagcuauacuugggacuuuggcgauuccuccgguacacugauuucacgagcauuagucgucacacacacuuauuuggagcccggccccgugaccgcacagguaguucuccaggcagccauuccacugaccagcugcggaagcagcccagugccuggaacuacggauggccaucgcccaacugcagaagccccuaacacuaccgcaggccaaguuccuacuacagaaguggucggcaccaccccuggucaggcaccuacagccgaaccgaguggaacgaccuccgugcaaguccccacaacugaggugaucucaacugcaccggugcaaaugccuaccgcagaaagcacagguaugacccccgaaaaagucccuguuuccgaagucaugggcacuaccuuagcagaaaugagcaccccagaggcaacagguaugacaccggccgaagugucaaucguaguauuauccggaacaaccgcagcacaagugacuacuacagaguggguggaaacuaccgcgcgggagcugccuaucccagagccugaagguccugacgccaguucaaucauguccacagaaaguaucacaggaagucugggccccuuacuugacggaacugccacuuuaagacucguuaaacggcaggucccccucgauugcguuuuauaccguuacgggaguuuuagcgugacccuggauauugugcaggggauugagucugcagagauccugcaggcuguucccagcggcgagggugaugcauuugaacugaccgugaguugucaggguggacugccuaaagaagcuuguauggaaauaucuucgcccgguugccagccuccugcacaaagauugugucaaccugucuuacccucccccgcuugucagcuggugcuucaucaaauccuuaaaggaggcuccggcaccuauugucugaacgugagucucgccgacacuaacucucucgcugucgucaguacccagcuuauaaugcccggucaggaagcugggcucggccaggucccucuuaucgugggcauucuguuaguccugauggccgugguucuggcaucucugaucuaucguagaaggcucaugaagcaagacuuuagcgucccacagcugccccacucgaguucccacuggcugagacugccgcgaauuuuuuguucaugccccauuggugaaaauagcccccuccucaguggccaacaaguuuag

SEQ ID NO: 15032 - RNA, 1737 nt, Artificial Sequence
  Description of Artificial Sequence: Synthetic coding sequence
auguugcugcugcuacuacucgccccccuauucuuacguccucccggagcaggcggcgcgcagacuccuaacgcaacauccgagggcugucagaucauacaccccccaugggaaggcggaaucagauaccgcggccugacaagagaucagguuaaggcgauuaacuuuuugcccguggacuacgaaauugaauacgucugccgaggcgaacgagaaguagucggacccaaagugcguaagugccuggcaaacggcuccuggacugauauggacacuccaagcaggugcguaagaauuugcagcaaaaguuacuuaacucucgaaaauggcaaaguguuccugaccggaggggaucuaccggcacucgacggggcacgcguggauuuucgaugcgaucccgacuuucaccugguugggucuucucgauccauuugcucacagggccaguggucuacgccuaaaccacacugucaaguuaauagaaccccccacucggaaagaagagcuguuuacauuggggcauuauucccuaugucgggugguuggccuggcgggcaagcaugccagccugcgguggagauggcacuagaggacgugaacucucgccgugacauucugccagacuacgaauuaaagcuuauacaccacgauagcaaaugugaccccggacaggccacaaaauacuuauaugaguuacuauauaaugacccuauaaagauuauucugaugccagguugcaguucuguuagcacccugguugcugaggcugcacguauguggaaccugaucguccucuccuauggcagcagcagccccgcuuuguccaaccgccagcgcuuuccaacauuuuuuaggacucauccuucagccacucuacauaacccaacgcgugucaaacucuucgaaaaauggggauggaaaaagaucgcuacaauccagcagaccacugagguuuuuaccuccacacuugaugaucuggaagagcgcgucaaagaggcgggcauugaaaucacauuuaggcagucguuuuuuagcgaccccgccgucccggucaaaaauuuaaagagacaggacgcacgcauaauuguaggauuguuuuacgagacagaagcucgcaagguguuuugcgaaguuuacaaggaacgcuuguuugggaagaaguauguuugguuucucaucggaugguaugccgauaauugguucaagauauacgacccuaguaucaacuguacuguugacgaaaugaccgaggcaguggagggccauauuacuacagagauuguaaugcucaauccagccaacacgagauccaucaguaacaugacuucucaggaguucguugaaaagcugacaaaacgguugaagagacacccggaggaaacugguggguuccaagaagccccccuggccuacgacgccauuugggcccucgcccuagcucuaaacaaaacuagcggaggaggugguaggagcggaguucggcuggaggacuuuaauuauaacaaucaaacaaucacggaccagauuuauagagcuaugaauucuucaaguuucgagggagugagcggccauguuguuuucgacgcuucugguucccgaauggccuggacacugaucgaacaguugcagggaggcucauauaagaaaauuggguauuaugacuccaccaaagacgaucucucuuggucuaagacggauaaauggauugugaucucuaggacucacucucccacauag

SEQ ID NO: 15033 - RNA, 1326 nt, Artificial Sequence
  Description of Artificial Sequence: Synthetic coding sequence
auggaguucgaguucgacagacugagggcauuccaggcaaugcaagugcacugcaacaacaugcauaccuugggcgcccgcuuaccaggaggggucgaaugccgcuuucguagagguccagcaauggccugggagggagagccaaugcgccacaauuugggcggcaaccuuggggauccacgggcccgcgcagucucaguuccucugggggggaggguggcucgguuucuacaguguagauuuuuguucgcgggaccuuggcugcuguuuucugaaaucucuuucauaucagauguggucaacaacagcucccccgcucugggagguaccuucccccccgcucccugguggccccccggacccccuccuaccaacuuuaguucccuggaauuagaaccucgaggucagcaacccguggccaaggccgaggggucgcccacugccauucucaucggaugccugguggcuaucauccuguuguugcuucucauaaucgcacuuauguuguggagacugcauuggcgaaggcuucuaagcaaaguguuagaaucucaccccagaacaaggagcccaggccucgucgguauaagaccuaccccucuacccgugucacccauggcccugcgguguuguucucccauucagccaaccgcuucauucuggccccuaacucccguacccuuagaagcaagagcuccaccccauccccccggcccgaauccaccuacaccacggggcgugacuggcggcaauaccuacgcagugccagcucugccgcccggagcuguuggugacggaccgcccagaguggacuucccucgcaguagguugagguuuaaagaaaaacugggagaaggccaguuuggagagguccacuugugugaagucgacaguccacaggaucucgugucccuggacuucccccucaacguaagaaaagggcauccccuccuaguugcgguuaaaauccuccgcccagaugcaacaaagaacgcucggaacgauuuucugaaggaagugaagauuaugaguagacuuaaggaucccaauauuauccggcuucuaggagugugcguacaagaugacccccuguguaugaucaccgacuauauggaaaauggcgaccucaaccaguuucucagugcccaccagcucgaggacaaggccgcugaaggagcgcccggagacggucaggccgcccagggaccgacuaucucuuaccccaugcuccuccacguugcugcccagauugccagcggaaugagguaccucgcuacucuuaacuucguacauuucuggggcgaacgccaccguuuccugcauuag

SEQ ID NO: 15034 - RNA, 447 nt, Artificial Sequence
  Description of Artificial Sequence: Synthetic coding sequence
augcagacauuuccuguagccggcgcccuggacccagccauccucgacaccuccagcccccaggccuuauauacaguauuacuaaucguucucgugaugaugagccuuguuuucggaaaguuugucccaguuaauugggagcccccccagccccuaccauuccccaaauaucugagguguuauaggugccucuuggagaccaaggaauugggaugccuacuuggaagcgacaucugucucacucccgcuggaagcucauguauuaccuugcacaaaaagaacucaucaggcucugacguaauggucuccgauugucgauccaaagagcaaauguccgauuguagcaacacucgcacuucgccugugucuggcuucuggauuuuuucccaguauuguuuucuugauuucugcaaugauccacaaaauaggggcuuauacacuccauag

SEQ ID NO: 15035 - RNA, 732 nt, Artificial Sequence
  Description of Artificial Sequence: Synthetic coding sequence
auggguccugaggcgcucucaucacuacugcugcuucuuuuagucgccucaggcgaugcugacaugaagggccauuucgaccccgccaaguguagguacgcucucggcaugcaagauagaaccaucccugacuccgacauuagcgcauccuccuccuggagcgauagcaccgccgcccgccacucucgacuggagucuuccgacggcgauggcgccuggugcccagcagguuccgucuuucccaaagaagaggaauaccuccaagucgaccuucagagauugcacuuagucgcacucgugggaacacagggcaggcaugcaggagggcugggcaaagaguuuucccggaguuauaggcuacgauacagccgcgacggccggagauggaugggguggaaggaucgguggggucaagagguuaucucuggaaaugaagaucccgagggcgucguuuuaaaggaccucggcccuccuaugguagcuagacucguaagauucuacccgagggcugaucgggucaugucaguuugucuaagaguagaguuauacgggugccuguggcgggauuguaguaugggagucugggcaaguuggcagauggugugguggggguggaugacucugggacggguacgaucauguggguccgggcaagcaaugacaaugugggauggcgcuaccaccgcaagccccgucgcaauguggcgcuggucccuuucucugacugguuag

SEQ ID NO: 15036 - RNA, 732 nt, Artificial Sequence
  Description of Artificial Sequence: Synthetic coding sequence
augggacccgaagcucugucaaguuugcuguugcuucucuuagucgcuuccggcgaugcugauaugaaagggcacuucgacccggccaaauguagauaugcccugggcaugcaggaucgaaccauucccgacagcgacaucuccgcuuccucuucuuggagugacuccacagcugcacgacacucccgacuggagucauccgacggugacggugccuggugucccgccgguucggucuuuccaaaagaagaagaauaccugcaaguggaccuucagcgccugcaccucguugccuuggucggcacccagggucggcacgccggagggcuaggaaaagaauuuucgcgcaguuaccgucugcguuauucacgugauggcaggagauggaugggguggaaagaucgguggggucaagaagugauuagugggaaugaggaucccgaaggggugguacugaaggaucuaggccccccaaugguggcucguuugguuagauuuuauccaagagcugaucgcgucauguccguuugccuuagggucgaacuguauggaugucuguggagggauuguagcaugggagugugggccucuuggcaaauggugugguggggauggaugacuuugggccgaguuagaagcuguggcucuggacaggccaugaccaugugggacggugcgacuaccgcuucaccaguugcaauguggcgcugguccuugucuuuaacgggauag

SEQ ID NO: 15037 - RNA, 1224 nt, Artificial Sequence
  Description of Artificial Sequence: Synthetic coding sequence
augagacugcucgcuuggcugauuuuucuugcgaauuggggcggggcacgcgccgagccgggaaaauuuuggcacauugccgaccuacaccuggacccagauuauaaaguuagcaaagacccguuucaggucugccccuccgccggaucccagccaguucccgacgcuggccccuggggcgauuaucugugcgacucaccaugggcacucauuaacagcucuauuuaugccaugaaagaaauugagcccgaaccagauuuuauccuuuggacaggcgacgauaccccgcacguuccagaugaaaaacuuggagaagcggcuguccuugagaucgucgagcgccuuacuaaacugaucagagaagucuucccaggggccuuuuacugugaaaaguuacccggaccuuccggggccggacgcauugugguccuuaauaccaaccuuuauuauacaagcaacgcccucacggcugacauggccgaccccgggcagcaauuccaaugguuagaagauguucucaccgaugcaagcaaagcaggugacaugguguauaucguuggccacguccccccaggcuucuuugaaaaaacgcagaauaaagcaugguuucgggagggguucaacgagaaguaccugaaagucgugcggaagcaccaucgggugauagccggacaguuuuuugggcaccaccauaccgauucuuuuagaauguuguacgaugacgcgggagucccuauuagcgccauguucaucaccccuggcgugacacccuggaagacaacauugccaggcgugguuaacggggccaacaauccagcaauccgggucuucgaauaugaccgagcuacgcugucauuaaaggacaugguuaccuauuucaugaacuuaagucaggcaaaugcucagggcaccccucguugggaauuggaguaccagcucaccgaggcuuacggcgucccggacgcuucugcccauucuaugcauaccguucucgacaggauugccggggaucaaaguacccuccagcgauacuacgucuacaauuccguguccuacucggccggagugugcgaugaagcuuguucgaugcaacauguuugugcaaugcgacaaguugauauugaugcuuacaccaccugccuguacgccagcggcacgacucccguaccacaacuaccucuguuacugauggcucugcucggauuguguacucuugucuuguag

SEQ ID NO: 15038 - RNA, 756 nt, Artificial Sequence
  Description of Artificial Sequence: Synthetic coding sequence
augccacauuuagccagccuguucacagcuagcucucgaugcuguccucauccucucaggcccgaaggcuccggcgcgauggggcccgaagcacuguccagccuucugcuccugcuccuuguggcuucuggagacgcagacaugaaaggacacuucgauccagccaaaugcagauacgcuuugggcaugcaagacagaacaauucccgauuccgacauuucugcuucaagcagcuggagcgacucuacugccgcgagacacagcagguuggaaaguuccgacggcgauggcgcauggugcccugcuggcuccguguuucccaaagaggaagaguacuugcaggucgacuuacagaggcuacaucuggucgcauuggucgguacacaaggcaggcacgcuggcggguuggggaaggaauuuucacggucuuaccggcugcgguacucucgagauggucggagauggaugggauggaaagaucgguggggacaggaagucauaagcgggaaugaggauccggagggcguugucuuaaaggacuugggcccgccuaugguggcccgacuggugagauucuacccacgcgcugacagagugaugagugucugccuuagaguggaauuguacggauguuuauggagaggggagugguuauccuuucuaggcauuuguuuccuuucccggggucuagaaggcggcgaauguggcgagugggcaucacggauuccuucacccgcuggaaaguugucccuguag

SEQ ID NO: 15039 - RNA, 756 nt, Artificial Sequence
  Description of Artificial Sequence: Synthetic coding sequence
augccccauuuggccagccuguuuacugcuucaagccgauguugcccacacccgcugaggccugagggauccggcgcuaugggaccagaagcccucucuagcuugcugcuccuucugcucguugcauccggugacgcagacaugaaaggucauuucgaucccgcgaaauguagguacgcuuuggggaugcaagaccgcacuauccccgacagugauauuuccgccaguucguccuggucugacagcaccgcugcgaggcacucccgacuagaaucuuccgauggagauggugcguggugcccagcugguucgguauucccaaaggaggaggaauacuugcagguugaccugcagcgacuccacuuaguugcacucgugggcacccaaggcagacacgcugggggauugggcaaggaguuuucacggucauaccgguugagauacagccgagacggacgacgguggaugggauggaaggauaggugggggcaggagguaauaucagggaaugaagauccugagggggugguucugaaggacuuggguccucccaugguggccagacuggugcgcuucuauccacgggccgaucgggucaugucagugugccugcgaguugagcuuuacgggugucuguggcgcggggaauggcuuucuuuccuggggaucuguuucuuaucaagagggcuugagggcggagaguguggcgagugggcuucuagaauucccucaccagccgguaaauugucacuguag

SEQ ID NO: 15040 - RNA, 456 nt, Artificial Sequence
  Description of Artificial Sequence: Synthetic coding sequence
auggaucucguccucaagcgguguuugcuccaccucgcugugauaggcgcgcugcucgcggucggugccaccaaagugccucgaaaucaggacuggcugggcgucagucgccaguuacgcaccaaagcauggaauaggcaacuguaucccgaauggacagaagcccagagacuggauuguuggagaggcgggcaagugucacucaaaguuuccaacgauggcccuacauugauuggugcaaacgcgaguuucagcauugcauuaaacuuuccaggcucucagaaaguucuaccugacggccaggugauauggguaaauaauacgaucauaaauggaagucaaguauggggaggccagcccgucuauccacaagaaacagacgacgcauguauauucccugauggugguccaugcccgagcgguagcuggucccagaagcggucuuuuguguauuag

SEQ ID NO: 15041 - RNA, 216 nt, Artificial Sequence; identical to SEQ ID NO: 13402
  Description of Artificial Sequence: Synthetic coding sequence

SEQ ID NO: 15042 - RNA, 447 nt, Artificial Sequence
  Description of Artificial Sequence: Synthetic coding sequence
augcaaaccuuucccguugcuggagcuuuagaccccgccaucuuagacacuaguucuccccaagcccuguacacaguccuguuaaucguauugguuaugaugucccugguuuucgguaaauucguccccgugaauugggagccaccccagccucugccguuuccaaaauauuuacgguguuaccggugccuccucgagacgaaggaacucggcugucugcuaggauccgauaucugucuuacccccgccgguaguucuugcaucacuuuacauaagaaaaauucguccggcuccgaugugaugguguccgauuguagauccaaggagcagaugagcgauugcaguaauacaaggaccagucccgugucaggguuuuggauuuucucccaauauuguuuuuuagauuuuuguaacgauccucagaacagaggacuuuauaccccuuag

SEQ ID NO: 15043 - RNA, 447 nt, Artificial Sequence
  Description of Artificial Sequence: Synthetic coding sequence
augcaaaccuuccccguggccggagcccucgacccagcaauucuggacacaucaagcccucaagcucucuacacuguucugcugaucguucuugucaugaugucccugguguucggaaaguuugugcccgugaauugggaaccaccacagccccuucccuuuccaaaguaucugcgcugcuaucgaugucuuuuagagacaaaagagcugggaugucuguuagggagugauauuugccugacacccgccgguucuaguugcaucacuuuacacaagaagaauuccagcggaagugacgugaugguauccgacuguagaucuaaagaacagauguccgacugcucaaacaccagaacuucacccgucucaggauuuuggauuuucucgcaguacugcuuccuugauuuuugcaaugauccacagaacaggggguuguacacaccauag

SEQ ID NO: 15044 - RNA, 1326 nt, Artificial Sequence
  Description of Artificial Sequence: Synthetic coding sequence
auggaauucgaauuugaccgacugagggcauuucaggcaaugcaaguucacuguaacaauaugcacaccuuaggcgccaggcuccccggaggcgucgagugccgguuucggcgaggacccgccauggcaugggagggugagccuaugcggcacaaucuaggcgguaaccucggagaccccagagcccgagcugucucugugccucuuggcggaagaguggcccgguuucuucagugcagguucuuauucgccggcccaugguugcuauucucagaaauaucauucauaagugauguggugaacaauuccagccccgccuuagguggcaccuucccuccugcuccuugguggccaccaggaccgccaccaacuaauuuuuccucccuugaacuggaaccccgcgggcaacagccagucgccaaagccgaagguucuccuaccgcaauuuugauaggaugcuugguugcgauaauccugcuucuguuacuaauuaucgccuugaugcuguggcgccuacacuggcggagacuccugucuaagguguuggaaucucaccccaggacuagaagcccaggucuagucgguauaagaccuacaccucuuccagugucaccaauggcacuccgcuguuguucccccauacaaccaacggcaucauuuuggccacucaccccugucccauuggaagcacgggcuccaccacacccuccaggcccuaaccccccaacgccccgcggaguaacuggggggaauacguaugccguuccugcccuaccaccaggcgccguuggcgaugguccaccuagaguagauuucccccggucucgguuacgguucaaagaaaaacuaggagaggggcaguucggugaagugcaccuuugcgaaguggacaguccccaagaccuggucucccuggacuucccucucaaugugagaaaaggccauccccuguugguugcagucaagauccuccgcccugacgccacaaagaaugcccgcaaugacuuccuaaaagaggugaaaauaaugucacggcugaaagacccuaauauaauccgccucuuaggaguuuguguccaagaugacccccuguguaugaucaccgacuauauggaaaauggagaccucaaccaguuccuauccgcccaucagcuugaggacaaggcggccgagggcgcgccuggcgacggacaagcagcccagggcccaacuauuucauaccccaugcuguugcacguagccgcucagaucgcaaguggcaugagauaccuugcuacacuuaauuucguacacuuuuggggcgaaagacacagauuucuccauuag

SEQ ID NO: 15045 - RNA, 2067 nt, Artificial Sequence
  Description of Artificial Sequence: Synthetic coding sequence
auguuaccaacagaagugccacagagccaccccggucccagcgcucucuuacuauuacaauuacuccuccccccuacauccgcauucuucccuaacauuuggagucuccuugccgccccagggucuauuacucaccaggaucuuaccgaagaagcagcucugaaugugacccugcagcucuuucuggagcaaccuccucccggcagacccccacuucgauuggaggacuucuuaggccggacccuccuggcagacgaccucuucgcagcuuauuucggacccgguaguuccagacgcuuucgggcagcacugggcgaagugaguagagcuaacgcugcacaggacuuucuacccacgucgcguaacgaucccgaucuccauuucgaugcugagcgccugggacaggguagagcgcgcuuaguuggagcccugagagaaacaguaguggccgcccgcgcacuggaccauacguuggcccggcagaggcucggagccgcauugcacgcccuccaggacuucuacucucauaguaauugggucgagcuuggagagcagcagccucauccacacuugcuuuggccccggcaggagcugcagaaucuggcacagguggccgaucccacauguuccgauugugaagagcuuucuugcccuaggaauugguugggcuuuacacuuuuaacuagcggauauuuuggaacacacccucccaaacccccaggcaagugcucccauggugggcacuuugaccgcucuucaucacaacccccccgcgggggcaucaauaaagacaguacaagcccugguuucagcccacaucacaugcugcaucugcaggcugcaaagcuggcgcugcuggcuuccauccaagcuuuuucacugcucaggucccgacucggcgacagagauuuuucacggcugcuagauaucaccccugccucaucucugaguuucguuuuggacaccaccggcucaaugggcgaagaaauuaaugcugccaaaauccaggcaagacaucucguggaacaacggagaggcucacccauggaaccuguccacuacgugcugguacccuuccacgauccaggauucggaccuguguucacuaccuccgaccccgacagcuuuuggcaacaacugaaugaaauccacgcacugggagggggggaugaacccgaaaugugucucucugcacuucaacuggcucuguugcauacaccaccuuuguccgauaucuucguuuuuacagaugcaagcccaaaagacgccuucuugacaaaccaggucgagucucuaacucaggaacgaagaugcagagucacuuuccugguuacggaagauacuaguaggguucaaggucgagcucgucgggaaaucuugaguccacugcgcuuugagccuuauaaagccguggcccuggccagugggggagaaguaaucuucaccaaagaucagcacaucagagacguugcggccaucguuggagaguccauggcagcucuuguuacucucccuuuagauccuccuguggugguuccagggcagccgcugguuuuuaguguggacgggcuguuacagaagaucacugucagaauucauggugauauaucuucguuuuggaucaagaaccccgcaggugugagccaaggucaggaagaaggcggagggccauuaggccauacaagacgcuuuggucaauuuuggaugguuacgauggaugacccuccucagacagguaccugggaaauacaaguuacagcagaggauacaccuggcgugagaguucaggcccaaacaucccucgauuucuuguuucacuucgguauuccaauggaggacgguccucaucccgguuuguacccauugacucagccuguggccggcuugcaaacacagcuucuuguugagagccagucguggggaucaagcgcagcuuuucugcccagacauccaaguaggggcccacgugggugccgaacuagacccggagcauuaggcgcacgugguacaagcggagcccggucaccucggagucucgcaguggcgcacgccgccgugcaccccuag

SEQ ID NO: 15046 - RNA, 1326 nt, Artificial Sequence
  Description of Artificial Sequence: Synthetic coding sequence
auggaauucgaguuugaccgguugagagccuuccaagcaaugcaaguccacugcaauaacaugcacacgcuaggagccagguuaccuggggggguagagugccgguuuagacgaggccccgcgauggccugggagggugaaccaaugaggcacaaucuggguggaaaccucggcgauccccgugcccgcgccgugucugucccgcugggcgguagaguggcuagauuccuccagugcagguucuuguuugcaggaccguggcuucuguucucugagauuagcuuuauuucugauguugugaacaacaguagccccgccuugggagggacuuuucccccagcaccaugguggcccccuggcccucccccaacuaacuuuucaucccuugagcuagaaccacguggacaacaaccuguagcaaaagccgaagggucuccuacagcuauccugauagguugcuuaguggcuaucauucuguuacuuuuacugaucauugcccugaugcuguggagacugcacuggagaaggcuucucucaaaggugcuugagucccacccccgcacacggucacccggacuagucgggauuaggccuacacugcugcccgucucacccauggcucugcgcuguugcagcccaauccaaccuacagcuuccuucuggccuuuaaccccagucccacuugaagcgcgcgcacccccucacccaccuggacccaacccgccaacucccagaggagugaccggaggaaacacauaugccgugccugcauuaccuccaggcgccguuggagacggaccuccacguguugauuucccaagaagcagacuuagguucaaggagaaguugggcgagggacaguucggcgagguccacuuaugugaggucgauagcccucaggaucugguuucgcuugauuucccacucaauguacgaaagggccacccauuauuaguggcugugaaaauacugcgaccagacgcuacaaaaaaugcucguaacgauuucuugaaagaagugaaaaucaugucucgacuuaaagauccuaacaucauucggcugcucggaguuugcguccaagacgacccacucuguaugaucaccgacuauauggagaauggugacuuaaaucaguuucugagcgcgcaccagcuugaggacaaggccgcugagggugccccgggcgauggacaagccgcccaagggccgaccauuucguauccaauguugcuccauguugccgcacaaauugccucugguaugcgcuaccuggccacucuaaacuucguucauuucuggggcgagagacaucgcuuccuccauuag

SEQ ID NO: 15047 - RNA, 2559 nt, Artificial Sequence
  Description of Artificial Sequence: Synthetic coding sequence
auguugcccacugagguuccccaaucacacccaggaccuagugcccuccuucuguuacaauugcuacugcccccaaccuccgccuucuuucccaacauuuggucccugcuagcagcuccgggaagcauaacacaccaggauuugacagaggaagcagcccuuaacgugacacugcagcuuuuuuuggaacagccccccccugguagaccgccucugagacuugaagauuuccugggccgcacucuacucgcggacgaccucuuugccgcuuauuuuggaccuggaucaucgcgaagauucagagccgcccugggcgaagugagcagagccaaugccgcccaggacuuccugccaacuucuagaaacgauccagaccuccacuuugaugcagaaagauuaggccaagguagagcccggcugguaggagccuuaagagagaccguggucgcagccagggccuuggaccacacccuugcacgccagaggcuuggagcugcccuacaugcucugcaggauuuuuacucacauucaaacuggguugaacuuggggagcagcagccucacccccaucuuuuauggcccagacaagaacuccaaaaccuugcccagguggccgaccccaccuguagugauugugaagaacuuucaugcccaaggaauuggcuaggcuucacacugcuuacaucaggauauuuugggacccauccuccaaaaccccccgguaagugcagccacggcggacacuuugaucgauccagcagucagccuccacgaggcggaaucaauaaggacucaacuucccccggcuucagcccacaccacaugcugcaucuccaagcugccaaacuugcccugcuggcgucaauccaagccuuuagucuacuccggucccggcuuggugaccgcgacuuuagcagguuacuugauauuaccccagccagcucucuuagcuucguccuggacaccaccggaagcaugggcgaggaaaucaacgccgcuaagauucaggccaggcaccucguagagcagagaagagguagcccuauggaacccguccacuauguccuugucccguuucaugaccccggauuugggccuguauucaccacaagcgacccagacucuuucuggcaacaauuaaaugaaauucacgccuugggcgguggagaugaaccugagaugugucuuuccgcucugcagcucgcacuccuccacacacccccucuuucugauaucuuuguguucaccgaugcuucgcccaaggaugcauuucucacgaaucaggucgaaucacuaacccaagagcggagguguagggugaccuuccuugugaccgaggacacaucacgggugcagggucgggccagacgggaaauacugagcccacuuagauucgagccuuacaaagcugucgcacuugccucggguggggagguuaucuucacuaaagaccagcacauccgagaugucgccgcaauuguaggagaauccauggcagcccuggugacuuuacccuuagauccucccguugugguccccggccaaccucugguauuuucgguagauggccugcugcagaagauaacggugcguauccacggugauaucucuaguuucuggauaaaaaacccggcgggaguuucccagggccaggaggaaggcgguggcccccuuggacauacgcggcgauuuggacaguucuggaugguaacaauggacgaccccccacagacaggcacaugggagauucagguaacagcggaagacacgccaggcguuaggguucaagcacaaacaagucucgauuuuuuauuccauuucgguauaccuauggaggacgggccucacccaggcuuguauccucuuacccagcccguugccggccugcagacucagcuauuaguggaagucaccggucucggcucucgagccaacccaggagacccacagccacacuuuucgcacgucauucuucggggggugccugagggggcagagcugggucagguaccguuagaaccggucggcccaccggagaggggccucuuagcugccucccugaguccaacccuacuuucuaccccuagacccuuuaguuuagaguugauaggucaagacgcggccggucgacgauugcauagggcugccccacaacccucaaccgugguccccgugcuucuagagcuuuccggccccuccggguuucuugccccaggaagcaaagucccuuuaucccugcggaucgcgucauuuucugguccacaagaccucgaccugcgaaccuucgugaauccuucauuuagccucaccaguaacuugucuagagcccauuuggaacuuaaugaguccgcauggggucgccuaugguuagaggugccagacuccgccgcccccgauucggugguaaugguuaccgugacugcaggaggaagggaagcuaauccuguuccccccacucacgccuuuuuacgucuucuaguaagcgcuccagccccucaaguuaggaaccacuacuuuccaagccaaggaccggcgcaucaccccuauagguuaaucuag

SEQ ID NO: 15048 - RNA, 732 nt, Artificial Sequence
  Description of Artificial Sequence: Synthetic coding sequence
augggucccgaagcacucucuucucugcugcuguugcugcugguugcuucuggggaugccgacaugaaaggacauuucgauccggcuaagugccgcuacgcccuaggcaugcaggauaggacaaucccugacucagauauuuccgccuccaguucuuggucagacagcacagcggcccggcauuccagacucgagucaucagacggcgauggugcuuggugccccgccgguucaguguuccccaaagaagaggaauaccuacaaguagaucuucagaggcugcauuugguugcucuugugggcacacagggucggcacgccgggggguuggguaaagaguuuucgcguucauaucgccuaagauauagcagagacggacggagauggaugggcuggaaggacagauggggacaagaggucauuagcggcaaugaagaccccgagggugugguauugaaggacuuaggacccccgaugguagcacgccuaguacgauuuuauccacgggcugaccgggucaugucugucugccugcgcguggaguuguauggaugcuuguggagggauuguaguauggguguuugggccuccuggcaaaugguaugguggggauggaugacacuggggagagugcgcaguugcgguagcgggcaggcaaugaccaugugggauggcgcaacaacagcuucucccgucgcaauguggcgguggagcuuaagucugacaggcuag

SEQ ID NO: 15049 - RNA, 2760 nt, Artificial Sequence
  Description of Artificial Sequence: Synthetic coding sequence
auggguccugaagccuugagcagccuccuccuccugcuucuuguugccucgggugacgcagauaugaaaggccauuuugaccccgcuaaaugccgcuacgcccuugguaugcaggaucgcacgauucccgacuccgauaucagcgccucuucaucuugguccgauucaaccgcggcaaggcacuccagacuggaaagcuccgacggugacggagcguggugccccgccgguagcgucuucccuaaagaggaagaguaccuucaggucgaucugcaacgucugcaccucgucgcucuggugggcacgcagggucgucaugcaggugggcugggcaaggaguuuuccagaucauauagauugcgauacucacgugauggcaggcgguggaugggguggaaggaucgcugggggcaggaaguaauuuccggaaaugaagaccccgaaggcguggugcugaaggaucuggggcccccgaugguagcuagguuaguccguuucuauccccgagcagaucggguaaugucuguuugcuuacgggucgaguuguacggguguuuauggagagauggucuccuuaguuauacugcaccuguagggcagacgauguaucugagugaggccguguauuugaaugacagcacauacgacgggcauacaguuggaggguuacaguaugggggguugggccaacucgccgauggagugguaggucuggacgacuucagaaagagucaggagcuacgcguguggccuggguacgauuacguuggcuggucaaaucauucuuucucauccggcuacguggagauggaguucgaauucgacagauugagagccuuucaggcuaugcaaguucauuguaacaauaugcacacucucggcgcuagauuaccuggaggcguggaguguagauuuagacgagguccagcaauggcgugggaaggcgagcccaugcgucauaacuuaggcgggaaccugggagacccgagagccagggccgugucagugccccucggcgggaggguugcaagguuccugcaaugccgcuuccuguuugccggcccuuggcuacuguuuucagagauuucuuucauuuccgauguggugaauaacuccuccccugcacuuggcggcacauuuccuccugccccuugguggccuccagggccuccuccaacaaacuucucaucccuggaauuagaaccacgaggacagcaaccaguggcgaaggcagaaggcucaccaacugcuauacucaucggguguuuaguggccaucaucuugcuguuauuacuuauuaucgccuuaaugcucuggaggcuccauuggcgaagacugcuuagcaaggcugagaggcgugucuuagaagaagaacucaccguucacuuaagcguaccaggcgauacuauauugaucaacaacagacccggcccacgcgaaccuccuccuuaucaggaaccgcguccuaggggcaaccccccucacagcgcccccugugugccuaacggcuccgcauuauugcuuucuaauccagcauauagacugcuucuggccacuuaugcacgcccacccagagggccuggaccaccgacccccgcuugggcaaagcccaccaacacccaagccuauuccggagacuacauggaaccugaaaagccaggcgccccacucuugccccccccaccucagaacuccgucccacacuaugccgaggcugacaucgugacacuacaaggggugaccgguggcaacacauaugccgucccugcauuacccccaggggcaguaggcgauggcccaccacgcguggacuucccucgaucuagauugcgcuucaaggaaaagcucggggaaggacaguucggcgaaguccaccucugugaaguggauuccccucaggaucuugugaguuuggacuuuccccucaacgugaggaaaggacacccacuccucguggccguuaagauucuuaggccugaugccaccaaaaaugcuucuuucucucucuucucaagaaaugacuuucucaaggaggugaagauuaugaguagacucaaagaucccaauaucaucagacugcuuggcgucugcguucaagaugauccacuuuguaugauuaccgacuacauggagaauggugaccugaaucaguuccucuccgcccaucagcucgaagacaaggcugccgaaggcgcuccuggagacggccaggcggcacagggacccacuauaucuuaucccaugcuucuucauguugccgcccagauugccucuggcaugagauaucuggccacauuaaauuucguccaccgcgaccuagccacccgaaauugucucgucggagaaaacuuuacuauuaaaauugccgacuucgggauguccaggaacuuguacgcuggcgauuacuaccgcguacagggccgcgcugugcugccaauucguuggauggcuugggagugcauccuuaugggcaaguuuaccacagcuucugaugucugggccuuuggggucacgcucugggaggucuuaauguuguguagggcccaaccuuucggccagcuuacugacgagcaggucauugagaacgcaggugaguuuuuucgcgaccaagggaggcaagucuacuuaucucggcccccggcaugcccucagggcuuauaugaacugaugcugcgauguuggaguagagagucggaacagagaccaccauucucccagcuccaucgcuuccucgccgaagacgcccuaaacaccguauag

SEQ ID NO: 15050 - RNA, 2700 nt, Artificial Sequence
  Description of Artificial Sequence: Synthetic coding sequence
augcugcuccuucugcugcuagcaccucuguuucuacgccccccaggagcuggaggugcucagacacccaacgcuacuucagagggcugucagaucauucaucccccuugggaggggggaauuagauaucgggggcugacacgcgaucaggugaaggccauuaauuuccugcccguggacuaugagauugaauauguguguagaggagaaagagaaguuguaggaccaaaagugcgaaagugucuggccaauggcucauggaccgauauggauaccccaaguagguguguuaaccgaacaccucauagugagagaagagccguguacauuggugcccucuucccuaugucuggugguuggccugguggacaagcuugucagccagcugucgagauggcacucgaggaugugaacucuagaagggacauccugccagacuacgagcugaaacuuauucaccaugacucaaagugugaccccggucaggccacuaaguauuuguaugagcuuuuguacaaugauccaaucaaaauuauucucaugccaggauguagcuccguaucgaccuuaguugcagaggccgcuaggauguggaaccucaucguacuuagcuacggcuccaguagccccgcccucucaaaccggcaacgcuucccaacuuuuuucagaacucaucccagcgccacucugcauaauccuacccguguuaaauuguuugaaaaaugggguuggaagaaaaucgcuacuauccagcaaaccacugagguuuucacuagcacucuggacgaucuugaagaaagggugaaagaagcagguaucgagauuacauuucggcaguccuucuuuuccgacccugcgguucccguuaaaaaccuuaaacgacaagacgcaagaauuauagugggucuguucuacgagacugaggccagaaagguguucugcgagguguacaaagaaagacuguuuggaaaaaaauacgugugguuccucaucgggugguacgccgauaacugguucaagauauaugauccuuccaucaauugcacaguugacgagaugaccgaggcuguggaagggcacauuacgacggaaauugucaugcuaaauccagcgaauacaaggucaaucucuaacaugacaagucaggaguuuguggaaaaauugacaaagaggcugaaacgacacccagaggaaacgggcggguuccaagaagcgccauuggccuacgaugcaauuugggcacuggcucucgcgcuuaauaagacgucuggcggcggaggcagaagcggcguacggcucgaggauuucaacuacaauaaccagacaauuaccgaccaaauuuaccgagcaaugaauaguagcuccuucgagggggugucaggacacgugguauuugacgcaucaggaaguagaauggccuggacuuugaucgaacaacugcaggggggauccuacaaaaagaucggguauuacgauuccacaaaggacgaucugucauggucuaagacugauaaguggauugguggaagcccucccgcagaccaaacacucguaaucaagaccuuucgcuuucucucucaaaaacucuuuauuuccguguccguccugucaucucucgguauuguccucgcuguugucugucugucauucaacauauacaacucacaugugcgcuauauccagaacagccagcccaaccucaauaaucugaccgccguugggugcucacuggcucuggcugcuguuuuuccccugggguuagacggcuaccacauaggccgaaaccaguuucccuuugucugccaggcaagauugugguuacucggccugggcuucagccucggauacgguuccauguucacaaaaauuugguggguccauacugucuuuaccaaaaaagaagagaagaaggaguggaggaaaacgcucgagcccuggaaacuuuacgccaccgugggucuacugguaggaauggaugucuuaacccucgccaucuggcagaucguugacccuuugcaccgcaccauagagacuuucgccaaagaagaacccaaagaagauaucgacgugucgauccuuccacaguuggagcacugcucaucucggaagaugaauaccuggcucggaauauucuacggauauaagggacuacuccuccuguuggggaucuucuuagcuuacgagacuaaauccguuuccacagagaagauaaaugaucaucgggccguaggcauggcaauuuauaaugucgcuguucucugucucaucaccgccccugugaccaugauccuuuccagucagcaagaugcggcuuucgcauucgcuucauuagcaaucguguucaguuccuauaucacucuaguuguguuauuugugcccaagaugagaagguuaauuaccagaggagaguggcagucagaagcacaagauacuaugaagacaggauccaguaccaauaacaaugaagaagagaaaucacggcugcuggagaaggaaaaucgcgaacuggaaaagauuaucgcagaaaaggaggaacgggucucugaauugcgucaccaacugcagagcaggcagcagcugaggagcagaaggcaucccccuacucccccggaaccuuccggaggucuaccccgcggaccccccgaaccgcccgaucgccuuucaugugacgguuccagaguccaccugcuguacaaguag

SEQ ID NO: 15051 - RNA, 447 nt, Artificial Sequence
  Description of Artificial Sequence: Synthetic coding sequence
augcaaaccuuucccguugccggagcccuggauccugccauccuugacacaaguuccccccaagcccuuuacacagucuuguuaauugugcucgugaugaugucacugguuuucggaaaguucgugcccgucaacugggaaccaccacaaccccugcccuuucccaaauaucuaagguguuacagaugucuucucgagaccaaagagcuuggaugucugcuugguucagacauaugccuaacaccugcuggaucaagcuguaucacacuccauaagaaaaacaguucagguagcgaugugaugguuuccgauugucgcucaaaagagcaaauguccgacugcagcaauacacgaaccucaccuguguccggguucuggauuuuuucucaauacuguuuccucgacuucugcaacgauccucaaaaccgaggccuuuacaccccguag

SEQ ID NO: 15052 - RNA, 516 nt, Artificial Sequence
  Description of Artificial Sequence: Synthetic coding sequence
augagacacaauuuaggagguaacuugggcgacccaagggcuagagcaguuuccgugccucugggcggacggguagccagauuucuccaaugucgcuuccuuuucgcaggccccuggcugcucuuuucugaaaucuccuuuauauccgaugucgugaauaacuccucacccgcacucggaggcacuuuuccacccgcaccuugguggccgcccgggccaccgccgacuaacuuuucaucucucgagcuggaaccacgaggccaacaaccugucgccaaggccgaaggcagcccuacagcgauucuuauugggugucucguggcuaucauccugcuccugcugcugauaaucgccuuaauguuguggcgccuccacuggagacgcuugcuuuccaaaguacucgagucucacccucguacacgaagcccaggacuaguggguauuagaccgaccccucugccuguuucucccauggcucugguccacuuaugcgaagucgacagcccucaggacuag

SEQ ID NO: 15053 - RNA, 666 nt, Artificial Sequence
  Description of Artificial Sequence: Synthetic coding sequence
augaccacacaguuacgugucgugcauuuguugccucuccucuuagcauguuucgugcagacauccccaaaacaagagaaaaugaagauggauugucacaaagacgaaaaagguaccauuuaugauuaugaagcaauagcucugaacaaaaacgaauaugugucauuuaaacaauauguggguaagcacauuuuguucgugaacguggcaacauacugcggacugacagcacaauaccccgaacugaacgcucuccaggaagagcugaaaccuuacggccugguaguccucggcuuuccuuguaaccaguuuggcaagcaggaaccuggcgauaacaaagagauacugcccggccuuaaguacguuagacccggcggcggauucgugccgucauuccagcucuucgagaaaggugacgucaauggagaaaaggaacagaagguuuucagcuuuuugaagcauuccugcccacaccccucggagauucugggaacauuuaagucgauuuccugggacccaguaaaagugcacgauauuagauggaauuuugaaaaguuuuuaguaggccccgauggcaucccggucaugcgauggagucacagagcaacugugucgagcguuaaaacagauauccuggccuaccuaaagcaauucaagacuaaguag

SEQ ID NO: 15054 - RNA, 447 nt, Artificial Sequence
  Description of Artificial Sequence: Synthetic coding sequence
augcagaccuuuccagucgcaggugcacuggacccagcuauacuggacacaaguucaccacaggcccucuauaccguguuacugauuguccucgugaugaugagucucguuuucggaaaauucgugcccgucaacugggagccuccucaaccucugcccuuuccuaaauaucuuaggugcuaucgaugccuccuggaaaccaaagagcugggcugccucuugggcucagacaucugccucaccccugcagguucaagcuguauuacacuucauaagaagaacucauccgguucggaugugauggugagcgacugucgcuccaaagaacagaugagugacuguuccaacacacgcacuuccccaguuucaggauuuuggaucuuuucucaguacuguuuucucgacuuuuguaaugacccucagaaccgcgguuuauauaccccuuag

SEQ ID NO: 15055 - RNA, 1737 nt, Artificial Sequence
  Description of Artificial Sequence: Synthetic coding sequence
augcucuugcuccugcuguuagcuccuuuguuccuuagaccucccggugcagguggggcccaaacuccuaaugcgacgagcgaagggugccagauaauccacccaccaugggaaggcggcaucagguaccgcgggcuaacacgagaucaggugaaggcaauuaacuuucugccugucgacuaugaaauugaauauguguguagaggagaaagagagguggugggcccaaaaguucggaaaugcuuggcaaauggguccuggacggauauggacaccccuucuagaugcguaagaauaugcagcaagagcuaccuaacgcucgagaauggaaaaguuuuccucacuggcggggaucucccagccuuagacggagcaagaguagauuuucgcugcgauccugacuuucacuuagugggcuccucacgcuccauauguucacagggacagugguccacucccaaaccccacugccagguuaauaggaccccacacagcgagcggcgugcaguguacaucggggcauuguuucccaugagcggcggguggccuggcggccaagcuugccaacccgcagucgaaauggcacuggaggauguaaauucccggagagauauccugcccgacuacgagcugaagcuaauucaucacgacucuaaaugcgauccaggccaagcgacuaaauacuuguacgaacugcuguacaaugaccccaucaaaaucauucucaugccagguuguucuucaguaagcacucuggucgccgaagcagcucggauguggaacuugauuguacuaucuuacgguucuucuagccccgcccugucuaaucgucagagauucccuaccuuuuuccggacacauccaagcgcaacgcuucacaaccccacgcgugucaaacuguucgagaaguggggauggaagaaaauagcaacgauucagcaaacuacagagguguuuaccucuacccucgaugaccuagaagagagaguaaaagaggccggcaucgaaauaaccuucagacagagcuuuuucucagacccugcuguucccguuaagaaucugaagcggcaagaugcccguaucaucgucggccuguucuacgagacagaggcaagaaagguauuuugugagguguauaaggagcgucuguucggcaaaaaauacguuugguuccugauagguugguacgcagacaauugguuuaaaauuuaugacccaagcaucaauuguacuguggacgaaaugaccgaggcaguggaggggcacaucaccacggagaucguaaugcucaauccagccaacacuagauccaucucuaauaugacuucucaggaguuuguagagaagcucacuaagcgcuuaaaaaggcauccggaggaaacaggaggguuucaggaggcaccccuugcauacgacgcaaucugggcgcuggcucucgcucucaacaagacaucagguggcgguggaagaagcggcguaagguuagaggacuuuaacuacaauaaucagaccaucacagaucaaauuuacagagcuaugaacucgucuucuuucgaggguguuagugggcaugugguguuugacgccucuggcagcagaauggccuggacacugauugaacaauugcaagguggaucauauaagaagauaggguauuaugauagcacgaaagaugacuuauccugguccaaaacugauaaauggauagugaucaguaggacacacucaccaaccuag

SEQ ID NO: 15056 - RNA, 1737 nt, Artificial Sequence
  Description of Artificial Sequence: Synthetic coding sequence
augcugcuguuacugcuccuugcuccucucuuucuucgcccaccuggcgcaggcggcgcacaaacucccaaugcgaccagcgagggaugccagaucauccacccccccugggaaggaggaaucagauaccgcggcuugacucgggaccaagugaaggcgauaaauuucuugcccguugauuacgaaauugaauacguuuguaggggugaaagggaaguuguuggaccgaagguuagaaagugccuggccaaugggucauggacagacauggacacaccaagcagaugugugcgaaucuguagcaaaagcuaucuuacacucgaaaacggcaaagucuuccugacaggcggggaccugccagcucuagacggcgcuaggguagauuuccggugcgacccagacuuucaucucguuggcucaagccgcuccauuugcucucaaggucaguggucaacccccaagccucauugucaggucaaccguacaccucacucagagagacgagccguauacauuggcgcgcuguuccccaugagcggggguuggccagguggccaggcaugucaaccugccguagaaauggcccuagaagaugugaauucccgcagagacaucuugccagacuacgaguugaagcugauucaccacgauagcaaaugugaccccggucaggccacuaaauaccuuuacgaacuacuuuauaacgauccuaucaagauuauccugaugccugggugcuccagcguauccacgcuuguggcugaagccgccaggauguggaaucuuauuguucuaucguacggguccaguucuccggcccucucuaaucgacagcguuuucccaccuuuuuuagaacucauccguccgccacccugcacaacccuacacgagucaagcucuuugagaaguggggauggaagaaaauagcuaccauucagcaaacuacggagguauuuacguccacucuagaugacuuagaggaaaggguaaaggaggcaggaaucgagauaacguuucggcagucauuuuuuagcgaucccgcaguuccagucaaaaaccucaagagacaagacgcucgcaucauuguaggccuauuuuacgaaaccgaagcucggaaaguguuuugugaaguuuauaaggaacgucuauucgggaagaaguacgucugguuccuuaucggaugguaugcagacaacugguuuaaaaucuaugauccauccaucaacugcacugucgaugaaaugacagaggccgucgaagggcacaucacaacugagauuguaaugcugaauccugccaacacccgaucuaucuccaacaugacgucucaggaauuugucgaaaagcucacaaagaggcugaagagacacccagaagagaccggcggcuuucaagaggcuccacuggcauacgacgcaauaugggcacucgcucucgcccugaacaagacaucaggcggugguggucggagcggaguucgccuggaagacuucaacuacaacaaucagacaauuacagaucagaucuaucgcgcaaugaacuccagcaguuuugaggguguaagcgggcaugucguguucgacgccucugguuccagaauggccuggaccuuaauugaacaauuacagggaggaagcuacaaaaagauuggcuacuaugacucgacuaaagaugaccugucauggucuaagaccgauaaauggaucgugauuucuagaacccacuccccgaccuag

SEQ ID NO: 15057 - RNA, 756 nt, Artificial Sequence
  Description of Artificial Sequence: Synthetic coding sequence
augccacaccucgccucccucuuuaccgcguccucacgaugcugcccacacccucuuagacccgaaggauccggcgcaauggggccugaagcccuuuccucacuuuuacuucugcuucugguugccucuggugacgcugauaugaaaggacacuuugauccugccaagugucgcuaugcucugggaaugcaggaccgaaccauaccugacucugauaucagugccuccucuagcuggagcgacucaaccgcagcgcggcacucuaggcuugaguccucagacggugacggcgcuuggugccccgcuggcucgguauuuccaaaggaagaggaguaccuccaaguggaccuccagagauuacaucuuguggcucuugugggcacucaagggcgucacgcaggugguuugggcaaagaauuuuccagaucauauaggcuucgauacaguagagaugguaggcgauggaugggguggaaggacagguggggacaggaagugaucagugguaacgaggacccagagggcguggugcuuaaggaucugggaccgccaaugguggcuagacuggugcgguuuuauccgagggccgaucgggugauguccguguguuuaagaguggaacuguacggcugccuguggaggggcgaauggcuaagcuucuugggaauauguuuuuugucuagggggcuugaaggcggggaaugcggugagugggcuucucgcauaccaucuccggcugggaaguugaguuuguag

SEQ ID NO: 15058 - RNA, 1764 nt, Artificial Sequence
  Description of Artificial Sequence: Synthetic coding sequence
augaggcccaggggucucccuccucucuuagucguguuacuuggcuguugggcaagugugucagcccaaacugaugcuacgccugccgucacuacugaaggacugaacucaacugaggcugcucuggcuaccuucggcacuuuuccuagcacacgaccaccaggaacaccacgugcccccggccccagcucuggcccaagacccacgccagugaccgauguugccguccucugcguaugcgaccucuccccggcacagugcgauaucaauugcuguugcgaucccgacuguucuucuguggacuuuuccguuuuuagcgcuugcucaguucccgucguuacuggagacucgcaguucugcucucagaaagccguaauuuacucccucaauuuuacugccaauccaccccagagagucuuugaacugguugaucagauaaauccguccauuuucugcauccauaucacuaacuacaagccggcccuauccuucauuaacccugaagugcccgacgaaaauaacuuugacacccuuaugaaaaccucagauggauuuacgcugaacgcagaauccuauguuucuuucaccacaaagcuggauauuccgaccgccgcaaaauaugaauauggcgugccccuucagaccagcgacaguuuucuuagauuccccagcuccuugacaucuagcuugugcacagauaacaacccggccgcguucuuggugaaccaggcagugaaauguaccaggaagaucaaccuugagcaaugcgaagaaauugaggcccuaucgauggcauuuuacucgucucccgagauccugcggguuccugacucucgcaaaaaaguaccuauuacaguccagucuaucguaauccagucucugaauaaaaccuugacgaggcgcgaagauacagacguccuacagccaacccuuguuaaugcuggucauuucucucugugcgucaauguggugcucgaggugaaauacucgcugacauauacagaugccggcgaagugacuaaggcggaucuguccuuuguuuugggaacugugucaucugugguggugccucugcagcagaaguucgaaauccauuuccuccaggaaaauacccaacccgugccccucucuggaaacccugguuacgucguaggccugccucuugccgccgguuuccaaccacacaaaggaucagggaucauacaaacuacuaacagauacggacagcugaccauacuucacaguaccacggaacaggacugccuggcacuggagggggugcggaccccaguguuauuuggauauacaaugcagagcggaugcaaguuaagacugaccggggcacuucccugucaacucguugcucagaaaguaaagagucuuuuauggggccaaggcuuuccagacuaugucgcucccuuugguaacucgcaggcccaggauaugcucgauugggucccaauucauuuuaucacucaaucuuucaaucggaaagauagcugucaacugccaggcgcgcugguaauugaagucaaguggacaaaguacgggagccuccugaacccccaggccaagaucgugaauguaaccgccaaucucauuagcucaaguuuucccgaagcgaacuccgguaacgaaagaacuauccugaucucaaccgcagucaccuuuguugauguuagugcucccgccgaagcuggcuuucgagcuccccccgccaucaacgcccgauuaccuuucaauuuuuucuucccuuucguauag

SEQ ID NO: 15059 - RNA, 2067 nt, Artificial Sequence
  Description of Artificial Sequence: Synthetic coding sequence
augcugccuaccgaagucccucagagccauccugggccgagcgcucuacuccuccuccagcugcuucuccccccuaccucugcuuuuuucccaaauaucuggucauuauuggccgcccccggcuccauaacgcaucaggaucucacagaggaggccgcucucaacgucacccugcaacucuuucucgaacagccucccccaggccgacccccuuugaggcuggaggauuuccuuggaagaacccucuuagccgaugaucuguucgcagcauauuuuggacccggaucuucucggagguuucgcgcugcccugggugaggucucaagagcgaaugcugcgcaagauuuucuaccgaccagcaggaacgacccggauuuacacuucgacgcugaaagauugggacagggacgggcacgguuggugggagcucuuagagaaacagucguugcagcucgcgcccuagaccauacgcuugcacgccagcggcuuggagcugcacuucacgcucugcaagauuucuauucucauucuaauuggguggagcugggcgaacagcagccucauccccaucuguuauggccuaggcaagaacuucagaaucucgcucagguugcagauccuacuuguucugacugugaggaauugaguugcccacgaaacuggcuuggauucacacuguugaccagcgguuacuucggcacccacccccccaaacccccuggaaaaugcucacacggcggacauuucgauagaagcaguagccagccaccucguggagggauuaacaaggauucuaccuccccugguuuuaguccccaccacauguugcaccuccaggccgcuaagcucgcacuacuggcaucuauucaggcguuuucucugcugcguucaagacuuggggaucgugacuucagucgacugcuggacaucacacccgcuucaucucugagcuucguauuggauacgaccggaucaaugggugaagagaucaaugccgccaagauacaggccagacaccuaguugaacagcgcagagggucuccaauggagccgguucauuaugugcucguccccuuccacgaccccggguucgguccuguuuuuacuacuucagaucccgacucuuuuuggcagcaauuaaacgaaauacacgcccucggggggggcgaugaaccugagaugugccugucggcccugcaacucgcacuuuuacacacaccaccccuuucggauauuuucguguuuaccgacgccucacccaaagacgcuuuucucacaaaucagguggagucacuuacucaggaacgcaggugcaggguaacauuuuuggugaccgaggacacuucccgagugcaaggacgagccagacgcgaaauacucuccccacuaagauuugaaccauacaaggcaguggcccuggcuagcggaggagagguuaucuucacuaaggaucaacacaucagagauguggccgccauugugggggaaagcauggcugcgcuugugacccugccacuggacccaccaguuguugucccagggcaaccacugguuuuuucagucgauggacugcuucaaaagauuaccgucagaauccacggggacaucaguuccuucuggauuaagaaucccgccggaguaagucaaggacaagaggaaggcggaggacccuugggucauacacgaagauucggacaguuuuggaugguuacgauggaugaccccccccaaaccgguacuugggaaauucaagugacugccgaggacacaccgggcguuaggguacaggcccagaccucccucgacuuccuguuccacuuugggaucccaauggaggacggaccucacccuggccuguacccucuuacucagcccgucgcuggacuucaaacccaacugcuggucgaaucccaaucuuggggcucuucugcagccuuccugccgagacauccuucaagagggccacgggguugucguaccagacccggugcccuaggugcucgcgguaccuccggcgccagaucuccuagaagccucgccgucgcacaugcggcuguccaccccuag

SEQ ID NO: 15060 - RNA, 303 nt, Artificial Sequence; identical to SEQ ID NO: 13421
  Description of Artificial Sequence: Synthetic coding sequence

SEQ ID NO: 15061 - RNA, 705 nt, Artificial Sequence
  Description of Artificial Sequence: Synthetic coding sequence
augaagacgcuggccggccuugugcuaggccugguuauuuucgaugccgccgucacugcuccuacacucgaguccauuaacuacgauucagaaacauaugaugcaacauuggaagacuuggacaaucuguacaauuacgaaaacaucccggucgacaaaguugagauagagaucgccaccgugaugccuucaggaaauagagagcugcucacaccgccaccccagccagaaaaagcccaagaggaagaagaggaagaggaaucuacaccacgacuuaucgauggauccucaccccaagagcccgaauuuaccggaguucucgggccucacaccaaugaagacuucccuacuugucugcuguguacuugcauaucaacuacagucuacugcgacgaccaugaacuggaugccauccccccucuuccgaagaacacugcuuauuuuuacucacgcuucaaucgcaucaagaagauuaauaaaaaugauuucgcaucucuuucugaucuaaaaaggauugacuugacuucuaaucugaucucagagauagacgaagaugcauuuagaaaacugccccagcuucgcgaguugguucuacgagacaauaagauuagacagcucccugaacuaccaacaacacuuacuuucauugauaucagcaacaauagacuuggacggaaggguauuaagcaagaggccuucaaguag

SEQ ID NO: 15062 - RNA, 2559 nt, Artificial Sequence
  Description of Artificial Sequence: Synthetic coding sequence
auguugccaacugaaguaccacagucacauccaggacccuccgcccugcuccuccuccagcuguuacucccucccacaagugcguuuuuuccuaauauuuggucccuacuugccgcuccaggcaguaucacacaucaagaccugacugaagaggccgcccuaaaugucacacugcaacuguuucuggaacagccaccccccgggaggcccccccugaggcuggaagacuuuuugggacgaacccuucucgccgaugacuuguucgcugccuacuucggaccuggcuccucgagaagguuuagagccgcccuuggggaaguuucucgggcuaacgccgcucaggacuuccugccaaccaguagaaacgauccugaucugcauuucgaugccgagcgacugggacaagggagagcacggcucgucggcgcuuugagagagacugucguggcugcuagagccuuagaucacacucuugcgagacagcgucugggcgcggcuuugcaugcauuacaagauuuuuauagccacuccaauuggguagagcucggagagcaacagccgcauccucaucuccuuuggccacgucaagaacuucaaaacuuggcccagguugcugacccgacuugcuccgauugcgaagaacugaguugccccagaaauuggcuaggcuuuacauugcuuaccaguggcuacuuugggacccacccgcccaaaccaccaggaaagugcucccauggcggacauuucgaucgcuccagcucccagccucccagagguggcauaaacaaggacuccacaucaccuggguucaguccacaccacaugcuccaccugcaagccgcaaagcuugcguuguuagcaaguauucaagcauuuagccuucuaaggucuagacuuggcgacagagacuucucgagacuauuagauaucacuccagccagcagccucuccuucgugcuugauacuaccggcucuaugggcgaggaaauuaacgcugcaaaaauccaggcucgucaucuuguggagcagcgcagaggaagucccauggagcccguucacuacguccuggugcccuuccacgaucccggcuuuggcccuguauucaccacaucggacccagauuccuuuuggcagcaacucaaugaaauucacgccuugggagggggggaugaaccugagaugugucuuuccgcuuugcagcuggcucuuuuacacaccccaccauuaucagacauauucguguucacugaugccagcccuaaagaugcuuuccugaccaaccagguggaaagucugacccaggagaggaggugccgagucaccuuucugguaacugaagacaccagucgcguacaaggccgggcuagaagagaaauccucucuccauuacgcuuugagcccuauaaagccguagcccucgcaagugguggcgaaguuauauuuaccaaggaucaacauauccgugacguugccgcaaucgugggcgaguccauggcagcccuaguaacccucccacuagacccaccugucgucguucccggccagccccugguauucuccguggacggacuguugcagaaaauuacaguuaggauucauggcgauauuaguaguuuuuggauuaaaaacccagcaggcgugucccaaggacaagaagaaggaggagguccgcuuggacacacgaggcgauucggccaguucuggaugguuaccauggaugauccgccccagaccggcaccugggagauucaggucacagccgaagacaccccaggcgugagaguccaggcgcaaacaucccuggacuuccuauuccauuuuggcauuccuauggaagauggaccucaccccggguuguauccacuuacacagccaguugccggccuccaaacacaauuacuaguagaagucacuggucucgguucacgcgcuaacccuggcgauccucagccucacuucucccauguuauccuccgaggggucccagaaggggccgaacuggggcaggucccacuggagccuguuggaccacccgaacggggucugcuggccgcgucgcugagccccacacugcuuucaacaccuagaccuuucucccucgaacucaucgggcaggaugcagccggcagacgcuugcauagggcugccccucagcccaguaccgucgucccuguuuuacuagaauuguccgggccuucuggcuuccucgccccuggaucuaaaguuccucugucccuuagaaucgccaguuuuagcgguccucaggaccucgaccuccgcacauuugugaacccuucuuucucccugacauccaaccucucucgggcccaucuugaacuuaaugagucagcauggggucgacuauggcucgaggugccagauuccgccgcaccagacagcguuguaaugguaacagucaccgcuggcggcagagaagccaauccaguucccccgacccaugcauuucuaaggcuguuagucucagcuccggcaccccagguaaggaaucacuacuuuccgucucagggccccgcacaucaccccuauaggcuaauuuag

SEQ ID NO: 15063 - RNA, 2760 nt, Artificial Sequence
  Description of Artificial Sequence: Synthetic coding sequence
augggcccugaagcucuuuccagucuguugcuuuugcuccugguggccucaggagacgccgauaugaaaggacauuucgaccccgcuaaaugccgguacgccuugggcaugcaggaccgcacgaucccggacagcgauauaagugcuagcucuuccugguccgacucuaccgccgcucgacauagccggcuugaaucaagugauggcgauggagcauggugccccgcugggagcguauuuccaaaggaagaagaguaucuacagguugaccugcagcgauuacaucuggucgcgcucguuggaacccagggccggcaugcggguggguuaggaaaagaguucucccgcucauacagacucagguacucuagagauggucggcgauggaugggauggaaagaccgguggggacaagaggugauuagugggaaugaggaccccgaaggaguugugcugaaggaccuuggaccccccaugguggcccgccuuguucgauuuuauccuagagcagacagagugaugagcgugugccugcgaguggaauuguacgguugucucuggcgggaugguuuguugagcuauacugcaccagugggccagacaauguauuuaucugaggcgguguaucugaacgacucuacuuacgauggacacacaguggguggccugcaguacggaggacucgggcaguuagccgacggagugguuggccucgaugacuuuaggaaaucccaggagcugcggguauggccaggcuaugacuaugucggauggagcaaccacagcuuuuccucaggauauguggaaauggaauucgaauuugacagacugcgcgcuuuccaggccaugcaagugcauugcaacaacaugcauacacugggagcaaggcugccaggcggggucgaaugccguuuccggagggguccagccauggcaugggaaggagaacccaugcgccauaaucugggaggcaaccuuggugacccaagggccagagcuguguccgugccacugggcggacggguggcucguuucuugcaguguagauuccuuuucgcuggacccuggcuccuguuuuccgaaauaucauucauuucugacgucgucaauaacuccucaccugcucucggaggcaccuuccccccggccccuugguggccucccggccccccgcccacuaacuucagcagccucgaacuggaaccucggggccagcagccaguugcuaaggcugaaggaucaccaaccgcaauacugauuggaugucuaguggcgauuauacugcuucuuuugcuuauuauugccuugaugcucuggcgauuacacuggcgacgccucuuaaguaaggccgaacgacgaguccuagaggaagaauuaaccgugcaccuaagcgucccgggcgacacuauccuaaucaauaaucgcccaggcccccgggagccccccccuuaccaagaaccuagaccucguggaaaccccccucauucagcaccaugcgugccuaacggcagcgcucugcuccucucaaacccagcauaccgccuuuuacuggccaccuacgcacgcccuccuaggggaccugggccaccgacuccugcuugggccaagccaacuaauacccaggcauacagcggggacuacauggaaccggaaaagccaggugccccacuuuuacccccuccaccucagaacagcguuccacacuaugccgaggcagacaucguaacucuucaaggcguuaccggaggaaauacauacgccguaccugcgcuucccccuggcgccgugggagauggcccuccccgagucgacuucccuaggagcagauuaagguuuaaagaaaagcugggggagggacaguuuggugaggugcacuugugcgaaguagauucuccccaggaccuggugucucuggauuuuccacugaaugugagaaaagggcacccacugcucguggcaguaaaaauccuacggccagaugccacaaagaacgcuagcuuuagccuguucucccgcaacgauuuccugaaagagguuaaaauuaugucucgacugaaagaccccaacaucauccgucucuuggguguuugcguccaggaugacccucucuguaugauuacagauuauauggaaaacggagacuugaaucaguuucuuuccgcacaucaacuggaggacaaggcugcagagggugccccuggggacggucaggccgcacaagguccaacgauaucuuauccuauguuacugcacguggccgcacagaucgcgucuggcaugcgcuaccuggcgacacugaauuuuguucaccgugaccuagccaccaggaacugucucguuggagagaauuuuacuaucaagaucgccgacuucgggaugucuagaaacuuguacgcuggggauuacuaucgcgugcaaggaagagccgugcuaccgauuagauggauggccugggagugcauacugaugggcaaauucaccaccgcaucugaugugugggcauuuggcguuacacuuugggagguccucaugcugugccgcgcacaacccuuuggccaacugacugacgagcaaguuauugaaaacgccggagaauuuuuucgagaucagggacggcaggucuaucucucaaggccacccgccugcccccaaggacuguacgaauugaugcugcgguguuggagucgggagucggagcaacggccccccuuuucccaacuccacagguuccuugccgaagaugcucucaauaccguuuag

SEQ ID NO: 15064 - RNA, 1737 nt, Artificial Sequence
  Description of Artificial Sequence: Synthetic coding sequence
auguuacuacuccugcucuuggccccccuuuuuuuaagaccccccggagcaggcggcgcacaaacccccaaugcgaccucagaaggaugucaaauuauucauccaccuugggaggguggcaucagguaccggggacugacacgggaucaggugaaggccaucaauuuccugccaguugauuacgagaucgaguauguuugccgcggcgagcgagaaguagugggaccaaaagugcgcaaaugccucgccaacggaucauggacggauauggauacuccaucgcguuguguucgcauauguagcaagaguuaucucacacuagagaacggaaaggucuuuuuaaccggcggcgaccugccagcuuuagacggugccagagucgauuuucguugcgauccagacuuccaucuggugggcagcagccgaaguauauguucccaaggacaauggagcaccccuaaaccccauugccaagugaaucgaacaccccacuccgagagacgggcuguguacauaggagcucucuuccccaugucgggcgguuggcccgguggccaagcgugccagccagccguagagauggcccuggaggaugugaacagucggcgcgacauuuugccggauuacgaacuaaagcugauucaccaugauagcaagugugacccuggccaggccacuaaauaccucuaugaacuacuguauaaugauccuauaaaaauuauucugaugcccgguugcucuucuguuucuacccuaguagccgaggcggcaaggauguggaaucugaucguacucucuuauggcuccucuuccccagcccucucaaaucggcaacgcuucccuacuuucuuucggacucaucccucugcuacccuucauaacccgacgcgcguaaaacuuuucgaaaaguggggauggaagaaaaucgcaacuauccagcagacuacagaaguguuuaccaguacauuagacgaccucgaagagagaguuaaggaagccggcaucgaaauuacuuuucggcagucauuuuucagcgauccagccguacccguaaagaaucucaagcgccaggacgcucgaauuauuguuggccucuuuuacgagacugaagcccguaaaguguuuugugaaguuuauaaagagcgacuguuuggaaaaaaauacgugugguuccucauagggugguacgcagauaacugguucaagaucuaugaccccagcauuaauugcacuguggaugagaugaccgaagccguggaaggacacauuaccaccgaaaucgugauguugaaccccgccaacacuagauccaucagcaacaugacaucccaagaauucgucgagaaacugaccaagagacuaaagagacauccagaagagacaggcggguuucaggaggcaccacuugccuaugaugccaucugggcucuagcuuuggcacugaacaagaccagugggggcggcggaagaucgggggugagacuggaggacuuuaauuauaauaaucagacuaucaccgaucagauuuauagagccaugaauuccucuucauuugaaggcguuucuggccacgugguuuuugaugcauccggcucgcguauggcuuggacacugaucgagcagcuucaagggggcaguuacaaaaaaauaggauacuaugacucuaccaaggacgaccugucuuggucuaaaacggauaaauggauugucauaucacgaacccacucucccacguag

SEQ ID NO: 15065 - RNA, 516 nt, Artificial Sequence
  Description of Artificial Sequence: Synthetic coding sequence
augagacacaaccucggaggaaacuugggcgacccucgagcccgcgccguuuccgugccccucggugguagagucgcgagguuucuucagugucgguuccucuucgcaggcccuuggcuccucuucucggaaauuucuuucauuagcgaugugguuaacaacucgucuccugcccucggcggcacuuuucccccugccccaugguggcccccuggccccccaccgacuaauuuuucaagccuugagcuggagccccgcggacagcagcccgucgcaaaggcugaaggcaguccaacugcaauucuaauaggcugccucguggcuaucaucuugcuccuucugcugaucaucgcucugaugcuguggcgcuugcauuggcgcaggcuucugucaaaaguauuggaaucucacccccggacccgcucuccaggauuaguugguaucagacccacaccuuuacccgucuccccuauggcacuugugcaucugugugaaguggauucaccacaggacuag

SEQ ID NO: 15066 - RNA, 2067 nt, Artificial Sequence
  Description of Artificial Sequence: Synthetic coding sequence
augcucccaaccgaggugccucagagccaccccggaccgucugcccugcucuugcuccagcugcuccugccccccacauccgccuucuuuccuaacaucuggagucugcuggccgcccccgguuccauuacacaccaagaucuuacugaagaggcugcccugaaugugacccugcagcucuucuuggaacagccuccaccuggaagacccccuuugcgccuggaagacuuuuuaggucguacacugcuagcugacgaucuuuucgccgcuuacuuuggcccgggcucaucucgccgcuuccgagcagcccugggagaggucucuagggcaaacgccgcacaggacuuucuccccaccagccgcaaugaccccgaccugcacuuugaugccgaaagauuaggacaaggacgcgcccggcuaguuggcgcuuuacgagagacugugguagcggcaagagcccuggaccacacguuggcacgccaaaggcucggagccgcguuacaugcgcuucaggauuuuuacucccacucuaauuggguggagcucggagaacaacagccacauccucacuuacucuggccucgccaggaauuacagaaccuggcccaaguggccgauccaacaugcucagacugcgaggagcuuagcugcccuaggaacuggcucggcuucacccuguuaacguccgguuacuucggcacacaccccccuaaaccaccuggcaaguguucccacggugggcacuucgacaggucuucuucccaaccgccuagaggaggcaucaauaaagauaguaccagcccaggauucuccccucaccacaugcuccacuugcaagccgccaaguuagcccuucucgcuucuauacaagccuuuucucuuuugagaucgcgccuaggugaucgagacuucucgagacuccuggauaucaccccugcuucuucauugucauuugugcuagacacaaccggcucaaugggcgaagagauuaaugccgcuaagauucaggcaagacaccugguagaacaacgacgcggauccccuauggaaccagugcauuauguucucguacccuuucacgauccuggcuucgguccaguguucacaacaucugaccccgacuccuuuuggcagcaacugaacgaaauccacgcgcuaggaggaggagaugaacccgaaauguguuugucugcacuacagcuggcacugcugcacaccccuccacugagcgauauuuuuguauucaccgacgcguccccaaaagacgcguuucuaacaaaucaaguagagaguuugacgcaagagaggcgcuguaggguuacauucuuagugaccgaagacaccuccagggugcaagggcgcgcaagacgagaaauauuguccccccuaagguucgaaccauauaaggccguagcuuuggcaucgggcggcgagguuauauuuacuaaagaucagcacauccgagaugucgcagcuaucgugggcgagucaauggcagcccuuguaacucugccuuuagaccccccuguugucgugccaggucagccucuaguguucucuguugacggccuuuugcagaagauuacaguucgcauccauggcgacauuucgagcuuuuggauuaagaauccagccggaguuucacaaggacaggaagaagguggcgguccacuuggccacacucgccguuucggacaguucuggauggugaccauggaugauccuccgcagacgggcacaugggagauucaggugacggccgaagauacaccuggcguucggguucaggcccagaccucgcuggacuuucuuuuucauuucggaauccccauggaggauggcccacaccccggucuuuacccccucacucagcccguggcgggucugcagacccaacugcuugucgaaucacagucuuggggcuccuccgcagcuuuccuuccccgccacccaagcagaggcccaagaggcugucgaacacgacccggagccuugggagcuagaggaacgaguggagcucggaguccccgaucauuggcgguagcccacgcagcaguucaccccuag

SEQ ID NO: 15067 - RNA, 5097 nt, Artificial Sequence
  Description of Artificial Sequence: Synthetic coding sequence
augcgauuacuguggggacucaucugggcaucuucuuucuucacacuuagccugcagaagccacgccuguuacuuuuuuccccuucuguggugcaccucggugucccucuguccgugggcguucagcuucaagauguuccccgcgggcaaguggucaaagggucaguuuuccugagaaacccuaguagaaacaacguuccaugcagcccaaagguggauuuuaccuuauccagugagcgcgacuuugcauugcugucauuacaggugccacugaaagaugcaaaaucaugcggacuccaccaguuacuucgcgggccugaaguucaauuaguggcgcacagcccguggcuuaaggauagccuuaguagaaccacaaauauccaagguaucaaucuccucuuuaguagcagacggggccaucucuucuuacaaaccgaccagcccaucuacaacccuggccaaagagugagguacagagucuuugcacucgaucagaaaaugagacccucaaccgacacaaucacagucaugguggagaacucucacggcuugcgcguucgaaaaaaagagguuuacaugccgaguucaaucuuccaggaugacuucgucauacccgacauuagcgaacccgguacauggaagauuucugcccgcuucucugauggcuuagaaaguaacucaucuacccaguuugagguaaagaaauacgugcuccccaacuuugaggugaagauaacgccuggaaaaccauauauuuuaacaguucccggucaucuggaugagaugcagcucgacauccaggcccgguacauuuacggcaaaccaguacagggaguggcauacgugcguuucggacuccuagacgaggauggcaagaagaccuucuuuagaggacucgagucccaaacaaagcuggucaauggccagagucacauuagucuaaguaaagccgaguuucaggaugcccuggaaaaauugaacaugggcauuacagaccugcagggccuaagacuuuaugucgccgcggcaaucauagaauaccccgggggugaaauggaagaagccgaacugaccucuugguacuucguguccaguccuuuuagccuagauuuguccaagacuaaacgccaccuggugccaggagcccccuuccuccuccaagcacuggucagagaaaugagcggcucccccgcuagcgguauuccugugaagguuucugcuacugucuccucaccaggcucaguucccgaagugcaggacauccaacagaacacugauggcucuggccaggucagcauaccaauaaucaucccacagaccauuuccgaacuccagcugucagucucggccggaagcccacaccccgccauagcccgucugaccguugcagccccccccuccgguggaccuggguuucugucuaucgagagacccgauucaagaccuccuaggguaggugacacauugaaccuuaaccuccgagcuguuggaucuggcgccacauuuucacacuacuacuauaugauccugagucgaggccaaauaguguuuaugaaucgugaacccaaaagaacucucacuucagucagcgucuuuguugaucaccaccucgccccgaguuucuacuucguggccuuuuauuaucauggcgaucacccagucgcaaauagccugcgagucgaugugcaagcaggagcuugugagggaaaacuggaacuuagcguugauggagccaagcaauacagaaacggagagagcgugaagcuucaucuugagacugacucuuuggcccucguggcacugggugcacuggacacagcccuguacgcugcaggaucgaagagccacaaaccucugaauauggguaagguguucgaagccaugaauuccuaugauuugggcugcggaccaggcggcggugauuccgcucugcaagucuuccaagcggcuggucuugccuucagcgauggcgaucaauggacccucuccagaaaaagauugagcugccccaaagaaaagacgacuagaaaaaaacguaacgugaacuuccagaaggccauuaacgagaagcugggccaauacgccucaccgaccgccaagcggugcugccaggaugguguuacuagauuaccgaugaugcgguccugugaacaacgcgccgccaggguucaacaaccagacuguagggaaccauuucuaagcuguugucaguucgccgaaucgcugaggaaaaaaucuagggacaaagggcaggcgggacugcagcgugcgcuagagauccuccaagaagaggaccugaucgacgaagacgacauucccguaagaucuuucuuucccgaaaauuggcuuuggagagucgaaacuguggaucgauuucagauccugacacuuuggcugccagacagccuaacaacuugggaaauacauggauugagccuguccaagacuaaaggucuuugcguggcaaccccaguccagcuccguguuuuucgcgaguuucacuugcaccuacgccucccuaugagugugcggcgguucgaacaacuggaacuucggcccguguuauacaacuacuuagacaaaaaucuaaccguuuccguucacguuucaccuguggaggggcugugucucgcaggaggaggaggauuagcccagcaggucuuaguccccgccggcucggcacguccaguugccuuuagcguaguacccaccgcugcagccgcggugucacugaagguaguugcucggggcaguuuugaauucccagucggggaugcuguguccaaagugcugcagauagaaaaggaaggcgcuauucaucgggaagagcuuguuuaugaguugaacccccuggaccaccguggucggacucuagaaauuccuggcaauucugaccccaauaugauuccagacggcgauuuuaauucuuaugugcgcgugaccgcgucugauccacuggacacccucggaucugaaggagcuuuguccccuggcgguguggcuagccuguuacgcuugccacgggguuguggggaacagacaaugaucuaucucgcuccaacauuagccgcaucacguuaccuugacaaaaccgaacaguggucaacccucccccccgaaacaaaagaucacgccguggaccucauacagaaagguuauaugcgcauacaacaguuccgcaaggcugacggcuccuacgcagccugguugucuagaggcaguucaaccuggcuuacugccuuuguccucaaggugcugagccuugcccaagaacagguaggcggcucaccugagaaacuucaagagaccucuaacuggcucuuaucucagcagcaagcagacggcuccuuccaagaccuaucucccgugauucaucgaaguaugcagggaggauuaguggguaacgaugaaaccguagcucucacugccuuugugacaaucgcacugcaccacggucuggcaguuuuucaggaugagggugcugaacccuugaaacagcggguugaagccuccaucagcaaggcuuccaguuuccuuggcgaaaaggcauccgccggccugcugggugcccacgcugccgcaaucaccgccuaugcucugacacucacaaaagcgccagcagaucugcguggcguagcacacaacaaccugauggcaauggcacaggaaacuggcgacaaccucuauugggggagcgugacgggcagccaaucgaaugcaguuucuccuaccccagcgccccgcaauccaucagacccaaugccccaagcaccagccuuauggauagaaacgacagcguaugcccugcuucauuuauuguuacaugagggaaaagcagaaauggccgaucaggcagccgcauggcugacacggcaggguagcuuccaagguggcuuccgcucuacacaggauaccgucauugcccucgaugcacucuccgcauacuggaucgcuucucacacuaccgaggaaagaggacugaacguuacgcugucaucuacaggccgcaacggauucaaaucacacgcccuucaacuuaacaaccggcagauacgggggcuggaagaagaacugcaguuuucucuugggaguaagauaaauguaaaagucggugguaauaguaaagggacacuaaaaguccuuagaaccuacaacguccucgauaugaaaaacacuaccugccaggacuuacagaucgagguuaccguuaagggucaugucgaauacaccauggaggccaaugaagacuacgaggacuacgaguaugaugaauugccagcaaaagacgacccggaugcccccuugcagcccgugaccccccugcaguuguucgaggggagaaggaacagacgcagaagggaggcuccaaaacuaaccagccugucugaccgauacguaagccacuucgagacagagggcccucacguucuccuauauuucgacucggugccaaccaguagagaguguguuggauucgaagcagugcaagaagucccugugggucucgugcaaccggcuagcgcaacucucuaugacuauuauaaccccgaaagacguuguucaguuuuuuauggagcuccauccaaaucccggcuguuggcaacauugugcucagcagaaguuugucagugugcggaagguaaguguccgagacagagaagagcucuggagaggggccugcaggaugaggauggcuaccguaugaaguucgcaugcuauuauccaagaguggaauauggauuccaggucaaggugcugagagaggauucuagagcugccuuucgguuauucgaaacaaaaauuacucaaguucuacauuucaccaaggacguuaaggccgcagcaaaccaaaugagaaacuuccugguccgggcuagcugcagauuacguuuggagccagggaaggaauaucuaaucaugggacuugauggcgccacauaugaucucgagggccauccgcaauaucuccucgauaguaacuccuggauugaagagaugccuagcgagagauugugccgguccacacgccagagagcugccugcgcccaacugaaugacuuccugcaggaauacgguacccagggcugccagguuuag

SEQ ID NO: 15068 - RNA, 726 nt, Artificial Sequence
  Description of Artificial Sequence: Synthetic coding sequence
augaaauucauucuucuuugggcucuuuugaauuuaacagucgcucuggccuuuaacccggauuauacaguuuccuccaccccuccuuaccuugucuaucuuaaaagcgauuaucugcccugcgccggcguccucauacaccccuuauggguaaucaccgcugcccacugcaaccucccaaagcuaagagugauuuuaggcgugacuaucccugccgacucuaacgagaaacauuuacaaguaaucggcuaugagaagaugauucaccacccgcacuucuccgucaccaguauugaccacgauauaaugcugauuaaacugaagacagaagccgagcuuaacgacuauguaaaauuagcgaaucugcccuaccagacaaucagugaaaacaccaugugcaguguaucaacuuggucauauaaugugugcgauauauacaaagaaccugauucccugcagaccguaaauauuagcgugaucucaaagccacagugcagagaugcuuauaaaaccuacaacaucacagaaaauaugcuuugcgucgggauugugccuggccgaaggcagccuugcaaggaggucuccgccgcucccgcgaucugcaacgggauguuacaagggauucucucuuucgcugaugggugcguucugcgggcggacgucggaauuuacgcuaaaauuuucuauuauauacccuggauugagaaugugauucagaauaacuag

SEQ ID NO: 15069 - RNA, 732 nt, Artificial Sequence
  Description of Artificial Sequence: Synthetic coding sequence
augggacccgaagcucuuucuucucuccuacuccuauugcuuguugccuccggcgaugcugauaugaagggccacuuugacccugccaagugucgcuacgcuuugggcaugcaggacaggacuauuccggauucugacauuucagcauccuccuccuggagcgacucuacugccgcgagacacagccggcuggaaaguuccgacggagauggugcauggugcccugcaggaucugucuuuccaaaagaagaggaguaccuccaagucgaucugcaacgacuucacuuaguggcgcugguagggacgcagggaaggcaugccggaggacugggcaaagaauucagucguucuuaucgccugcgguauagucgugauggacggcgauggauggguuggaaggacagauggggccaagaggugauuucaggcaaugaagauccagagggcgucgucuuaaaagaucugggaccuccuaugguggcgcgguugguccgcuuuuacccccgagccgacagggugaugucugucuguuugaggguggaguuauacggaugucucuggagagauuguucuaugggagucugggcuaguuggcagauggugugguggggauggaugacuuuagguagagugcggagcugcggcucagggcaagccaugacaaugugggacggggcgacaacagcuucacccguggcaauguggagguggagccucucccugacuggauag

SEQ ID NO: 15070 - RNA, 1986 nt, Artificial Sequence
  Description of Artificial Sequence: Synthetic coding sequence
auggaccuuguucuuaagcguugucugcugcauuuggccguuauuggcgcccuguuggcagugggagcgaccaagguuccgagaaaccaggacuggcuuggaguaagucgucaacuaagaaccaaagccuggaaccggcagcuuuauccugaauggacagaggcucaacgacucgacugcuggcgaggaggucaagugucgcugaagguuuccaaugacgggccaacguugauuggggcaaacgcuagcuuuaguaucgcacucaauuucccaggaucucaaaaaguccuuccagacggccagguuauuuggguuaacaauacaauaaucaaugggagucaaguuuggggcgggcaaccggucuauccacaggaaaccgaugacgcaugcauuuuccccgacggcggacccuguccuucaggauccuggucacagaaacgaagcuuugucuacguguggaaaacauggggccaauauuggcaaguacucggggguccugugagugggcuguccaucggcaccggcagagccauguuagggacacacacgauggaaguaacuguguaccaccggagaggguccaggucauauguaccacucgcacauuccuccuccgcuuucacaauuacagaccaagugccauucucugugagcgugucacagcuucgagcccuggauggaggcaauaagcacuuccuucgcaaucagccauugacauucgcuuuacagcugcaugacccaucgggauaccucgcggaggcugaccugagcuacacaugggacuucggcgauagcucuggaacccugauuucgcgugcuuugguagucacucacaccuaucucgaaccugguccaguaaccgcucaaguuguacugcaggcggcgaucccacucacuucaugcggcagcagucccguaccaggcacaacugauggacauagaccaacggcugaagcaccaaacacuacagcuggucaggucccaaccaccgaagucgugggcacuaccccgggacaggcucccacagccgagcccucuggaacuacuucaguacagguaccaacaacagaagucauuucaacugccccuguccagaugccaacagcagaaucaaccggcaugaccccagaaaaggugccaguuucugaaguuaugggcacgacgcucgccgagaugagcacuccugaggccacagguaugacccccgccgagguauccauuguuguucuuuccggaacaaccgccgcccaagugaccacgaccgaauggguggagacuacagcccgcgagcuucccauccccgaaccggagggucccgaugcuuccaguaucaugucgaccgagagcauuacaggcucccuuggccccuugcucgaugguacugccacccuuagauuagugaaacgccaaguuccccucgacuguguacuuuacagauauggcucuuucagcgucaccuuggauaucguucaggguaucgagucugcagaaauccugcaagcugugccaagcggagagggagacgcauucgaguuaacugugagcugucaaggaggccugccuaaggaagccuguauggagauuucuagcccuggaugccaaccccccgcucagcgccugugucaacccgugcugcccagcccagccugccagcuggucuugcaccagauucugaagggcgguucaggcacauauugucucaaugugucucuagcggacacuaauucucuugcuguggucucuacccaauugauaaugccaggccaggaggcuggacuuggccaaguuccucugaucguuggcaucuugcucgugcuuauggccgugguucucgcuucccugauuuaucgucggcguuuaaugaagcaggauuucucuguuccacaacugccacacaguucuucccacuggcugagacucccccguauauuuugcucauguccgauuggugaaaauucuccacugcucucugggcaacagguauag

SEQ ID NO: 15071 - RNA, 2760 nt, Artificial Sequence
  Description of Artificial Sequence: Synthetic coding sequence
augggacccgaagcucuuaguucucugcuacuccuguuguugguagcaucuggcgacgcugauaugaaaggacacuucgaucccgcaaagugcagguacgcucugggaaugcaggaucggacgauucccgacagcgauaucucugcaagcaguaguuggucagauuccacagccgccagacacucuagacuggaaagcucugacggcgauggagccuggugcccagcaggaagcgucuuuccgaaagaagaggaauaccuccagguggauuugcagcgccuucaucucguugcucugguggggacgcaagggagacaugcuggaggauuggggaaagaguucagucggagcuaucggcugcgauacaguagggacggccgacgcuggaugggauggaaggaucgcuggggccaggaagugauuagcggcaacgaggauccggaagggguuguacugaaagacuuaggcccuccaaugguugcaaggcuggugcgguucuaucccagggcugaucgcguuauguccgugugccugagaguagaacucuauggaugucuguggcgggaugggcuuuugagcuauacagcuccugucggacagacuauguauuuauccgaagcgguuuaccugaaugacagcacauaugacggacauaccguugggggccuucaguacggaggacugggacaguuggcagauggcguggugggucuggacgacuucaggaagucgcaggaauuacgagucuggccuggcuacgauuaugugggauggucaaaccacagcuuuucauccggguauguggaaauggaauucgaauuugaucgccugcgugcauuucaagcgaugcagguacacugcaauaacaugcauaccuugggcgcccgacugccugguggggucgaaugccgauuuaggaggggaccugcgauggccugggagggugagccaaugaggcauaacuuaggcggcaauuuaggcgauccaagagcuagggcaguuucuguuccucucggagguagaguggcucgcuuucugcagugcagguuucucuucgcuggaccauggcugcuauuuuccgaaauaaguuucauuagcgauguuguuaauaacucuucaccagcucucgguggcaccuuuccucccgcaccgugguggccaccaggaccuccgccuacaaacuuuuccagccuugaacuggagccgagaggucagcagcccgucgcuaaggcugaggguagcccaaccgcgauccugauugguuguuuggucgccauaauucuauugcugcugcucauaaucgcuuuaauguuguggagacuucacuggcgccgccugcuguccaaagccgaacgucgcgugcuggaagaggaacucaccgugcaucucuccgucccuggagauacaauucugauaaauaaccggccuggcccaagagagcccccuccauaucaggagcccagaccuaggggaaauccaccucauuccgcaccauguguucccaaugggucugcacuucuuuugagcaauccagcuuauagauugcuccucgcgacuuacgcacgcccgccacgaggaccuggcccaccgacaccagcgugggcuaaaccgacuaauacgcaggcuuauaguggcgacuacauggaaccagaaaagccuggcgccccucuguuaccuccaccuccucagaacucugucccgcauuaugccgaagccgauauuguuacccugcaaggugucaccggaggaaauacguaugcagucccugcccuuccccccggagcugugggcgacgggccuccccgaguugacuuuccaagaucgagacugcgguuuaaggaaaagcuaggcgaagggcaauuuggagaagugcaucuuugcgagguagauagcccccaagaccuuguuagccuugacuuuccccucaauguucgcaagggccacccccugcucgucgcuguuaaaauacuccgucccgaugcaaccaagaacgccagcuucagccuuuuuucucgaaaugacuuccucaaggaagugaagauaaugucccgcuugaaggacccgaacaucaucagacugcuuggagugugcgugcaggaugauccacuguguaugaucaccgauuacauggaaaacggagaucuaaaccaguuucuuagcgcccaccaacuugaagacaaggcugcugaaggagcaccgggugacggacaagcugcccagggcccaacaauaaguuacccuaugcugcugcauguugcugcccaaauagcuuccgguaugagguaccucgcaacacuuaacuuuguccacagggaucucgcuacucguaacugccucgugggagaaaacuuuaccauuaagauagccgacuuuggcauguccagaaaucucuaugcuggugauuauuaccguguccaaggaagagccgugcugccgauuagauggauggccugggaaugcauucucaugggaaaauuuaccaccgcuuccgacguuugggcauucggaguuacacuaugggagguucuuauguugugucgagcacagccuuucggacaacugacagaugaacaaguaauugaaaacgccggcgaauucuucagggaucagggcagacaggucuaucuauccagaccccccgcuugcccucaagggcuuuaugagcuaaugcugcgcugcuggaguagggaauccgaacagcgacccccauucucacagcuccaccgauuuuuagcagaagaugcacuuaacaccguguag

SEQ ID NO: 15072 - RNA, 216 nt, Artificial Sequence; identical to SEQ ID NO: 13433
  Description of Artificial Sequence: Synthetic coding sequence

SEQ ID NO: 15073 - RNA, 2685 nt, Artificial Sequence
  Description of Artificial Sequence: Synthetic coding sequence
augucccuaccacggugcugcccacacccccuuagacccgaagguucaggugcuaugggccccgaagcccugucuucccuacuauugcugcuccuuguggcaucuggcgaugcggacaugaagggccacuuugaucccgcaaagugccgcuacgcgcucggaaugcaggacaggacuauaccagauuccgacauaucagcuucuuccucuuggucagauaguacugccgcucggcauagccggcuugaauccagcgacggcgacggggcguggugccccgcugguucuguguuuccaaaggaggaggaguauuuacagguggaccuucaacgccugcacuugguugcucuuguagggacccagggaagacacgccggggggcucgggaaggaauucaguaggucuuauaggcuccgauacagucgugaugguagacgguggaugggcuggaaagacagauggggucaggaggucauaaguggcaaugaagauccagaggguguaguccugaaagaccuaggcccuccgaugguggcucguuuggugagauucuauccccgugccgauagagugauguccgugugccuucgagucgaacucuaugggugccucuggagggacggacuccuuagcuauacggcucccguaggacagacaauguaccugucagaggcugucuaccugaacgauaguaccuaugacggacacacugucggcggccugcaguaugggggucucgggcaauuagcagacgggguggucggauuggacgauuuuaggaagucucaagaacuuagaguuuggcccgguuacgauuaugugggguggucuaaucauagcuucagcucuggauauguugaaauggaauucgaauuugaccgguugagggcuuuucaggccaugcaaguccacugcaacaauaugcacacucuuggagcuaggcugccuggagguguggagugucguuuccgccgcgguccugccauggcuugggaaggagaacccaugagacauaaccugggcggaaaccugggugacccaagggccagagcugucagcgugccgcugggagguaggguugcuagguuuuuacaaugucgauuccuuuucgccggccccuggcuucuguucucagaaauuuccuuuaucagcgacgugguuaauaauagcagucccgcccuaggcgguaccuuccccccggccccaugguggccccccgggccaccccccacaaauuuuucaagccuugagcuggagccaagaggucaacaacccguugccaaggcugaagggucaccaacugcuauucugauuggcugucuuguugcuauuauccugcugcuuuuacucauaauugcucuuaugcuguggcgauuacacuggcgcagacuccugucaaaagccgagagaagagugcucgaggaggaacuuacagugcaccugucugucccaggagacaccaucuugaucaauaaccgcccuggaccaagagaaccaccucccuaucaagaaccccgaccuagaggaaacccaccccauagcgcccccugcgucccuaauggcagcgcguacucaggggauuacauggaacccgagaagccaggcgcuccuuuacuaccccccccgccucaaaauuccgugccucacuacgcugaagcugacaucgugacauugcagggcgugaccggagguaacacuuacgccgugccugcucugccccccggagcaguaggugacggucccccuagaguggacuuuccaaggagccgccugagauuuaaagaaaaacugggugagggacaguuuggcgaaguccaccuuugugaagucgauucuccacaggaccuuguuagccucgauuucccccuaaacgugcgaaaaggccacccccuguuggucgccgugaaaauucuuaggcccgaugcgaccaagaacgcaaggaaugauuuccugaaagaaguuaagaucaugagccgguuaaaggaccccaauaucaucaggcuacuuggaguuugcgugcaggaugauccccuuuguaugaucaccgacuacauggaaaauggcgaccucaaccaguuucugucagcacaucagcucgaagacaaagccgccgaaggcgcccccggcgacggacaagcggcccagggcccuacaaucucauauccgaugcuguugcauguugcggcgcaaauugcuucuggcaugagauaccuggcgacucucaauuucguacacagagaccuggcuacaagaaacugccucguuggcgaaaauuuuacaauuaagauagcagacuucgggaugucuagaaacuuguaugccggcgacuauuacagaguacaaggccgugccguucugccaauuagauggauggccugggaaugcauacugauggguaaguuuacaacagcgagcgacgugugggccuucggugugacucuuugggaaguccuuaugcugugccgcgcccagcccuuuggucagcugacagacgaacaaguuaucgaaaacgcaggcgaauucuuuagagaccagggccgucagguuuaccuuagcagaccaccagccuguccucaaggacuguacgaguugauguugcgauguuggucaagggagucugagcagcgcccacccuuuucacagcugcaucgauucuuagccgaggaugcuuugaacaccguuuag

SEQ ID NO: 15074 - RNA, 273 nt, Artificial Sequence; identical to SEQ ID NO: 13435
  Description of Artificial Sequence: Synthetic coding sequence

SEQ ID NO: 15075 - RNA, 618 nt, Artificial Sequence
  Description of Artificial Sequence: Synthetic coding sequence
augaugcggacccucauuaccacacauccauuacccuuacuccugcucccacagcaacugcugcaacuaguccaguuccaggagguagauacagacuucgacuucccagaggaagauaaaaaggaggaauuugaagaaugucuagaaaaguucuuuucgaccggcccugccagacccccuacaaaggagaaagugaagcgaaggguauugaucgagccggguaugccccucaaccacauugaauauugcaaccacgagauuaugggcaagaauguguacuacaagcauagauggguugccgaacauuacuuucuccuuaugcaguacgacgagcugcagaaaauuuguuacaacagauucgugcccugcaaaaaugguauccggaagugcaaccgaucuaagggacuuguggaaggcguuuacuguaacuugacagaggcguucgaaauacccgcuugcaaauaugaaagcuuguauagaaaggguuauguauugauuacauguucuuggcagaacgaaaugcagaagagaauaccgcauacuauuaaugaccugguugagccccccgaacaccgcucguucuugagugaagauggcguuuuuguaauuucaccuuag

SEQ ID NO: 15076 - RNA, 30 nt, Artificial Sequence; identical to SEQ ID NO: 13437
  Description of Artificial Sequence: Synthetic coding sequence

SEQ ID NO: 15077 - RNA, 600 nt, Artificial Sequence
  Description of Artificial Sequence: Synthetic coding sequence
augucuuucagugcaacgauccuguuuuccccaccaucuggaucugaagcaaggugcuguugcugcgcguguaaaagcgagacaaacggugguaauaccggaucucagggagggaacccaccccccagcacgccuaucacagucaccggccacggacuggccgugcaaucaagcgaacaacuacuacacgucauauaccaaaggguugauaaggccgucgggcuggcagaagccgcucuuggacuugccagggcuaauaacgaacugcuuaaaagauuacaggaggaagugggcgaccuccggcagggaaaagugucuauuccggacgaggacggcgaauccagggcacauucuagcccucccgaagagcccggaccccuuaaagagucacccggagaggcuuuuaaggcccugagcgcaguggaagaggaaugugauagcguuggcagcgggguacaggucguuauugaggaacugagacagcuaggggcugcuucugugggaccgggaccccuuggguuuccagccacucaaagagauaugcgacucccuggcugcacauuagccgccuccgaggcagcaccauugcugaacccauag

SEQ ID NO: 15078 - RNA, 633 nt, Artificial Sequence
  Description of Artificial Sequence: Synthetic coding sequence
augucggccggaaaaaugaugcgcacccuaauuaccacccauccacucccuuuacugcugcucccacagcaacuauuacaauuggugcaguuucaagaaguagauacagacuuugacuucccagaggaggacaaaaaggaagaauuugaggaaugcuuggagaaauuuuuuagcaccggcccagcgagaccacccaccaaagaaaagguuaagcggcguguucuuaucgagccuggcaugccccucaaccacauagaauacugcaaccacgagaucaugggaaagaacguauacuacaaacaccgguggguggccgaacacuauuuucuccugaugcaauacgaugagcuucaaaagaucuguuacaaucgcuucgugcccugcaagaacggaaucagaaagugcaaucgcucaaaaggcuugguggaggggguguacuguaauuugacugaggcuuucgaaauccccgccuguaaauacgaaagcuuauaucguaaggguuacguucuaaucacauguuccuggcagaaugagaugcaaaagagaauaccgcauacaaucaaugaucucguagagccuccagaacaucgauccuuucucuccgaggacggcguguuugugauuucccccuag

SEQ ID NO: 15079 - RNA, 1221 nt, Artificial Sequence
  Description of Artificial Sequence: Synthetic coding sequence
augcagcuguuccugcuccugugucuaguccuguuaagcccacagggcgccagucuucauagacaucacccgcgagaaaugaagaagagaguggaagaucugcacgugggagccaccguagcgccgucauccagaagagacuucacuuucgauuuguaucgggcacuugcguccgccgcuccaagccaguccauuuuuuuuucaccugucaguaucucuaugucucuagcuauguuaucacugggcgcuggguccucaacuaaaaugcaaauccuggaaggccugggacugaaucuccagaaguccucagagaaagaacuucacagaggcuuucagcagcuacugcaggaacuuaaccagccuagggacggguuccaacucaguuuagggaacgcucuguuuacagaccuggugguagaccuucaggauacauucgucagcgcuaugaaaacauuguacuuggccgauacuuuuccaacaaauuuccgcgauucugccggggcuaugaaacagauuaaugauuacgucgccaagcaaaccaagggaaaaauagucgaccuucugaaaaaccuugauagcaaugccguugugaucauggugaauuacaucuucuucaaggcaaagugggagacuaguuucaaccauaagggaacgcaagagcaggacuuuuacguaacuucagagacaguugugagagugccuaugaugagcagggaggaccaguaccacuaccuuuuggaccguaaucuaucuuguagggucguuggggugccguaccagggcaacgccacagccuuguuuauucuccccagugaagggaagaugcaacaggucgagaacggacuguccgaaaaaaccuuaaggaaauggcucaaaauguucaagaaacgacaacucgaacuguauuuaccuaaauuuaguauugagggcaguuaccagcuggagaaaguccuuccaucccuugguauuucuaacguauucaccucccacgcugacuuaagcgguauuucaaaccauucuaacauacagguaagcgagaugguacauaaggcaguuguugaaguagaugagucaggcacuagagccgccgcugcuaccggcacaauauuuacauuuagaagcgcaagauuaaacagucagaggcugguguucaauaggccuuuccugauguuuauugucgauaacaauauucuguuccugggcaaagugaauagacccuag

SEQ ID NO: 15080 - RNA, 600 nt, Artificial Sequence
  Description of Artificial Sequence: Synthetic coding sequence
auggagaccuuuccucuccuacuguuaucccucggcuuaguucuggcugaagcuuccgaguccacgaugaaaaucauaaaagaggaauucacagacgaagaaaugcaguaugacauggcuaaaucuggacaggaaaaacagacaaucgaaauacugaugaauccuauccugcuggugaagaauacuuccuugucgauguccaaggaugauauguccuccacccuucugaccuuucgcagccuucacuacaaugacccuaaagguaauaguucuggaaacgauaaagaguguuguaacgauaugacaguguggcggaaggugucagaggcuaacgguagcugcaaaugguccaauaauuucauucguucgucaaccgaggucaugcggcgcguccacagagccccuuccugcaaauuuguccagaaucccgggauuucuuguugcgaaucccucgaauuggaaaauaccgugugucaauuuaccaccggcaagcaguucccaaggugccaguaucauucagucacaagccucgaaaagaucuuaacgguccugacgggccauucucuuaugucuuggcucguguguggguccaaauuguag

SEQ ID NO: 15081 - RNA, 411 nt, Artificial Sequence
  Description of Artificial Sequence: Synthetic coding sequence
augaguuucagcgccacuauucuguucucuccuccaucgggcuccgaggcuagauguuguuguugugccugcaaauccgaaaccaauggaggaaacacugguagucagggggguaauccuccaccguccacacccaucaccguaaccggccaugggcuggccgugcaaucguccgagcaauuacuacacgugauuuaucagcgcguggacaaagccguagggcuggccgaggcugcauugggacuagcuagagcaaacaacgaacucuugaagaggcuccaggaagagguaggggaccuucggcaagguaaagugaguauuccagacgaggauggagagucccgcgcccauucgucuccucccgaagagccaggaccauuaaaagaaagcccaggagaggccuucaaguag

SEQ ID NO: 15082 - RNA, 252 nt, Artificial Sequence; identical to SEQ ID NO: 13443
  Description of Artificial Sequence: Synthetic coding sequence

SEQ ID NO: 15083 - RNA, 30 nt, Artificial Sequence; identical to SEQ ID NO: 13444
  Description of Artificial Sequence: Synthetic coding sequence

SEQ ID NO: 15084 - RNA, 519 nt, Artificial Sequence
  Description of Artificial Sequence: Synthetic coding sequence
augcagcucuuucuacuccucugccucguguuacuuaguccucagggagcaucacugcauagacaccacccaagggagaugaaaaaaaggguagaggaccuccacguuggggcuacaguggcaccuucaaguaggcgagauuucacuuuugaccucuaccgcgcucuggcuucggccgcuccaucccaaagcauauuuuucaguccugucucuauuagcaugucgcuugcuaugcugagucuuggcgcaggcuccucaaccaaaaugcagauacucgagggccuaggcuugaacuugcagaagucaucggaaaaagaacugcaucgaggauuucagcagcugcugcaggaacuaaaucagccgcgggacggauuucagcuuagucuaggcaaugccuuguuuaccgaccucguugucgacuugcaagacacauucgugagugcaaugaaaacacuuuaucucgcugacacuuuccccaccaauuuucgagauuccgcuggcgccaugaaacaaaucuag

SEQ ID NO: 15085 - RNA, 615 nt, Artificial Sequence
  Description of Artificial Sequence: Synthetic coding sequence
augccugggggcaaaaaaguugccggcggcgggagcagcggggccacuccaacaagcgcagccgcgacagcccccagcggcgugagaaggcuggagacaucugaaggaacaagugcacagagggaugaagaacccgaggaagagggagaagaggaucugagagauggcggugugccuuucuuugugaauaggggagggcugccggucgaugaggcaacgugggagcgcauguggaaacacguugcaaagauacaccccgacggugaaaaaguagcacagagaauucguggcgccacugaucuaccaaaaauucccauuccuuccgugccuacguuccagccgucaacaccgguaccagaaagacuugaggccguccagcgguacauucgugaacugcaguacaaucacacuggcacccaauucuucgagauuaaaaagagcagaccccucacgggacugauggaccuggcaaaggagaugaccaaggaagcccugccaauuaagugccuggaagcugucauccugggaauguaucccagcucuccagagggcgaaggauccggauuauuaugggcuucugcuagcugcagugaaagugagggaggagugggauag

SEQ ID NO: 15086 - RNA, 1221 nt, Artificial Sequence
  Description of Artificial Sequence: Synthetic coding sequence
augcagcuguucuuacugcuaugucucgugcugcucucuccacaaggugccucuuugcacaggcaucacccaagggaaaugaaaaaacgagucgaagacuugcaugucggugcaacuguggccccaagcucucgucgcgauuuuacauucgaccuguaccgcgcucucgcgucagcugcucccucccagaguauauucuucagucccgugucaauaucuaugucgcuggcaaugcucagccugggcgccggauccaguacaaaaaugcagauccucgaaggccucggccuuaaucuccagaaaaguagcgaaaaagaacuacacaggggauuucaacaacugcugcaggaacugaaccagccacgggauggauuucagcucucauuaggaaaugcauuauucaccgaccuuguuguggaccugcaggacacauuugucagcgccaugaaaacuuuguaccuggcggauaccuuccccaccaacuucagggacagugccggagcaaugaaacagauuaaugacuaugucgccaaacaaacuaaggguaaaauuguagaucuacugaagaaucuagauuccaaugcuguuguuauuaugguuaauuauauuuuuuucaaggccaaaugggagaccuccuuuaaccacaaggggacucaggagcaggauuucuaugucacuagcgagaccgucgucagaguacccaugaugagcagagaagaccaauaccacuaucugcuggaccguaaccugucaugucgaguggugggcgugcccuaccaaggcaaugcaacagcccucuuuauuuuaccuuccgaaggaaaaaugcaacaaguggaaaaugggcuguccgagaagacccucaggaaauggcuuaagauguuuaaaaaacggcaacuggagcuguaccucccuaaguucucaauugaggguaguuaucaacuagaaaagguucuccccagcuuagguauuagcaauguuuucacaucacaugcagaucugucaggaauuuccaaucauucgaacauccaggugucagagauggugcacaaagccguagucgagguggacgagagugggacacgggccgcagccgcuacgggaacaaucuuuaccuucagaucagcucgguuaaacagucagcgauuaguguucaaucgaccuuucuuaauguucauuguggauaacaauaucuuauucuuaggaaaaguuaaccggcccuag

SEQ ID NO: 15087 - RNA, 3837 nt, Artificial Sequence
  Description of Artificial Sequence: Synthetic coding sequence
augagacuguuacuguugguuccacuauuacuggccccagcccccgguucaagugcccccaaggugcgcagacagagcgacaccuggggaccauggucccaguggagucccugcucuagaacguguggcgguggagucucauuucgagagaggccuuguuauucccagcgccgggacgguggaaguuccugcguugguccggcuagaagccauagaagcuguaggaccgaaaguugcccagauggcgcacgggauuuucgcgccgagcagugcgccgaguuugacggagcggaauuucagggacgacgcuacagguggcuaccguacuauucagcaccaaacaagugugaauuaaacuguauaccaaagggagaaaacuuuuacuacaaacaucgcgaagcugugguggacggcacaccuugcgagccagguaaacgagacgucuguguagacggaaguugcagaguuguuggaugugaccacgagcuugauaguucaaagcaggaggauaaaugcuuacggugcggcggggaugggacaaccugcuaccccguagccgggacuuuugacgcuaaugaucugucccggggcuauaaucagauccugauaguccccaugggcgccaccagcauacuuauugacgaagcugccgccucuaggaacuuucuggccguuaagaauguaaggggcgaguacuaccugaacgggcauuggacuaucgaagcagcacgcgcacuaccugccgccuccacgauucuacacuacgagcguggcgcagaaggagaucuggcgcccgaacgucuccaugcgcgcgggccaacuucagagccauuaguaaucgaacucauuucgcaggaacccaacccaggagugcacuacgaguaccaccucccgcuucgccgaccaucgccaggguucucauggucgcacggaagcuggagugauuguuccgcagagugcgguggcgggcaccagucaagauugguuuuuuguacaauugaucacgaagcauacccagaccacaugugccaacggcagccgagaccagcugacagaagaucuuguaaucugcauccuugcccagaaaccaaacgguggaaggccggaccgugggccccuuguucagccucuuguggcgguggcucccagucucggucugucuacuguaucucuuccgauggcgccggaauucaggaggcuguugaagaggccgaaugugccggacucccaggcaagccuccggcgauccaagcaugcaauuugcagaggugcgcugcauggagcccagaaccuuggggcgaauguucaguguccugcggcguuggagucaggaagcgaucugugacuugcagaggcgaacgagggagccucuuacacacggccgcuugcuccuuggaagaccgcccuccguugaccgaaccaugcgugcacgaagacuguccacuauuaagcgaccaggccuggcaugugggaacauggggcuuauguuccaaaucuugcucuagugggacaagacggagacagguaauaugugccauaggaccccccagucacugcgggucuuuacaacauucuaaacccgucgauguggagccguguaauacccaaccgugccacuugccucaggaggucccaucuaugcaggacguucacacaccagccaguaaucccuggaugccucuaggaccacaggagucuccggcuucugacucaaggggccaguggugggcagcacaagaacauccuagcgccagaggagaucacagaggggaaaggggagauccacgaggggaucagggcacacaucugucagcccuugggccagccccgucucugcagcaaccaccuuaccaacaacccuugcggucaggguccggcccacacgauugcagacauaguccccauggcuguuguccagacggccacacugccucuuuaggaccucaguggcagggcugucccggcgcaccuugucagcagagcagguacggcuguuguccugaucgcguuagcguugccgaagggccccaccacgcuggcugcaccaagucauauggcggagauucaaccggagggaugccccggagcagggcuguggccuccacagugcauaacacacaccaaccacaagcacaacagaacgaaccauccgagugccgaggcucacaauucggcuguugcuaugacaacguugcaaccgcagcugggccccugggagaaggaugcgugggacaaccuucucaugccuaccccgucaggugccugcuaccgagcgcccacgguuccugcgcagacugggccgcucguugguacuucgucgccuccguuggccaguguaauagguucugguauggcggcugucacggaaaugcaaacaacuuugccagcgaacaggagugcaugucauccugccagggcucccugcacggaccucggcgcccucagccuggcgcaagugggaggaguacacacacagacggaggggggagcucaccagcaggcgaacaggaaccaucacaacaccgcaccggagccgcgguucagaggaagccuuggccauccggggggcuauggagacaggaccagcagccuggcccuggagaggccccacauacacaggccuucggcgaauggccuuggggucaggagcugggaucccgugcaccuggacuagggggugaugcaggaucccccgcgccucccuuccauucgucaucuuaccgcaucucgcuggcgggcguugaaccuucccuuguccaagccgcucuaggucaauuaguucgccucagcuguagugaugauaccgcccccgagucccaggcagcauggcaaaaagaugggcaaccaauuagcagugauaggcacagacuccaguuugacgguucucuaaucauucacccccugcaagcugaagacgcgggcacauacucuugcggaucgaccaggcccggccgugacagucagaagauucaguugcguauuaucggaggcgauauggcgguccugucugaagccgagcuguccagguucccgcaacccagagaccccgcccaggauuucggucaggccggggcagccgggccccucggagcaauccccagcucgcacccacagccagccaaccgcuugcgacuggaucagaaccagccacgagucguugaugccucucccggacaacgcaucaggaugacuugccgagcggaaggauuuccaccccccgcgauugaauggcagagagauggucagccagucagcucaccucgucaccagcuucagccagauggcagccucgucauuagccggguggcuguggaggaugggggguuuuauacuugcguagcuuuuaacgggcaggacagagaccagcgaugggugcagcugagaguucugggagaguuaaccaucagcgggcuaccaccaacuguaaccguaccugagggugacaccgcgagacugcugugugucguagcuggagaguccguuaauauucgauggucacgaaaugggcugcccguucaggcugauggucacagggugcaccagagccccgacggaacacuucugauuuauaaccugagagcaagagaugagggguccuacacauguagugccuaccaaggaucucaggcaguauccagauccacugaagugaaggucgucuccccagcaccaaccgcccagccaagagacccaggacgcgauugcguagaccagccggagcucgcuaauugugaccucaucuugcaagcccaacugugugggaaugaauacuauucuuccuuuuguugcgccucaugcucuagguuucaaccgcacgcucagccaauauggcaguag

SEQ ID NO: 15088 - RNA, 261 nt, Artificial Sequence; identical to SEQ ID NO: 13449
  Description of Artificial Sequence: Synthetic coding sequence

SEQ ID NO: 15089 - RNA, 906 nt, Artificial Sequence
  Description of Artificial Sequence: Synthetic coding sequence
augcaguuguuccuacuccuuugccugguccugcucuccccucagggagcuagccuccacagacaucacccccgugagaugaaaaaacggguugaggaucuccauguuggugcuacagucgccccaaguucacgcagagacuucacuuucgacuuguaccgugcccucgcaagugcugccccuucccagagcauuuuuuucagcccugugucuauuucuaugucccuggccaugcugucucucggagcuggcuccuccacuaaaaugcaaauacuggaaggccuuggucugaaccuccaaaaaucuagugaaaaagaacugcaucgcggauuccagcagcugcuucaggaacugaaucaaccgagggacggauuucaguugagucucggcaaugcucuuuuuacugaucugguuguggaucuacaggauaccuuugucuccgcaaugaagacacuauauuuagcagauacguucccuaccaauuuuagggauagcgcuggcgcaaugaaacagaucaacgauuacgucgcuaaacaaacaaaagguaaaauaguggacuugcuuaaaaauuuagauagcaaugcgguuguuauuaugguuaauuacaucuuuuucaaagcuaaaugggagacuucauuuaaccauaaagguacucaggaacaggauuucuaugugacgagugaaaccguugugagaguucccaugauguccagggaagaucaguaccacuacuuguuagaucggaaccuauccugccguguuguuggagugcccuaccaaggcaaugccaccgcucuuuuuauccugccaucugagggcaagaugcagcaaguugaaaauggacucagugagaaaacccuccggaaauggcucaaaauguuuaagaagcguuacuuucagacauag

SEQ ID NO: 15090 - RNA, 411 nt, Artificial Sequence
  Description of Artificial Sequence: Synthetic coding sequence
auggagaccuucccccuccuguuacucagucuuggacucgugcuugccgaagccucugaauccacaaugaagaucauaaaggaggaauucacagacgaggagaugcaauacgauauggccaaaaguggacaggaaaagcaaacuauagagauacugaugaaucccauacuacucgugaaaaacaccucccucucuaugagcaaagacgauaugaguuccacccuccugacauucagaucucugcauuauaaugauccaaagggcaauuccagcgguaaugauaaggaauguuguaaugacaugaccguguggcgcaaaguaagugaagccaauggaagcuguaaaugguccaauaauuucauccggucuaguacagagguuaugcgcagaguucauagggcccccaguuag

SEQ ID NO: 15091 - RNA, 1221 nt, Artificial Sequence
  Description of Artificial Sequence: Synthetic coding sequence
augcagcuuuuccuguugcugugucuuguacuucuaagcccccagggggccagucuccaccgucaucauccuagggaaaugaagaaacgaguagaggaccuucacguuggcgcuacuguggcaccaucaagcagacgggacuucaccuucgaccuguacagagcccucgcuuccgcggccccuagccagucuaucuuuuucucccccgugucaauuuccaugucucucgccaugcugucuuuaggagccggauccucuacgaaaaugcagauccuagagggacucggcuugaaucugcaaaagucuagcgaaaaagaacuccauaggggcuuccagcaauuacuucaggaacuaaaucaaccucgcgauggcuuccagcugucccuggguaacgcccuuuuuaccgaucugguuguagaucuacaggauacauucguaucugccaugaaaacguuauaccuggcugacacauuuccaacuaauuuuagagacagcgcaggagcaaugaagcagaucaaugauuauguugccaaacagaccaaagggaaaauuguugaucuacugaagaaucucgacucuaacgcagugguaauuaugguaaauuacaucuuuuucaaggccaagugggagacaagcuuuaaccauaaaggaacacaggaacaggacuucuauguaacauccgagacuguggugaggguuccaaugaugagcagggaggaucaguaccauuaucuccuggaccgaaacuuaagcugccguguggugggagugccauaccaagggaacgcaaccgccuuguuuauucugccaucagaaggaaaaaugcagcaaguggagaacggacuguccgaaaagacccuuagaaaauggcuuaaaauguucaagaagcgccaacuagaacuuuaucuccccaaauucucuaucgaagguuccuaucagcuugagaaagugcugccuucccugggaaucuccaacguguucacaucacacgccgaccugucuggcauaucuaaucacucgaacauccagguaucagagauggugcacaaagcagucguggaggucgacgagagugggacccgagccgcagcagcgaccgggacaauuuuuaccuucagaagcgcccguuuaaacagucagagacugguuuucaacagacccuucuuaauguucauaguagacaacaauauauuguucuugggaaaaguaaauagaccuuag

SEQ ID NO: 15092 - RNA, 618 nt, Artificial Sequence
  Description of Artificial Sequence: Synthetic coding sequence
augaugcguacacuuauaaccacacacccucugccucuacuccuguugccccaacaacugcuccaacugguacaguuucaggaaguugacaccgauuucgauuuucccgaggaagacaaaaaagaagaguuugaggaauguuuggagaaguucuuuucgaccggcccugccaggccccccacaaaggagaaagugaaacggagagugcugaucgaaccuggcaugccauugaaccacauugaauacugcaaucacgagauuauggguaagaacguuuacuacaaacaccgguggguagcagaacauuauuuccuacugaugcaguaugacgaacugcagaagauuugcuacaaucgauucgugccguguaagaaugguaucaggaaguguaauagauccaaaggacuaguagagggcguguacugcaaucucacagaagccuuugaaaucccugcaugcaaguaugaaagucuguaccgaaaaggguacguguuaauuacauguucguggcagaacgaaaugcagaagaggaucccccauaccauaaaugaccuaguugaaccuccggagcaucguaguuuccugagcgaagacggcguuuucguuauaucucccuag

SEQ ID NO: 15093 - RNA, 240 nt, Artificial Sequence; identical to SEQ ID NO: 13454
  Description of Artificial Sequence: Synthetic coding sequence

SEQ ID NO: 15094 - RNA, 618 nt, Artificial Sequence
  Description of Artificial Sequence: Synthetic coding sequence
augaugcgaacccugauaaccacacacccguugcccuugcuguugcuuccacaacagcuccuacagcuugugcaguuccaagaaguggauacggauuuugauuuuccagaggaagauaagaaggaagaauucgaggaguguuuggaaaaauucuucuccaccggaccagccagaccacccacuaaagaaaaagucaaacgacgagugcuaaucgaaccuggaaugccacugaaucauaucgaguacugcaaccacgagauuaugggaaagaacguguauuauaagcaucgcuggguggccgaacacuacuucuuacugaugcaauacgacgagcugcagaagauuuguuauaaucgcuuuguccccugcaaaaauggaauacggaaaugcaacagauccaaaggauugguugaggggguuuauugcaaucucacagaggccuucgagaucccagcauguaaauacgaaucacuguaucggaagggcuacguacuaauuaccugcaguuggcagaacgagaugcagaaaaggauaccucauacuauaaaugaccugguggaaccaccugaacacaggaguuuucuuuccgaagacggcguguucgucaucucacccuag

SEQ ID NO: 15095 - RNA, 3789 nt, Artificial Sequence
  Description of Artificial Sequence: Synthetic coding sequence
augcgccuucuuuugcugguaccacugcucuuggcaccugcuccugguucaucggcgcccaaagugcgaaggcagagcgacacauggggaccauggagucaauggucaccgugcucucgaacauguggggguggaguuagcuuccgcgagagaccuugcuacagccagagacgggaugggggcagcagcuguguuggaccagccagaagucaccgaaguugucguaccgaaucuuguccugacggcgcucgugauuuccgggccgaacagugcgcugaauucgacggcgccgaauuccagggcagaagguaccggugguuaccauacuacucugccccuaauaaaugcgaacugaacugcauccccaaaggcgaaaacuuuuacuauaagcacagagaggcugugguugacggcaccccaugcgaacccggaaagcgugaugucugugucgacggcucaugucgagugguaggcugugaucacgaauuagauuccucuaagcaagaagacaagugucuucgcugcggcggcgacgguacuacuuguuauccuguugcuggaacuuuugaugcaaaugacuuaucucgagguuauaaucagauccucaucgugccuaugggugcaacaucuauuuuaaucgacgaagcugccgcuucccgcaacuuccuggcagugaagaauguaaggggggaauauuaccugaacggacauuggacgauagaagccgcucgagcccuucccgcagccagcacuauucuccacuacgagcggggcgcagaaggugacuuggccccagaacgccugcaugcgcggggcccuaccuccgaaccacuaguuaucgaguugaucucccaggaaccaaaucccggcgugcacuacgaguaucaucugccccuucgaaggccaucucccggcuucucuuggucccauggcaguugguccgauuguucagccgagugcggcggagggcaucaaucgaggcugguuuucugcaccauagaccacgaggcuuacccagaccauaugugccaacggcaaccuagaccagcagauaggcguucgugcaaucuucauccuugucccgagacuaagagauggaaggcagguccaugggcccccugcucugccucuuguggcgguggcucccagucacgaagcguuuacuguaucucuuccgauggggccggcauccaggaagcaguugaggaggcugaaugcgcugguuugcccggaaaaccaccggcgauucaggcuugcaauuuacaaagaugcgcggccuggagcccugaaccuuggggggaguguaguguauccuguggcguaggugugagaaagcgaucagugacuuguagaggagagcgugguucucuuuuacacaccgcugcuuguucccuugaagaccggcccccacugaccgagccuugcguccaugaagacuguccgcugcugagugaucaggcuuggcacguuggcacauggggguuauguucaaagaguugcucaaguggcaccagaagaagacaggugauuugcgccaucggaccucccucucacugugggagccugcagcauagcaaacccguagauguggagcccugcaacacucagccaugucauuuaccccaagaggugccauccaugcaggauguccacacgccagccucaaaccccuggaugccauuaggaccccaagagucaccugcuagcgauagucguggacaguggugggcagcacaggaacacccaagcgcucguggugaccaucguggcgagaggggcgacccccggggugaccaaggaacgcaucucagcgcucucggccccgcaccuagccugcaacagcccccauaccagcaacccuuaagaucaggcucugguccccacgacugccggcacagcccacacggaugcugcccugauggucacacugccucucuggggccgcaguggcaggguugucccggagccccuugccaacagagucgguauggaugcugccccgauagaguauccguagcagaaggcccccaccacgccggguguacaaaaaguuauggaggugauagcaccggcggaaugccucggagccgugcaguggcaagcaccgugcacaacacccaccagccucaggcacagcagaacgagccauccgaguguagaggaucacaguucggguguugcuaugacaacguugcuacagcggcaggcccacugggcgaaggaugugucggacaaccgagucacgauugggcugcaagaugguacuuuguggccagcguggggcaguguaauagauuuugguacggaggaugccacgguaacgcuaauaauuuugcuagugaacaggaauguaugucuagcugucaggggucuuuacacggcccaagacggccucagcccggagcaaguggccggucuacacacacggacggaggcggauccucacccgcuggagaacaagaacccucgcaacaccgcacaggagcugccguucaaaggaagccauggccaucgggcgggcuguggcgccaggaccaacagccaggacccggggaggcaccacacacccaggcuuuuggggaauggccauggggacaggagcucgggucucgggcuccagggcuugguggcgacgccggcuccccugccccuccuuuccacucuucauccuauagaauuagccuggccgguguagagcccucccucguccaggcugcucuaggacagcucguucgguuaagcuguuccgaugauacugcccccgagagccaggcagccuggcaaaaggacgggcagcccauuuccucugacagacacagacugcaguucgacgggucccugaucauucauccccuucaggcagaggacgccgguacuuauucuugugggagcaccagaccuggaagggacucacagaaaauucaacugcgcauuauuggaggugauauggccgugcucuccgaggcagaacuaaguagauuuccucaaccccgugacccggcucaggacuucggacaggcgggugcugcuggcccccugggggccauucccucaucacacccucagcccgccaaucgccugcgucucgaccagaaucaaccccgaguuguugaugcuucaccaggacagagaauacggaugacauguagagcugaaggcuuuccuccuccugcaaucgaguggcagcgugacgggcagcccguaucuagcccacggcaucaacugcagcccgaugggucgcugguuaucaguagaguugcagucgaggacgggggauucuacacuugcguugcuuucaacggccaagaucgugaucaacgcuggguucagcugcguguguuaggcgagcugaccauuaguggacugcccccuaccguuacaguccccgaaggugacacugccagauugcuuugcgugguagcaggcgagagugucaauauuagaugguccagaaaugggcugccaguccaggcugacggccacaggguccaccagagcccugacgggacauugcucauuuacaaucuccgagcacgggaugaaggcucuuauaccugcagcgcauaccaaggcucucaagcuguuucccgaaguaccgagguuaaaguaguaaguccagcccccaccgcccaaccccgugaccccggucgcgacuguguggaucagcccgaacuugcgaacugugaccugaucuugcaggcacaacugugcggaaaugaauauuauucgagcuuuugcugcgccuccuguagccgguuucaaccucacgcucaacccaucuggcaauag

SEQ ID NO: 15096 - RNA, 321 nt, Artificial Sequence
  Description of Artificial Sequence: Synthetic coding sequence
augucauucucugccaccauacuguuuuccccaccauccgguuccgaagcuagguguugcuguugugccuguaagucugagaccaacgggggcaauacuggcucucaaggcggcaauccccccccaagcacacccaucaccguuacggggcauggucucgcuguccagaguucggagcaacuguugcauguuaucuaccagagaguugauaaagccgugggacucgccgaagcugcucuaggccuagcuagagcaaacaacgagcugcugaagaggcuccaggaagaggucggcgaccuccggcaagggaagguuaguuag

SEQ ID NO: 15097 - RNA, 444 nt, Artificial Sequence
  Description of Artificial Sequence: Synthetic coding sequence
auggcacuccaaagaacccacucacuguugcugcugcugcuguugacucugcucggcuuaggucuggugcaaccgagcuacggccaggauggcauguaccaacguuuucuucgccagcacguucacccugaagaaaccggagguucugacagauacuguaaccuaaugaugcagcguaggaaaaugacccucuaccauugcaagcguuuuaacacauucauacacgaagacauuuggaacauucgcuccaucugcucuacaacaaauauccaguguaagaacggaaaaaugaauugucaugaaggaguagucaagguuacagauugcagggauacuggcucuucaagagcgccgaacuguagauaucgcgccaucgcaucaacacgcaggguugugauugcuugugaaggaaauccccaaguccccgugcauuuugaugguuag

SEQ ID NO: 15098 - RNA, 435 nt, Artificial Sequence
  Description of Artificial Sequence: Synthetic coding sequence
augcaguuauuccuccuucucugucucguacuccuuuccccucaaggagcuagccugcaucgccaucacccacgagaaaugaagaaacgaguggaagaucugcaugugggagccacaguugcccccagcucuagacgggacuuuaccuucgacuuguaucgcgcccucgccuccgccgccccaucccaguccauauucuuuuccccagugagcauauccaugagccuggccauguugagccuuggggcaggaagcucaacaaagaugcagauucucgaagguuugggccuaaaucugcagaaguccuccgaaaaggaacugcacagaggcuuucaacagcugcugcaagaacugaaccaaccccgcgacggcuuccaacucagccuuggcaacgcucuguuuaccgacuuaguugucgaucuucaggauaccuag

SEQ ID NO: 15099 - RNA, 540 nt, Artificial Sequence
  Description of Artificial Sequence: Synthetic coding sequence
auggggucguccgggcuguuguccuuacugguacucuuuguucuguuggcuaauguccagggccccgggcugaccgacuggcuuuucccccgccguuguccuaagauucgugaagagugugaauuucaagaacgcgacguguguacuaaggaucgucagugccaagacaauaagaaguguugcguuuucuccuguggaaagaaauguuuggaccugaagcaagacguuugcgagaugcccaaggaaacaggacccugucuagccuauuuccuacacuggugguacgacaagaaagauaacaccugcuccauguuuguguauggcgggugucaaggaaacaacaauaacuuucagucaaaagccaauugccuaaacacauguaaaaauaaacaaccaugccccaagaucaagguggagugugaaguggaggaaaucgaucaaugcaccaaaccuagagacugccccgagaauaugaaauguugcccuuucagcagagggaagaaaugucuggauuuucgaaaagcgucacugucuaccuag

SEQ ID NO: 15100 - RNA, 444 nt, Artificial Sequence
  Description of Artificial Sequence: Synthetic coding sequence
auggcucuacagagaacacacucucuguugcuccugcuacuuuugacccuucucggacugggacuggugcaaccuagcuacggacaggacgguauguaccaacgcuuucuaaggcagcacgugcacccagaagaaaccgggggcagcgauagguacuguaaucugaugaugcagcguagaaagaugacccuauaucauuguaagcgcuuuaacacauucauccaugaggacaucuggaacauacguucgaucugcucuacaacgaauauacaaugcaaaaaugguaagaugaacugucaugaagggguuguuaagguaacagacugccgagacaccggcagcucaagagcaccuaacugccgguauagagccauugcaucuacacgucgaguugugaucgccugcgagggcaacccacaaguuccugugcacuuugauggauag

SEQ ID NO: 15101 - RNA, 600 nt, Artificial Sequence
  Description of Artificial Sequence: Synthetic coding sequence
auggaaaccuucccacuucuacuccuuagccucggacuggugcucgccgaggccucagaaucuacaaugaaaaucaucaaagaagaauuuaccgacgaagagaugcaguacgauauggccaaaaguggucaggagaagcagaccauugaaauucugaugaacccuauccuacucgucaaaaacaccuccuuguccaugagcaaagaugauaugaguucuacucugcugacauuuaggagucuccauuacaaugacccaaaagggaauucuuccggcaacgacaaggaaugcugcaacgauaugacgguauggcggaaggucagugaagcuaaugguucuugcaaauggucuaacaauuuuauacgcucuagcacagagguaaugcgacgaguccaucgggcacccagcugcaaauuugugcagaauccuggcaucagcuguugugaaagccucgagcucgaaaauaccguaugccaguuuacuacuggaaagcaguuucccagaugucaguaucacuccgucacaucuuuagaaaaaauucuuacaguccugacaggccacaguuuaauguccugguuagugugcggauccaagcucuag

SEQ ID NO: 15102 - RNA, 153 nt, Artificial Sequence; identical to SEQ ID NO: 13463
  Description of Artificial Sequence: Synthetic coding sequence

SEQ ID NO: 15103 - RNA, 75 nt, Artificial Sequence; identical to SEQ ID NO: 13464
  Description of Artificial Sequence: Synthetic coding sequence

SEQ ID NO: 15104 - RNA, 633 nt, Artificial Sequence
  Description of Artificial Sequence: Synthetic coding sequence
auguccgcaggaaagaugaugagaacccugaucacaacccacccacuaccacugcuacuacuaccccagcagcugcugcaguuagugcaauuucaagagguugauaccgauuucgauuucccagaggaagacaaaaaagaggaguuugaggagugucuagaaaaguucuucaguacuggccccgccagaccgccaaccaaggaaaaggugaagagaagagugcugaucgagccgggaaugccguugaaucacaucgaauacuguaaucacgaaauuaugggcaagaauguuuauuacaaacaccgauggguggccgaacauuacuuccugcugaugcaauacgacgaacuacagaagaucugcuacaacagauucguaccauguaagaacgguauccgcaagugcaacaggagcaaaggccugguggaaggaguuuauuguaaccugaccgaagcuuucgaaaucccagcaugcaaguacgaauccuuauauagaaagggcuacgugcugauuacuuguucuuggcaaaaugaaaugcagaaaagaauuccucacaccauaaacgaucugguugagccucccgagcauagaaguuuccuuucagaagacggcguguucgugauuuccccauag

SEQ ID NO: 15105 - RNA, 36 nt, Artificial Sequence; identical to SEQ ID NO: 13466
  Description of Artificial Sequence: Synthetic coding sequence

SEQ ID NO: 15106 - RNA, 444 nt, Artificial Sequence
  Description of Artificial Sequence: Synthetic coding sequence
augaucaucauggugaucauuuuucuggugcuuuuauuuugggagaaugaaguuaaugaugaagcugugaugaguacucuugagcaucuucaugucgauuauccacagaaugacgugcccgucccugcccgguauugcaaccacaugauaauccagagagugauucgcgagccagaucacacuuguaagaaggaacacguauuuauucacgagaggcccagaaaaauuaacgguauuuguauaucuccaaagaaagucgcuugccagaaucucuccgccaucuuuuguuuucaguccgaaaccaaauuuaagaugaccgucugucaguugaucgaaggaacucgcuacccugcgugcagauaccauuauuccccaaccgaaggcuuuguccucgugacaugugacgaccugcgcccagacuccuuuuuggguuacgugaaguag

SEQ ID NO: 15107 - RNA, 696 nt, Artificial Sequence
  Description of Artificial Sequence: Synthetic coding sequence
augcagcuguuucugcuccuuugccugguccuucugucaccccaaggggccucgcugcacagacaccauccucgggagaugaaaaagagaguggaagacuugcauguuggcgccacaguagccccgucaagcagaagagacuucacauuugacuuguauagagcccucgcuucggccgcaccuagucagagcauauuuuucucccccguaucuaucucaauguccuuagcaaugcucagucucggagccggcuccucaaccaagaugcagauccuggagggccuuggccugaaucuucaaaaguccagugagaaagaguuacaccggggguuucagcaguugcuacaagagcuuaaucagccacgugacgguuuccaacucucucuggggaaugcccucuuuacugaccucguuguggaccuccaagauaccuucgugagcgcgaugaagacauuauaucuggccgauacauuccccaccaacuucagagauuccgccggcgccaugaaacagaucaacgauuacguagcaaagcagaccaagggcaagaucgucgacuugcuuaaaaaucucgauucgaacgcuguggugauuauggugaacuauauuuuuuuuaaggccaaaugggagacaagcuucaaucauaaaggaacgcaggaacaggacuucuauguuacuucugaaacagucgucuag

SEQ ID NO: 15108 - RNA, 1626 nt, Artificial Sequence
  Description of Artificial Sequence: Synthetic coding sequence
auggcaaaguuuggggugcacagaauacugcuacuggcaauaagccugacuaagugccuagaaagcacgaagcuucuggcggaucuuaaaaagugcggggaccuugagugugaagcccugauaaaucgggugucagcaaugagagacuacagaggaccugacugucgcuaucuuaauuuuacaaaaggcgaggaaaucucaguuuaugugaaguuggcuggcgaaagagaggaccuaugggcgggcaaggggaaggaauucggguauuuuccaagggaugcagugcagauugaagagguuuucauuagcgaggagauucagaugagcacuaaggagagcgacuuucugugccuacuuggcguaucuuacacguuugacaaugaagacagugaacucaacggugauuacggcgagaauauuuaucccuaugaagaagauaaggacgagaaaagcagcauuuacgagagcgacuuucagaucgaacccggauucuacgccacuuaugagagcacacuguucgaagaccaggugccagcccuugaagccccugaggacaucggcaguacaagugaaagcaaagacugggaggagguuguggucgaguccauggaacaagauaggauuccugagguccaugugccccccagcucagcagugaguggcguuaaggagugguuuggauuagguggggagcaagcagaggagaaggcuuuugaaucaguuauugagcccgugcaggaaucaucauuucgaucuagaaaaaucgcugucgaggacgaaaacgaucuggaggaacugaauaauggggaaccucaaacugagcaccaacaagaaagcgagagugagauugauuccguaccuaagacccaaagugagcucgcaucugaguccgaacauaucccgaaaccucagucuaccggcugguuuggaggcggguucacaagcuauuugggguuuggcgacgaggacaccggucuggaauuaaucgcugaagaguccaaccccccacugcaagacuucccuaacucuauaucuagugacaaagaagccaccgugccauguacugagauauuaacugaaaagaaggauaccauaaccaacgauagccuuucccugaagccauccugguuugacuucggguucgcaauacucgguuuugcauaugcuaaggaagacaaaaucaugcuggacgaucgaaagaacgaagaagaugggggcgccgaugaacacgaacacccacucaccuccgaauuagaccccgagaaagaacaagagaucgagacgauuaagauaauugaaaccgaagaccagaucgacaaaaaaccaguaucugaaaaaacggacgagagcgauacaauuccauaucucaagaaguuuuuguauaacuuugacaauccauggaacuuccagaauauucccaaggaaacugaguuaccguuuccaaagcagauucucgaucagaauaauguaauagagaacgaagagacaggcgaguucagcauagauaacuacccaaccgacaacaccaaggucaugaucuucaaaagcaguuacucauugucuggcugguaugagaacaucuacauccgcaucuacuucaucuucaagcacaaccucuuucuguag

SEQ ID NO: 15109 - RNA, 1245 nt, Artificial Sequence
  Description of Artificial Sequence: Synthetic coding sequence
augaaucccacccuaggucuggccauauuccuggcuguuuugcuaacuguuaaaggacugcugaagcccagcuuuucuccuaggaauuauaaagccuugucagaaguucaaggauggaagcaaagaauggccgcaaaggaguuagcucgucagaauauggauuuaggauucaaauugcugaaaaagcucgccuuuuauaaccccggcaggaauauauuucuaucccccuuguccauauccacugccuuuuccaugcucugucuuggagcccaggauucuacccucgaugaaaucaagcagggauuuaacuuucguaaaaugccagaaaaagaccuucaugaaggguuccacuacaucauccacgagcugacacagaagacccaggaccucaagcugagcauuggaaacacacuauucauugaccagagacuccagccucaacggaaauuccuggaagacgcgaaaaacuucuacucugccgagaccaucuuaacgaauuuucagaaucuugaaauggcccagaagcagauaaaugauuuuauaucccaaaaaacacauggcaaaaucaacaaccucaucgaaaauaucgaucccggcaccgucaugcugcuggcaaacuacauauuuuuccgugccagguggaagcacgaauucgacccuaacguuacuaaagaagaagauuucuuccuggaaaaaaacagcuccgugaaggucccuaugauguuuagaagcgguauauaccagguugguuaugacgacaagcuauccuguacaauccucgagauccccuaucagaaaaauaucacagcuauuuucauccuaccagaugagggaaaacugaaacaccuggagaagggccugcaagucgauacauuuagccgauggaagacccugcucucgagacgcguuguagacguuucaguaccgagauuacacaugacuggcacauucgaucugaagaaaacccucucauauauaggcguaucuaagauuuuugaagaacacggugaucugacaaagauugccccccauaggucucugaaggucggugaggcaguucacaaggcggaguugaaaauggaugaacgaggcacugagggugcugccggaaccggagcccagacccuuccaauggagaccccccuggucguaaagauugauaaaccauaccuguuacugauuuacagcgagaaaauuccuucuguccuuuuccucgguaagauuguuaaucccauugguaaguag

SEQ ID NO: 15110 - RNA, 618 nt, Artificial Sequence
  Description of Artificial Sequence: Synthetic coding sequence
augaugaggacauuaauaacuacucauccgcugccauuacuccuucuuccucagcaguugcuccagcucguacaguuccaggaaguggauacugauuucgauuuuccagaagaagauaagaaagaggaauucgaagaaugcuuagagaaauuuuuuucaaccgguccugcacgcccgcccaccaaagaaaaagugaagcgcaggguguugauugaacccggaaugccacugaaccacauagaauacuguaaucaugagauuauggggaaaaauguuuacuacaaacaccggugggucgcggaacauuauuuucuucucaugcaguacgaugaacuccagaagauuuguuauaaucguuuuguuccuugcaaaaaugguauccguaaguguaaccgcaguaaaggcuugguagaaggaguguauugcaaccucaccgaagcuuucgagauacccgcuuguaaauaugaaagucucuauagaaaagguuacguccugaucaccuguucauggcagaaugaaaugcaaaagcguauuccucauaccauuaacgaucugguugaacccccugagcaucgguccuuccucucagaagacggaguauuugucauuaguccauag

SEQ ID NO: 15111 - RNA, 516 nt, Artificial Sequence
  Description of Artificial Sequence: Synthetic coding sequence
auggaaacauucccccuccuacuacuuagucuuggccuggugcucgcagaggcuuccgagucaaccaugaagauaaucaaagaagaauucaccgaugaagagaugcaguacgacauggcaaaaaguggacaggagaagcagaccaucgagaucuuaaugaaucccaucuuacugguuaagaacaccucuuugagcaugaguaaggacgacaugucuucuacacugcuuaccuuuagaagccuccacuauaacgauccuaaaggcaacucuuccggaaacgauaaagaauguugcaacgauaugacagucuggagaaaagugagcgaagccaauggcagcugcaaguggucaaauaacuucauucggagcucgacggaagugaugagaagaguccaccgagccccuaguuguaaguucguccagaaucccggcauauccuguugcgagucacuugaguuagagaacacgguaugucaguucacaacagguaagcaguuuccucgaugccaauauuag

SEQ ID NO: 15112 - RNA, 633 nt, Artificial Sequence
  Description of Artificial Sequence: Synthetic coding sequence
augucagcuggaaagaugaugcguacucugaucacuacccacccccuaccuuuacugcugcuaccacagcagcucuugcaacugguccaguuucaagagguugacaccgacuuugauuuucccgaggaagauaaaaaagaggaguucgaggaauguuuggagaaauuuuuuagcaccgguccagcuagaccaccuaccaaagagaaaguuaaacgaagaguguugauugagccgggaaugccccugaaccauauagaauauugcaaucacgaaaucaugggaaaaaaugucuauuacaaacauagauggguggcagagcauuauuuccugcugaugcaauacgaugaacugcagaagauuuguuauaaccgguuugugcccugcaaaaacggaauccgcaagugcaaccggagcaagggguugguagaagggguguauuguaaccugacugaggccuuugaaauccccgcuuguaaguaugaaagccuguaucgaaaggguuacguccucaucacguguaguuggcagaacgagaugcagaaaagaaucccacacacaauuaaugaccugguagagccuccugagcacagaaguuuucuuuccgaagauggcguuuuuguaaucagccccuag

SEQ ID NO: 15113 - RNA, 537 nt, Artificial Sequence
  Description of Artificial Sequence: Synthetic coding sequence
auggagacauuuccucuacuccugcugucccugggacuagugcuugccgaagccuccgaguccacuaugaagauuaucaaagaggaguuuacagacgaagagaugcaauacgacauggcaaaguccggucaagaaaagcaaacaaucgaaauucucaugaacccuauauuacuggugaagaacacaagccuaucuauguccaaagacgacaugucaucaacucugcugacauuccgaagucuucacuauaaugacccuaaaggcaacuccucagggaaugacaaagaauguuguaacgacaugacuguguggcgaaaagucucagaggcuaaugggucuugcaaauggaguaauaauuuuauacguaguucuacggaagucaugagaagagugcauagagcaccauccugcaaguucguucagaauccagggaucaguugcugcgagagccuggagcucgaaaacaccguuugucaauuuacuacagggaaacaauucccucgcugucaauaucacuccguaaccagcuuagaauag

SEQ ID NO: 15114 - RNA, 474 nt, Artificial Sequence
  Description of Artificial Sequence: Synthetic coding sequence
augcagcuuuuucugcugcugugucucguauugcucuccccucagggagccucucuccaccggcaccacccacgagagaugaagaaacggguugaggaucuccaugucggcgccacaguggcucccuccucucgccgcgacuuuacuuuugaucucuacagagcucucgcgucugcugcgcccucccaguccaucuucuucucaccaguaucuaucucuaugagucuugccauguuaucccuuggagccgguuccucuacaaaaaugcaaauuuuagagggccugggccugaaccugcagaaaagcuccgagaaggaguuacaucggggauuucagcagcuucugcaggaacucaaucaaccucgggauggcuuccaacuuucacugggcaacgcucuuuuuacugaucucguuguugaucuacaagauacauucguauccgcuaugaagaccuuauaccuggccgauacauag

SEQ ID NO: 15115 - RNA, 1035 nt, Artificial Sequence
  Description of Artificial Sequence: Synthetic coding sequence
augccgccuagaaugcuggucgcaccccucccucuacauuuucuguuggcugccguguccucugagaaucgcuccgguagaaggcaauggcaacaggccguggccgcuggcagcggcccugggagaaacucuucccgagcuauucacuggucguugcccagagcccucgugccagcuacugguacacgagcauccggaucccagaagagacagcggcccccaaaaggccaggaagcgcuauggagccguccccauucucggcacuccgccgaacgcgccggaggaucucacucugaccccggacgauuguccgcuccgcuuggacugggccucccuucaggccggggucggcuuaccgcaaugccaggucgagcaccucuaaggacuguucccggcgcacucggggcuuggcuguugggcggccugugggccuggacccuuuguggacucuguagccugggcgcugucggugcucccagacccugucaggcaccccagcaaugggagggccgucaagugauguaucaacagagcagcggucgaaauucuagggccuuauuaucuuacgacggguugaaucagagggugcgaguucucgaugaacguaaagcucugauccccugcaaacgacucuuugaguacauucuucuuuauaaggacggagugauguuccagauugaccaggccaccaagcagugcaguaagaugacccugacucagccaugggacccccuagacaucccacagaauucuacauucgaggaucaauacuccaucggcggcccacaggaacagaucaccgugcaagaauggagcgaccgcaaaagugcacgcagcuaugagaccuggauuggaauauauaccguaaaagacugcuaucccguccaagaaacuuucaccaucaauuacucugucauacuauccacccguuucuuugauauccagcucggaauaaaggauccuuccguguucacaccacccagcaccugccagauggcucagcucgaaaagaugucugaagacuguucuugguag

SEQ ID NO: 15116 - RNA, 321 nt, Artificial Sequence
  Description of Artificial Sequence: Synthetic coding sequence
ggccagccuaaagccgcacccagcguuacucuguuccccccuuccucagaggaauuacaagccaacaaagccacauuaguuugccugguuucugacuuuuauccuggcgcagucaccguggcauggaaggcagacggaucccccgucaaggugggcgucgagacaacaaaacccuccaaacagagcaauaacaaauacgcagccagcucuuaccugagcuugacccccgagcaauggaaaucccaccggagcuauaguugccgcgucacacaugagggaagcaccguugaaaagacaguggccccugcugaguguucauag

SEQ ID NO: 15117 - RNA, 672 nt, Artificial Sequence
  Description of Artificial Sequence: Synthetic coding sequence
augcgccugcaaagaccuagacaggcuccagcaggagguaggagggcgcccagagggggacgcggaucaccuuaccgaccugaccccggaagaggugcuagacgccugcggcgcuuucagaagggcggugaaggagccccaagagcugauccccccugggcaccacugggaaccauggcuuuacucgcauuacuguuagugguugccuugccaagaguauggaccgacgcuaaccugacagcccgccagcgcgauccugaagauucccaaagaacggacgagggcgacaauaggguguggugccacguuugcgagagagaaaauaccuucgaaugucaaaauccaagaagaugcaaauggacagaacccuacugugucauagcugccgucaaaauuuuuccuagauuuuucaugguugccaaacaauguucugcugggugcgccgcuauggaacgaccaaaaccagaggaaaagcguuucuugcuugaggagccuaugccuuucuucuacuugaagugcuguaaaauuagguacugcaaccuggaaggcccacccaucaacaguuccguuuuuaaagaguacgcaggcuccaugggggaaagcuguggugggcugugguuggccauacuucuguugcucgcuucuauugccgcuggacuuucacucucuuag

SEQ ID NO: 15118 - RNA, 1542 nt, Artificial Sequence
  Description of Artificial Sequence: Synthetic coding sequence
auggccccagccagaacgauggcacgcgcaagacucgccccugccggaauccccgcugucgcucuuuggcugcuauguacauugggccuucaaggcacgcaagcagguccucccccugccccacccggccuaccugcuggagccgauugccucaauucuuucacagcuggcgucccaggauuugucuuagacaccaaugcaaguguauccaacggagcuacuuuccucgaaagccccacaguucggcgcggcugggacugcguaagagccugcuguacaacccagaauuguaaucucgcacugguggagcuucagcccgauagaggugaggaugcuaucgcugccuguuuucucauuaacuguuuguaugaacagaacuuugugugcaaauuugccccucgcgaaggcuuuaucaauuaucugacucgcgaaguguaucgaucuuaccgccagcugagaacucaaggauuugggggaaguggaaucccaaaagcaugggcuggcauugaucuuaaaguacaaccucaggagccccugguccucaaggacguugagaauacagauuggagacugcuacgaggcgacacagacguuagaguggagcggaaggaccccaaucagguugagcuuugggggcuuaaagaaggaaccuauuuauuccaacuuaccguuacaucauccgaucaucccgaagacacagcuaacgucacagucacuguacucucaacgaagcagacugaagacuauugucuugccuccaauaaggugggcagaugcagaggcagcuucccacggugguauuaugauccaacggagcagauauguaaguccuucguguauggcggaugccucgggaauaaaaauaacuaccugcgagaagaagaauguaucuuagccugcaggggcgugcagggucccagcauggaacgcagacaccccguaugcucuggaaccugucagccaacacaguuuaggugcuccaacggauguugcauugacagcuucuuagagugugaugauacacccaacugcccugaugcaagcgacgaggccgcaugugaaaaauauaccagcggauuugaugaacuucaacggauccauuucccuagugacaaaggccauugcguugaccuuccggacacuggauuauguaaagaaucaaucccccgaugguacuauaacccauucucugaacacugcgccagauuuacuuacgggggcuguuauggcaauaagaauaacuuugaagaggaacaacaauguuuagaguccugcagagguauuagcaaaaaggaugucuuuggccugagacgagagauuccaauuccaucaacuggcaguguagagauggcuguggccguauuucuagucauuugcauagucguagucguagcaauucugggauacugcuuuuuuaagaaccagagaaaagauuuccacggacaccaucaucacccaccgcccaccccagcaucaaguacaguuucaaccacugaagauaccgagcaccuaguuuacaaccauacaacccggccccuauag

SEQ ID NO: 15119 - RNA, 1341 nt, Artificial Sequence
  Description of Artificial Sequence: Synthetic coding sequence
augcuacauccugagacaucuccaggucgaggacacuuauuggccgugcuacuagcguugcucgguacagcaugggccgaaguguggccaccccaauugcaggagcaagcaccaauggccggagcccugaauagaaaggaaaguuuccugcuacugucucugcacaaccgccugagaucuuggguucagcccccugccgcagauaugaggcgauuagauuggagcgacagucuugcucaguuggcucaggcacgugccgcccucugcgguaucccgacuccaucucucgccagcgggcuguggagaaccuuacaagugggauggaacaugcaguugcuucccgccggucuggcgucuuucguugagguggugucacucugguuugccgaggggcaacgcuauucccaugcagccggcgaaugcgcucgcaacgcaacauguacacacuacacacagcucguuugggcaacuucuucacaacuuggcuguggaaggcaucucuguucugccggucaggccgcuaucgaggcauuuguuugcgccuacagcccccgagguaauugggaggucaaugggaagaccaucgucccuuauaagaagggugcuugguguagccucugcaccgccuccgugagcgggugcuuuaaagccugggaccacgcaggcggcuuaugugaagucccucgcaaucccuguagaaugucaugucagaaccauggucggcugaacaucagcacaugccauugccauuguccuccagguuauacuggcagguacugccaggucagauguucacuccaaugcguacacggccgcuuucgggaggaggaguguagcugcguuugcgauauuggcuacggaggagcccagugcgcuaccaagguucauuuccccuuucauacuugugaucugcgaaucgauggggauuguuucauggucaguuccgaagcagauacguacuaccgcgcuagaaugaagugucagagaaaggggggaguucuggcccagaucaagagccaaaaagugcaggacauucuggccuucuaucucggucgacuagaaacaacuaaugaggugauugacuccgacuucgagacgcgcaauuuuuggaucggccugaccuacaagacggcuaaggacagcuuccgaugggcuacuggugagcaucaggcauuuacgaguuucgcuuuuggacagccggauaaucauggauuuggaaauugcgucgagcuccaggccuccgccgccuuuaacuggaacaaucagagaugcaaaacaaggaaccgguauauuugccaguucgcacaggaacauauuagucguuggggcccgggaucuuag

SEQ ID NO: 15120 - RNA, 936 nt, Artificial Sequence
  Description of Artificial Sequence: Synthetic coding sequence
auggggguuauggcaaugcucaugcuuccucuacuacuccuggggauuucgggacuucucuucauuuaccaagaagugucacgcuuauggaguaaaucugcugugcagaauaagguaguggucauuacagacgcgaucucagguuugggcaaggaaugugcgagaguguuccacacggggggugcccggcucguacugugcggcaaaaacugggagcgcuuagagaaucuguaugacgcccuaaucuccguugcagaccccagcaagacuuucacgcccaaguugguucuccucgaucucuccgacauuuccuguguccccgacgucgccaaagaagugcucgauugcuauggaugcguagacauucuuauaaauaaugccucugugaaggugaaaggcccagcacacaagaucucccuggagcuggauaagaagauuauggacgccaacuacuucggcccaauaacccugacgaaagcucugcugccuaauaugaucucccggagaacuggucagauuguacucgugaauaacauccaaggaaaguucggcauuccuuuuaggaccacuuacgcugccaguaagcaugccgcccuaggguuuuuugauugccugcgagccgaaguugaagaauacgacguggucauuucuacuguuuccccuacauuuauccguuccuaccauguguauccugaacagggaaacugggaggcgucaauuuggaaauucuuuuuccgaaagcucacauacggaguccaucccgucgaggucgccgaggaggucaugaggaccgugcgaaggaagaaacaggaaguguuuauggcuaauccgauuccuaaagcugcugucuacguucgcacauuuuuucccgaguuuuucuuugcagucguugcgugcggaguuaaagaaaagcuaaaugugcccgaggaagguuag

SEQ ID NO: 15121 - RNA, 594 nt, Artificial Sequence
  Description of Artificial Sequence: Synthetic coding sequence
auggcuaagaauggacuagucaucugcauccugguuauuaccuugcuccuggaccagaccacaucacacaccucaagacuaaaggcacgcaagcacucaaagcgacgcguacgugacaaggacggugaccugaaaacacaaauagagaagcuauggacugagguuaaugcucugaaggagauccaggcccuccaaaccgucugccugaggggaacaaaagugcacaagaagugcuaccucgcguccgaaggccugaagcacuuccacgaagccaacgaagacuguaucagcaaaggcggcauccugguaauuccucggaacucagaugaaaucaaugcucuucaggauuacggcaaaagaagcuugccagggguaaacgacuucugguugggaauuaaugacauggucacagagggcaaguucguagacguuaacggcaucgcuaucagcuuuuugaauugggacagagcucaaccuaacggcggcaagcgagagaacugcguuuuauucagccaguccgcacaggggaaguggucugaugaggcauguaggaguucaaagcgguauauaugcgaauuuaccauuccacaguag

SEQ ID NO: 15122 - RNA, 705 nt, Artificial Sequence
  Description of Artificial Sequence: Synthetic coding sequence
augaaaguucuucucuuaacuggucuaggagcccuuuucuuugcguauuacugggacgauaacuuugacccagggggacucgauuacuuaguccuaaaccauauuggcggagccccagcaggcacuagagccagaucuccccaggccacgcgcuggcuaaugcaagucaacuuuguuucuuacguucagcucacaucccgcgcacugccaucucugaccgacucgaaaggcucucuggugguggucucaagucuacuaggaagagucccgacaucuuuuucuacucccuacagcgcagcaaaguucgccuuagacggguuuuuugguagccuuaggagagaacucgaugugcaggacgucaaugucgccaucacaaugugcguucugggacucagagaucgggccucugccgccgaagccguaagauccucuaccucucgcccccgccagccggagcaccgagguguuccacuacaaucucagaccgcaauguuucugccgccgacuguuccaggugcccggacacuuaccgaaaccccacugagaggguggccucagcccaagaugaaguccucacgccaaaaaagcaagacugaaaaaaaugaugggcaucucgaaccaguaacagccugggagguacagguuccucgagugagaagacugugccgaggacuggcuagaccacaccuuuucggacacgacuag

SEQ ID NO: 15123 - RNA, 228 nt, Artificial Sequence; identical to SEQ ID NO: 13484
  Description of Artificial Sequence: Synthetic coding sequence

SEQ ID NO: 15124 - RNA, 225 nt, Artificial Sequence; identical to SEQ ID NO: 13485
  Description of Artificial Sequence: Synthetic coding sequence

SEQ ID NO: 15125 - RNA, 861 nt, Artificial Sequence
  Description of Artificial Sequence: Synthetic coding sequence
augaaaguguugcuguuaacuggccucggcgcuuuauuuuuugcguacuauugggacgacaacuucgauccggcuucauuacaaggcgcgcggguucuacugacuggugcgaacgccggugugggagaggaguuagccuaccauuacgcaagacucggcucccaucugguucuuacugcacacacagaagcucuguugcagaaggucguugggaacugcagaaaacugggagccccgaagguguuuuacaucgcagcagacauggcuagucccgaagccccugagagugugguacaguucgcccuugacaaauuaggaggucucgauuaccuggugcugaaucacauaggaggggcgcccgccggaacuagagcucgaucaccacaagcuacccgguggcucaugcaggugaauuucgugucguaugugcaguugacuaguagggcucuuccaagccucacagacuccaagggguccuuaguaguuguaucuagccuucuaggaagagugccuacgucuuucuccacuccauacucagcggccaaguuugcccuagauggguuuuucgggucacucaggagggaacuugacguucaggaugugaauguugcaauuacaaugugcgucuuagggcugagagaccgcgcgucugcagccgaggcuguucguggagucacaagagugaaagccgcccccggacccaaagcagccuuagccguaaucagagggggugcuacacgggccgcgggaguguuuuacccguggagguuccgacugcugugucugcugagaagauggcucccuaggccgagagcaugguuuauucgccaagaacugaacgucaccgcagccgcugcuuag

SEQ ID NO: 15126 - RNA, 459 nt, Artificial Sequence
  Description of Artificial Sequence: Synthetic coding sequence
augcagguuaacuuuguauccuacguucaacugaccagcagagcacuuccaucacugacagauagcaagggcucacuggucgucgugucaucgcuccugggccgaguacccaccucauuuucaacgccuuauucagccgcuaaguucgcccuagacggauucuuugggagccugagacgggaacuugacgugcaggaugucaacgucgcaauaaccaugugugucuugggacugcgcgaccgagccagcgccgcugaagcaguaagaggugucacaagggugaaagccgcuccuggcccaaaggccgcauuagcugugauuagggggggagcaacgagggccgcgggcguguuuuaucccuggcgauuuaggcugcugugucuucuccgucgauggcugccuagaccaagagccugguucauccgacaggaacuaaacgugaccgccgcugcugcuuag

SEQ ID NO: 15127 - RNA, 2856 nt, Artificial Sequence
  Description of Artificial Sequence: Synthetic coding sequence
augcgaguucuagccugccuguuggccgcacuugugggcauucaggcgguggaaagacucagauuagcugacggcccucauggaugugcaggacgacuggaaguauggcauggcggacgauggggaacuguaugugaugacgggugggacuuaagagaugccgcuguggcuugcagacagcugggcugcggaggcgcauuagcagcuccugggggcgcguucuuuggagagggagcugguccugucuggcucucugagcucgccugucgggguaaugaagggcaacuggggcugugucaccaccgcggcuggaaggcccacaucuguucucaugaagaagacgccgguguaguuugcgccggacagagaguggcuaacucucgcgaugauucaacuucuccccuggauggagcgccauggccaggccugcuucuagaacugagccccaguaccgaagaaccacuagugacucaugcccccagaccugcuggaaauccccagaaugccucccgcaaaaaaucuccacggcccaagcaagccaaauccacuagggccccauugcugaccacuggcgccccacggcaagaacgauugaggcuugugucgggaccucacaggugugcgggccgucucgagguauggcacggagggagauggggcacggucugcgaugauggaugggauuugcgagacgcagcuguggcauguagggagcugggaugugguggggcguuggccgcacccggcggggcuagguuuggaccaggugcaggcccuguuuggauggacgauguaggcugugggggaggggaacaggcccugagggauugcccucgaucuccgugggggagaagcaacugcgaucacagcgaggaugcaggacuggugugcacgggcccugccccucgccugagacuagcagauggaccccaugguugugccggucgccuggaaguuuggcacgggggccgcuggggaaguguuugugacgaugccugggaucugagggacgcugccguggcaugucgugagcuuggcugugggggagcauuagcagcgccgggcggugcuuucuucggugaaggcagcgggccaauaauuuuagacgaccuuaggugucgaggaaacgaaaccgcacugagguucuguccugccagaccuuggggacagcaugauugucaccaccgggaggacgcuggagcuguuugugacggaaugccccuuggguaugugcccccuacugcucccaccgacuccaauaacaguacgccacgggaagccgcaucccguccgccaucuacuaugacuagccaggcccccggcacugcaggagugucccccccaccggcuucuccuacaguuuugugggagcccggaccagaggcaggauccccucagcuaagacucguggcgggcccaucaaaauguagugguagguuagaaguuuggcacgaucagcgcuggggaaccgugugugaugauagcugggauaugcgugacucugccguggucuguagagaacugggauguggugggccucagcagccugaccccgccgccggcagguuuggguggggugcuggaccaauuugguuagacgaugugggguguguuggaacugaggcuaguuugucagacugcccugcugcuccguggggaaaacacaacugugcccauaacgaggacgugggagugaccuguaccgggccgccagggcuugauucuauuagcgauccauucagcuggagcuggauacccggauugggacgcgaccgggacgccuggcugccgggagagcuggccacuaagcccagugcaucaguaacagcaucaguccuugaaaaaaccacuaccaaagcaccaggcaagaugccuaagucuacgaagaaguggguuacuaaaaaugccaagcgcccgaccacucaaccacccgugaugcccacaaccaagcacagccgcgcucaaagcccccccgaccucacuagucagaccaccgccgcccuaacgacagaagcuagcagacggccuacuucagaguuuaccagaaggccaacaacugaggcaccucaacgguggaccagucauacuacugccacgcuuacuccacaggcaccuagggaacggacgacaaagacgauggcaaugcucacaacucaaggcccucaagaaaugaccagcgaaucaacuauuaaguccauuccccaagccuccuuagagcccucagccgaaaucccagaaggaucuccagagucuccgaaagauccagcaccgucccccaguguuuccaccacaggcgagucgggacuguuccgcguaaggcucgcagauggccccaacagaugugcuggcaggcuggaaguguggcacgccgggcggugggguacggucugcgaugacaauugggauuuacgcgacgcuacuguugcuugcugggaacuuggauguggaaaagugcggccucgcgucggcaaaacucacuacggacccgggacuggaccuaucuggcuugacgacaugggguguaaaggaagcgaagccaguuugagcgacugcccaucuggggcgugggguaaacauaacugcgaucaugaagaggaugucggccugacauguacaggguauaccgacuacgacgauuacccuccauggacuugggacccuacaucccgagaggaucuagcgaaggggaccacuacggcaggaguaccuggccacacccugccuuggagaaccacgagacgucccggaucaucuuccccagcuaucagaaggcuacccgacaccgagccagaggcuggagccccacgcggagacgccccaaggucuagaacggcacgugucgcugccccaccauag

SEQ ID NO: 15128 - RNA, 8430 nt, Artificial Sequence
  Description of Artificial Sequence: Synthetic coding sequence
augacucuggagggacucuaccuggcccgaggcccccuagcacggcuccugcuagcgugguccgccuuacuuugcauggcaggaggacagggacgcugggacggggcauuagaagcugcaggacccggccgcgucagacgacgagggagcccuggcauccugcaggguccaaaugucugugggucacguuuucacgcauauugcugcccaggcuggcgcacuuuuccagguagaucucagugcguugugcccaucugucgacgggcauguggggaagguuuuugcucucaaccaaaucugugcaccugugcggacgggacucuugcaccaucuuguggcguaagucggggauccggcuguuccguuagcuguaugaauggcggaacauguaggggagcaucuuguuugugucaaaaaggcuauaccggcacuguaugcggacaaccuauaugcgaucgaggaugucauaauggggggagguguauuggcccuaacaggugugccugcguguauggauucaugggaccacaaugcgaacgcgauuacagaacagguccuugcuuuggccagguggguccugaaggaugucagcaccagcugacaggcuuggugugcacuaaagcucugugcugugcuacgguugguagggccuggggucuuccaugcgaguuauguccggcucaaccucaccccugcagacgcggauucaucccaaacauacauacuggggccugccaagauguugacgagugccaagcuguccccggguuaugucagggcggcucuugcgugaacauggugggaucauuucacugccgguguccugucggucauagauuguccgauucauccgccgccugcgaagacuaucgggccggugccuguuuuaguguccucuuuggaggaagaugcgccggcgaucuugccggccauuacacccgaagacaguguuguugcgaccggggucggugcugggccgcaggaccagugccugaauuaugcccuccuagaggaucuaaugaauuccaacagcuuugugcacagcgacugcccuugcuuccuggucaccccggucucuuuccgggucugcuaggguuuggcucaaacggaaugggacccccacugggacccgcgcgacugaauccacaugguagugaugcucgcgggauuccaucccugggccccggaaauuccaauauaggcacggcaacacugaaucaaacuauugauaucugccgucacuuuacgaauuuaugcuugaauggucgaugccuccccacuccaaguuccuauaggugcgagugcaauguuggcuacacccaagacgugagaggagagugcauugaugucgacgagugcacuagcucaccaugccaccacggcgauugcguaaacaucccugguaccuaccacugucgcugcuacccagguuuucaggccaccccaacacgacaggccugcguugauguggacgaaugcauuguuagcggcggacucugucaccuugguagaugugugaauacggaggggagcuuucagugugucuguaaugccggauuugaguuaagccccgacggaaagaauugcguagaccacaaugaaugugcuacguccacgauguguguaaauggcguuugucucaaugaggacggcucuuuuucaugcuugugcaaacccgguuuuuuauuagccccaggcggccauuacuguauggauaucgacgaaugccaaacacccgggauaugugucaacggacauugcacaaauacagaaggcaguuuucgaugccaguguuuaggcggacuagcugugggaaccgauggccggguuuguguggacacccacguacgaagcacaugcuacggggcuaucgagaaaggauccugcgcucgccccuucccuggcacuguaacuaaauccgaaugcugcugcgcaaauccagaucauggcuucggcgaacccugucagcucuguccugcuaaagauucugccgaguuucaggcgcuuugcucaaguggacucggaauuacgacagauggaagagauauaaacgagugugccuuggacccggaggucugcgcaaacggcgugugugaaaaucuucgagguucuuaccgaugugucugcaauuuaggcuacgaagcaggcgcuucaggcaaagauugcaccgauguggacgaaugcgcccucaacagucuguuaugugacaaugguuggugccagaacagccccggcaguuacaguuguucaugcccccccggcuuucacuucuggcaggacacagaaauuugcaaagacguggacgagugccugagcucaccaugcguuuccggugugugcaggaaucuggcagguucuuauaccuguaaaugcggccccggcucucgcuuagauccauccggcacuuucugccucgacucaacuaaagguaccuguuggcucaagauacaggagagccgcugugaaguaaacuugcaaggggccucccucagaagcgaauguugugcuacauuaggugccgcauggggcucaccuugcgagcggugugagauugauccugcgugugccaggggguucgcucggaugacuggagugaccugcgacgauguuaaugaaugcgaaaguuuuccagggguuuguccuaacggccgcugcgugaauacugcggguuccuuuaggugcgaaugcccggagggacuuaugcuugaugccaguggaagauuguguguggacguccgacuggagcccuguuuccugagaugggaugaagaugagugcggggucacauugccggguaaguauagaauggacgugugcuguuguagcauuggagcggugugggguguggaaugcgaggccuguccugauccugagucauuggaauuugccucucuauguccacgagggcugggcuucgccuccagagauuuucuaucagggagaccguucuacaaagacguuaaugaguguaaaguguuuccaggucuguguacacauggcacuugucgcaauaccgugggcucuuuucauugcgccugcgcaggaggauuugcccucgacgcucaagagagaaauuguacugacauugaugaaugccgcauuuccccagaucucugcggccaaggaacaugcguaaacacccccggguccuucgaaugcgaaugcuucccaggauaugaguccggauucauguugaugaagaauugcauggacguagaugagugcgccagggauccgcuacucuguagaggaggcaccuguacuaacacugacggaagcuauaaaugucagugccccccaggccacgaacucacagcaaaaggaacagcuugcgaggauaucgacgagugcagccucucugacggccuguguccccauggacaguguguuaauguaauuggugccuuccagugcaguugucacgcuggguuccaauccaccccugacagacaaggcuguguggauaucaacgaguguagagugcagaacgggggaugugaugugcauuguaucaauacagaaggaaguuaccguuguucuugcgggcagggcuauucauuaaugccugauggacgggcuugugcagaugucgaugaaugcgaggagaacccuagagugugugaccagggccacugcacaaacaugcccgggggccacagauguuuaugcuacgauggguuuauggccaccccagauaugaggaccugugucgaugucgacgaaugugauuuaaauccccacauuugccugcauggcgacugugagaauaccaaagggucuuuuguuugucacugccaacuaggauauaugguccgcaagggagcuacuggcuguuccgacgucgaugagugugaagugggaggacacaauugcgauucgcacgcuagcugccugaauauucccggaaguuucagcugccgauguuugccaggaugggucggugacgguuucgaaugucacgacuuagacgaauguguuagucaggagcaucguuguuccccucgaggugacugccuaaacguuccuggaucuuauagauguacaugccggcagggauuugcaggggacggauucuuuugcgaggauagagacgagugcgcggaaaacguugacuugugugauaacggacaaugccugaacgccccagguggcuauaggugcgagugugaaaugggauuugaucccacggaagaucaccgggcuugucaggauguagaugagugugcccaaggcaaccuuugcgcauucggauccugugaaaaucugcccggaauguuucggugcauuugcaacggcggauacgagcuugaccgcggcggaggaaacuguacugauaucaacgagugcgccgaccccguuaacuguauaaaugguguuuguaucaacacccccgguuccuaccucugcucuuguccgcaagauuuugaacucaacccauccgguguuggcugcguggacacgagagcuggcaauugcuuccucgagacucacgaccguggagauucagggaucucuugcagcgcugaaaucggaguuggugugacucgggccuccuguuguugcucauuaggccgggcuuggggcaauccuugugagcuuugcccuauggcaaacaccacagaauaucguaccuuguguccagguggcgagggguuccagccuaacaggaucacaguaauccuugaggacauagacgagugucaggagcuacccgggcuaugccaggggggagauugugugaauaccuuuggaagcuuucaaugcgaguguccgccaggauaucaucugucagagcacaccagaaucugugaagacauugaugaauguucuacucauucaggaauuugcggcccaggaacuugcuauaauacucuuggcaacuacaccugcgugugcccagcagaauacuugcagguuaacggaggcaauaauuguauggauaugagaaaaagcguaugcuuuagacauuauaacggcaccugccagaaugaacuggccuucaaugucacuaggaaaauguguugcuguucauauaauaucgggcaagcguggaaucgcccuugugaagcuugucccacccccaucagccccgauuaucagauccugugcgggaaccaagcucccggauucuugaccgauauucacaccgguaagccucuugauaucgacgaaugcggcgaaauuccagccaucugcgccaacggaauauguauuaaucagauagggucuuucagaugugaaugcccggccggcuuuaacuauaauuccauucuauuagccugcgaagauguggacgagugugggucgcgcgagucuccuugccagcagaaugcugauuguauaaauauacccggaagcuacagaugcaaaugcacacgcggguauaaacuuucacccgguggggccugcguuggcaggaacgaauguagagaaaucccuaauguuuguagucauggggauugcauggauacggaaggcucguacauguguuuaugucauagaggauuccaagcaagcgccgaccagaccuuguguauggacaucgacgagugugacagacagcccugcgguaauggaacuuguaagaacaucaucggcucuuauaacugucuguguuucccaggcuucguaguuacccacaauggggacugcguggauuuugacgaguguaccacauuaguaggucaaguaugucgcuucggccauuguuuaaauaccgcaggcuccuuucacugucuaugccaggacggguucgaacucaccgcugaugguaagaacugcguggauaccaaugaaugccucucucuggccggaacaugccugcccgguacuugucaaaacuuggaaggguccuucagauguauuugccccccaggauuucagguucaaagugaccauugcauugacauugaugaguguagcgaagaaccuaaucugugccuguucggaaccugcacaaacaguccgggcagcuuccagugucuuuguccacccggcuuugugcucagcgauaauggacacagaugcuucgacacuaggcagaguuuuugcuuuacacgguucgaggccggcaaaugcuccguacccaaggcuuucaacacaacuaagacaagaugcuguuguucuaaaaggccuggagaagguuggggagauccaugugagcucugcccucaagagggaagugcugccuuucaagagcucuguccguuuggucauggcgcugucccggggcccgaugauucaagagaggauguuaacgagugugcagagaacccaggcguuugcacuaacgguguuugcgucaauacagauggaagcuucagaugcgaaugcccuuuuggauacucccuggauuuuacaggaaucaauugcguggacacugacgaaugcucugugggacauccaugcgggcaggggaccugcacaaacgugauuggggguuucgagugcgccugugccgacggauuugaacccgggcuaaugaugacaugcgaagauaucgacgaguguucccugaacccauuacucugcgccuuccgaugucacaauacugaaggaagcuacuuauguacuugcccugcuggguacacucugagagaggauggggcaauguguagagauguggacgagugcgccgaugggcagcaggacugucaugccagaggaauggaguguaagaaucuuauugggaccuuugccugcgugugccccccuggaaugcgaccccuuccuggaagcggagaaggcugcacagacgacaaugagugccaugcucagccugacuuaugcgugaacggaagaugcguaaacacggcggggucuuucagaugcgauugcgacgaaggcuuccagccaucuccuacccugacagagugccaugauauuaggcaagggcccugcuucgccgaggugcuccaaacaaugugccgaucacuaucuucaucgucugaggccgugacuagagcagaauguugcuguggcgggggaagaggcugggguccccgcugugaacuuugcccacucccugggaccuccgcuuauagaaaauugugcccgcauggauccggguacacagcugagggcagagauguggacgaguguaggauguuagcccaucugugcgcccauggcgaauguauuaauucucugggaucguuucggugucacugccaggcaggguauaccccagacgcaaccgcuacaacaugucuggacauggaugaaugcucccaaguaccgaaacccugcaccuuuuuaugcaaaaacacuaagggaagcuuccucugcagcuguccacgugguuaucuccuggaagaggauggcagaaccugcaaggaucuggacgaauguaccucucgacaacacaauugucaguuucugugcgucaauacggucggugccuuuaccugcagaugcccacccggcuuuacucagcaucaccaggcuuguuucgacaacgacgaauguuccgcacaaccaggccccugcggugcccacggccacugucacaauacuccagggagcuuuagaugcgagugucaucagggauuuacucuggucucaucuggccauggaugugaagacguaaacgaaugugauggcccgcaucgcugccagcacggaugccaaaaucaguuggguggguacagauguagcuguccucaagguuuuacucaacacucccagugggcacagugcguggaugagaaugaaugcgcccugucaccucccacauguggaucugccagcuguagaaauacccuaggcgguuucagaugcgugugcccgagcggguucgauuucgaucaagcguuaggagggugccaagagguagacgagugcgcuggcagacgcggacccuguaguuauucuugcgccaacacucccggaggguuccuguguggauguccccagggguacuuuagagccggacaaggacauugcgucagcggucuuggauucucuccagggccacaggauacgccagauaaagaggagcuccucucaagugaagcaugcuaugagugcaaaauuaauggccuguccccccgagaucgcccccgcagaagugcccaccgugaccaucaggugaaccuugccacauuggauagcgaagcccuguuaacguugggauugaaccuaucacaccucggacgugcggagcgcauccuggaacuaagaccugcauuggagggcuuagaggggaggauuagauauguaaucguucgagggaacgaacaaggauuuuuccgaaugcaccaucucagaggcguuagcucacugcagcuggggcgacgucggcccgguccaggcaccuacagacuggagguaguaucccauauggcaggcccuuggggaguacagccugaaggucaaccugguccuuggggccaggcucugcgccuaaaaguucaacuucagcugcucuag

SEQ ID NO: 15129 - RNA, 291 nt, Artificial Sequence; identical to SEQ ID NO: 13490
  Description of Artificial Sequence: Synthetic coding sequence

SEQ ID NO: 15130 - RNA, 1890 nt, Artificial Sequence
  Description of Artificial Sequence: Synthetic coding sequence
augcaacaagacggccucggaguagggacacgaaacgguucgggaaaaggacgcucuguucaucccuccuggcccuggugugccccucggccgcugcgcuauuuuggaagagaugcgcgcgcuaggagagcccaaacagccgcgauggccuuacuggcaggaggccucucccggggucuugggucccaccccgcagccgcaggccgagaugcugugguguuuguuuggcuguugcugucuacuugguguacugccccagcaagagcgauucaggucacaguuucuaauccguaccacgugguuauucuuuuccagccugugacccuaccguguaccuaccaaaugaccucuacgcccacacaacccauugucaucuggaaauauaaaaguuucugucgcgauagaaucgccgaugcuuucagccccgcauccguggacaaucaguuaaaugcccaguuagcugcugggaauccuggguacaaccccuacguggagugucaagauagcguaagaacagugagaguuguggcaaccaaacaagggaacgcagugacccucggcgacuacuaccaggggagacgaaucaccauuacuggcaaugcagaucugaccuucgaucaaaccgcguggggugacuccggcguuuacuauugcucugucgucuccgcucaggaccuucagggaaacaacgaagccuaugcagaacugauuguucucgacugguuguuuguggugguggugugccuggcugccuuccucauuuucuugcugcucgggaucuguuggugucaguguuguccucacacaugcuguuguuacguacgcugcccuuguugcccggauaaaugcugcugccccgaagcccuauacgcggcaggcaaggcugcgacaucuggagugccgucuaucuaugcaccaaguacauacgcacaccuuagcccagcuaagacuccuccuccccccgcuaugauaccaaugggcccagccuauaacggauaccccggcggcuacccuggagacgucgaucgcaguuccuccgcuggaggccaggguaguuacgucccccuucucagagauaccgacagcucuguugcuucaguccgcaguggguaccgcauccaagccagccagcaggaugacuccaugcgugucuuguauuacauggaaaaagagcucgcaaauuucgacccaucccguccaggacccccauccggacggguggagagagcaaugucagaggucacaagucugcacgaagaugacuggagauccagaccuucuagaggccccgcacugacaccgauccgcgacgaagaauggggagggcacagucccagaagcccacguggaugggaccaagagccagcaagagagcaagccggaggcggauggagagcgcgcagacccagggcaagaagcguggaugcgcuggaugaccuuacaccaccuucuacugcugagucugguuccaggagcccuacaagcaacgguggaaggaguagagccuauaugccuccgcgcucuagaucucgcgacgaccuguaugaucaggaugacucccgcgacuuuccgcgcucuagggauccccacuaugaugacuuucggagucgcgagcgcccgccagcugauccucguucacaccaucauagaacuagagacccucgagacaacgggaguaggucuggugaucucccauacgacggucggcuccuugaagaggccguacggaaaaagggcagcgaagagaggcgacgaccccacaaagaagaagaagaagaagccuauuaccccccagccccgccccccuauuccgaaaccgacucucaggcaucgcgcgagagacguuuaaagaagaauuuagcacugagcagagaaucccuuguugucuag

SEQ ID NO: 15131 - DNA, 711 bp, Artificial Sequence
  Description of Artificial Sequence: Synthetic coding sequence
atggatttccaagtccaaattttttcatttttattaatctccgcttcagttattatttctagaggacaaattgttttaacacaatcaccagcaattatgtcagcttctccaggagaaaaagttacaatgacatgttctgcttcatcatcagttacatcaatgcattggttccaacaaaaatctgggacttccccaaagcgttggatttatgatacatcaaagttagcatcaggtgttccagcacgattctcaggatcaggatctggtacatcatattcacttacaatttctattatggaagcagaagatgcagctacatattattgccaacaatggaattataatccacctatgggaacatttggtggaggaacaaagttagaaataaaaagagcagatgctgctccaactgtaagtatatttccaccatctagtgaacaattaacatcaggtggtgcatctgttgtttgttttcttaacaatttttatccaaaagatataaatgttaaatggaaaattgatggttcagaaagacaaaatggagttttaaactcttggactgatcaagattctaaagactctacatattctatgtcttctactttaactcttacaaaggatgaatatgaacgtcataactcatatacatgtgaagcaactcataaaacatcaacctcaccaattgtaaaatcattcaatagaaatgaatgt

SEQ ID NO: 15132 - DNA, 711 bp, Artificial Sequence
  Description of Artificial Sequence: Synthetic coding sequence
atggactttcaagttcaaatcttctccttcctgctgataagcgcatccgtgattatctctcgtggccagattgtgctgacccagagcccagcaataatgtcagcgtcacctggcgagaaagttaccatgacttgttcagccagtagtagcgtcacaagcatgcattggttccaacagaagtcagggaccagccccaaacgctggatttacgatacgtccaagctagcgtcaggtgtgcctgcccgtttttccggctcaggcagtggtaccagttattcactgactattagcataatggaggccgaagatgctgcaacctattactgtcagcagtggaattacaatcctccgatggggactttcggcggaggaaccaaactggaaatcaaacgcgccgacgcagcacccactgtgtccatctttcccccatcctccgagcagttgacctctggtggagcctctgtggtttgttttctgaacaacttttatccgaaggatattaatgtcaagtggaagattgatggatccgaaagacagaatggagtgcttaactcatggaccgaccaggatagtaaagacagtacttactcaatgtcttctaccctgaccctgacaaaagacgagtatgagcgtcacaattcgtacacttgcgaagctacacataagacatccaccagtcccatcgtcaaaagcttcaacagaaacgagtgt

SEQ ID NO: 15133 - DNA, 711 bp, Artificial Sequence
  Description of Artificial Sequence: Synthetic coding sequence
atggattttcaagtgcaaatcttctcgttcctgctgatcagcgcatcagttatcatctcacgaggccagatcgttctgacccaatccccggccatcatgtcggcctctccgggcgagaaggtgaccatgacctgctcagcgtcatcgtccgtcacttcgatgcactggttccagcaaaagagcggcacctcgccgaaaagatggatatacgatactagcaagctggcctccggagtcccagctcgcttttcgggctctggaagcggaacctcctacagcctgactatctcaatcatggaagccgaggatgctgcaacctactactgccagcagtggaactacaacccgccgatgggaacgttcgggggtggaactaagctggaaatcaagcgggccgacgccgcaccgactgtctccatcttccctccgtccagcgaacagttgacgtctgggggtgcctcggtcgtgtgtttcctgaacaacttttaccccaaggatatcaatgtgaaatggaagattgacggaagcgaacggcagaatggagtgctcaatagctggactgaccaagattccaaggactccacctactccatgtcgtccactctcactctgactaaggacgaatacgaacgccataatagctacacttgcgaagcgacccataagacgtccacttcaccgatcgtgaagagcttcaacaggaatgagtgc

SEQ ID NO: 15134 - DNA, 711 bp, Artificial Sequence
  Description of Artificial Sequence: Synthetic coding sequence
atggattttcaggttcaaattttctcattcttgcttatctctgcctcagttatcatcagcagaggacagatcgtcttgacccagagccccgccattatgtcagctagcccgggggagaaagtgactatgacttgttctgctagtagttccgttaccagtatgcattggtttcagcaaaaatctgggaccagtcccaaaaggtggatttacgatacctccaaactcgctagtggggtacccgctcggttcagcggctccgggagcggcacctcatactctctcactattagtattatggaggcagaagacgctgcgacatactactgccagcaatggaactacaatcctccaatggggacattcggcggtggcaccaaacttgaaattaagagagctgacgctgcgccaaccgtgtctatattccctccctcatccgaacagctgacctccgggggcgcctcagtcgtttgctttctgaataatttctacccaaaagacatcaacgttaagtggaaaatcgatggctctgagcggcagaacggagtactgaatagctggacggaccaggacagtaaagacagcacttacagcatgtcctctacactgaccttgactaaggatgaatacgaacgccacaactcttatacttgtgaggctactcataaaacttccaccagccccatcgttaagagcttcaatcggaacgagtgc

SEQ ID NO: 15135 - DNA, 711 bp, Artificial Sequence
  Description of Artificial Sequence: Synthetic coding sequence
atggacttccaggtgcagatcttttccttcctccttatcagcgcgtcggtgatcatctcgaggggccagatcgtgctcacgcagagcccggcgattatgtcagcctcgcccggcgaaaaggtcactatgacctgtagtgcatcctcctcggtcaccagcatgcactggttccagcaaaagagcggaaccagcccaaagcgctggatttacgacacctccaagctcgccagcggcgtgccagctcggttctctggatccgggtcgggaacttcatacagcctgaccatctcaatcatggaggccgaagatgcagctacctactactgccagcaatggaattacaacccgccgatgggaactttcggaggaggtaccaaattggagatcaagcgcgcggacgccgccccaactgtgtcgatctttccgccgtcgagcgagcaactgacttcggggggtgcctccgttgtgtgcttcctgaataacttttatcctaaagatattaatgtgaagtggaagatcgacggctcggagcggcaaaacggagtcctgaactcgtggaccgaccaggattctaaggactcaacttactccatgtcatccactctgaccctgaccaaagatgagtacgaaagacacaactcctacacgtgcgaagcaactcataaaactagcacctcccctatcgtcaagtcattcaacagaaatgaatgc

SEQ ID NO: 15136 - DNA, 711 bp, Artificial Sequence
  Description of Artificial Sequence: Synthetic coding sequence
atggactttcaggtgcagatcttctccttcctgctgatttctgcaagtgtgattatcagccgaggtcagattgtactgacacagtctcccgccatcatgagtgccagcccaggcgagaaggttaccatgacatgttcagcgtcgagcagcgtgacctcaatgcactggttccagcagaaatctggtacatcgcccaagcgctggatctacgacacatcaaagctcgccagtggagtgcccgcgcgatttagcggatcaggctcaggtactagttacagtctgacgataagcattatggaggcggaggatgctgcaacctactactgccaacagtggaactacaatccacccatgggaacattcggcgggggtactaaacttgagattaaacgggcagatgctgcaccaaccgtgagcatcttccccccatcatcagaacagctgacgagcggaggcgcgagcgtggtctgcttcctcaataacttctacccaaaggatatcaatgtgaagtggaaaatagacgggagcgagcgccagaatggagtgctcaactcttggacagaccaggatagtaaagacagcacctatagcatgagctcaaccctgacactgaccaaggacgaatacgaacggcacaattcttatacctgcgaggccacccataagacctctacctcacctatcgttaaatctttcaaccgaaatgagtgc

SEQ ID NO: 15137 - DNA, 711 bp, Artificial Sequence
  Description of Artificial Sequence: Synthetic coding sequence
atggactttcaggtccaaatctttagctttctgctaatctctgcctccgtgattatttcaagagggcagattgtgctcactcagagtccagccattatgtccgcgtccccaggcgagaaggttacaatgacctgttctgctagctcctccgttacaagcatgcattggttccagcagaaaagcggcactagcccaaagcgttggatttacgatacatctaaactggcgtcaggggttccagctagattctccggctctggcagtggtacctcatactccctgactatcagcatcatggaggctgaggacgccgccacctattattgccagcagtggaattataaccctcctatggggacctttggagggggaacaaagctggagattaaacgtgccgacgcggccccaactgtttctatttttcccccatctagtgagcagctcaccagcggtggcgcgtccgtagtatgttttctcaataatttctaccctaaggacataaacgtgaaatggaagatcgacggaagcgagcgacagaacggcgtgctgaattcttggacagaccaagacagtaaggattctacctattccatgagctcaacactcacactcactaaggacgaatatgagcgtcataacagctatacttgcgaggcaacccacaagacatctacatctcctattgttaaaagtttcaatcggaacgagtgt

SEQ ID NO: 15138 - DNA, 711 bp, Artificial Sequence
  Description of Artificial Sequence: Synthetic coding sequence
atggactttcaagtccagattttcagctttctgctgatttcggcatccgtaatcatatctaggggtcaaattgtgttgacccaaagccctgcgatcatgtcggcgagcccaggtgagaaggtgaccatgacctgcagcgctagctcgagcgtgacttctatgcactggtttcagcagaagtccgggacgtcacccaaacggtggatctatgacacctccaaactggcaagtggagtgccagcacggttttcaggaagtggctccgggactagctactctcttacgatttccataatggaggcggaagatgcagctacctactactgtcaacaatggaattacaatcctcctatgggtacctttgggggcggcacgaagttggaaatcaagagagcagacgcagcccctaccgtgtcgatctttccaccgtccagtgaacaactcacgtcgggaggcgcatccgtcgtgtgtttcctgaacaacttctaccccaaggacattaacgtcaaatggaaaattgatggatctgaacgtcaaaatggtgtgcttaactcatggaccgatcaggattccaaagatagcacttactcaatgtcctcgactcttactctcacgaaggatgagtacgaacgacataacagctatacttgtgaagctacgcataagacttccacctcccccatcgttaagtcgttcaatcgcaacgagtgc

SEQ ID NO: 15139 - DNA, 711 bp, Artificial Sequence
  Description of Artificial Sequence: Synthetic coding sequence
atggacttccaggtgcagatcttctcctttctgctgatctcggcgtcagtcatcatttcgaggggccagatcgtgttgacccaatcgccggcaatcatgtccgcctcgcctggggagaaggtcactatgacgtgttcggccagctcatccgttacttcaatgcactggtttcaacagaaatccggaactagccctaagcggtggatctacgacacctcgaaacttgcatctggggtgccagccagattctcagggtccggatccggtacctcatactcgctcaccatcagcataatggaggccgaggacgctgcgacctactactgccaacagtggaactacaatccaccaatggggacctttgggggcggcaccaaattggagatcaaacgcgccgatgctgcgccaactgtgtcgatattcccaccgtcctccgaacagctgacgtccggaggagcatcggtcgtgtgctttctgaataacttctatccaaaggatatcaacgtgaagtggaagatcgatggaagcgaacgccagaacggagtcctgaactcgtggaccgaccaggactcaaaagattccacctactcgatgagctcgaccctcaccctgactaaggacgaatacgaacgccataacagctacacgtgcgaagcgactcacaagacttcgaccagcccgatcgtcaaatcgtttaaccggaatgaatgc

SEQ ID NO: 15140 - DNA, 711 bp, Artificial Sequence
  Description of Artificial Sequence: Synthetic coding sequence
atggattttcaagttcagatatttagttttctccttattagtgcttccgttatcattagccgaggccaaatcgtcctaacacaaagtccggctataatgagtgcctcaccgggagaaaaggtcactatgacttgctccgcgagcagcagcgtcacgtcaatgcattggttccaacagaagagtgggacgtctcccaagcggtggatatatgacacgtcaaagttggcttctggggtgcctgcgaggttctccggttcgggttcgggaaccagttactccttaactattagcattatggaagcagaggacgctgcgacttattactgccaacagtggaactacaatccaccgatggggacgttcggaggcggtaccaagcttgaaattaaaagggcggatgctgctccgaccgtttcgatattcccgccgtcctccgaacaactcacgtcgggaggtgcgtccgttgtctgttttctgaacaacttttaccccaaggatattaacgtgaagtggaagatagacggtagcgaacggcagaatggagttttgaatagctggaccgatcaggactcaaaggactccacctatagcatgtcctctaccttgacgcttacaaaggacgagtatgaacggcataattcgtatacgtgcgaagcaacgcacaaaacctcgacctcgcccattgtcaagagtttcaaccgcaatgaatgt

SEQ ID NO: 15141 - DNA, 711 bp, Artificial Sequence
  Description of Artificial Sequence: Synthetic coding sequence
atggactttcaggtgcaaatctttagctttcttctgatctccgccagcgtcatcatctcaaggggacagatcgtgctgactcaatctcctgcgattatgagcgcttctcctggcgaaaaggtgaccatgacatgctccgccagctctagcgtgactagtatgcattggttccaacaaaaaagcggcacaagcccaaagcggtggatctacgacacaagcaagctggcttctggcgtccctgcacgcttcagcggctccggcagcggcacatcttactctctaaccatttctatcatggaggccgaagacgctgccacatattactgccagcaatggaactacaaccccccaatgggaacctttggagggggcaccaagctggaaatcaagcgtgccgatgctgcgcctacagtgagcattttccctccaagctctgagcaactcacatccgggggagctagcgtggtctgcttcttgaacaatttctaccctaaagatatcaatgttaaatggaaaatagatggatctgagagacaaaacggtgtccttaactcatggaccgaccaggactctaaagactccacgtacagtatgagtagcaccttgacactcactaaagacgaatacgagagacataactcttacacttgcgaggcgacacacaaaacatccacaagccccatcgtcaagagcttcaaccgtaacgaatgc

SEQ ID NO: 15142 - DNA, 711 bp, Artificial Sequence
  Description of Artificial Sequence: Synthetic coding sequence
atggacttccaggtccagatcttctcgttcctgctgatttccgctagcgtgatcatctctcgcggtcaaattgtcctgacccagtctccagccattatgtccgcgagcccaggtgagaaagtgaccatgacatgctccgcttcgtcctctgtgaccagtatgcactggtttcagcaaaagtcgggaaccagcccgaagcgctggatctacgatacctcgaaactggcctctggggtccctgcccggtttagcggttccggtagcggaacttcctacagtctcacaatcagcattatggaagctgaggacgcggctacatactactgccagcaatggaactacaacccacccatgggtactttcggtggcggcactaagctggaaattaagcgggcagatgccgctcctaccgtctctatcttccccccctcctccgagcaactcacctctggcggagcatccgtcgtgtgtttccttaacaacttttatcctaaggacattaacgttaagtggaagatcgacgggtccgaacgtcagaacggcgttttgaatagctggaccgatcaggactccaaggactccacgtattcgatgtctagtacactcaccctgacaaaggatgaatacgagcgacacaattcatacacctgcgaggccacgcacaagacaagcactagtcccatcgtcaagagttttaaccgcaatgaatgc

SEQ ID NO: 15143 - DNA, 711 bp, Artificial Sequence
  Description of Artificial Sequence: Synthetic coding sequence
atggacttccaagtgcagatcttttcttttttactaatcagcgcatccgtgatcatcagcaggggccagatcgtgttgacacagtcgcccgccatcatgagcgcgtctcccggcgagaaagtgaccatgacatgttctgcctcaagttctgttaccagtatgcactggttccaacagaaaagtggtactagtcccaagcggtggatttacgatacctcgaagctggcttcgggtgtcccagccaggtttagtgggtccggcagcggcacctcgtactcactgaccatttctataatggaagccgaagatgccgcaacgtactattgtcagcagtggaactataaccctccaatgggcaccttcggcggaggaactaaactggaaattaagcgcgcagacgcagcaccaacagtgagcatattccctccctcctccgagcagttgacatccggcggggccagcgtagtgtgttttctgaataacttttaccctaaagacatcaatgtaaaatggaaaatcgacgggtccgagagacagaatggtgtgcttaactcttggacagaccaggacagcaaggactccacctactccatgagctcgaccttgactctcactaaggacgaatacgaacgacataatagctacacttgcgaggccacacataagacatccaccagtcccattgtcaagtcttttaaccgaaatgaatgc

SEQ ID NO: 15144 - DNA, 711 bp, Artificial Sequence
  Description of Artificial Sequence: Synthetic coding sequence
atggactttcaggtacagatcttcagctttcttcttatcagcgccagcgtgataataagccggggacaaatcgtgttgacccaaagtcctgctattatgtctgcgagccctggcgaaaaggtaactatgacatgcagtgcctcctcttccgtcacaagtatgcattggtttcaacaaaagagcggcacaagtcccaagcgctggatttacgacacctcaaagctggccagcggggttccagcgagatttagtggtagcggaagcggaaccagctacagtctcaccatctctatcatggaggcagaagatgccgctacttattattgccagcaatggaactacaatccacctatgggtacgttcggcggcggtacaaagctcgaaatcaaaagggccgacgctgctcctaccgtctctatctttccaccgagcagtgagcaactgacaagcgggggcgcatcagttgtgtgcttcctgaacaatttctatccgaaagatatcaacgtgaagtggaaaattgacggaagtgagcggcaaaacggtgttcttaacagctggacggatcaggactccaaggatagtacctatagtatgagcagcaccttgacactgaccaaggatgagtacgaaagacacaactcttacacgtgcgaggcgacgcataaaaccagcacctcccccatcgttaaaagtttcaaccgaaacgagtgt

SEQ ID NO: 15145 - DNA, 711 bp, Artificial Sequence
  Description of Artificial Sequence: Synthetic coding sequence
atggattttcaggtccagatattttcattcctcctgatatctgcctctgtaatcatatcacgcggacagatagtcctcacacagtccccagctattatgtccgcctcacccggagaaaaagtgacaatgacatgctccgctagttcctccgtgacttctatgcactggtttcagcagaagagtgggacaagtccaaaacgatggatatatgatacaagtaaactggcatccggggtccctgcaaggttctccggatctggatcgggaacttcttattcccttactatatctatcatggaggccgaagatgcagctacttactattgtcagcagtggaattacaaccctcctatggggacgttcgggggaggaactaagctggagattaaaagggcagatgcagcccctacagtgagtatctttcccccatcttcagaacaactcacatcagggggggcctccgtggtgtgtttcctcaacaatttttatccgaaagatatcaacgtgaaatggaaaatagatggatccgaaagacagaacggggtcctaaactcctggactgatcaggactccaaagattctacttattcaatgagttctacactgacacttactaaagatgagtatgaaagacataactcctacacgtgtgaggcgacacacaaaacatctacttccccaatcgtcaaatcattcaatcggaacgagtgt

SEQ ID NO: 15146 - DNA, 711 bp, Artificial Sequence
  Description of Artificial Sequence: Synthetic coding sequence
atggactttcaagttcagatcttctctttcctactgatttccgcgtctgttattatctctcggggccagatcgttttgacccagtcaccggcgatcatgagcgctagtcctggtgagaaagttaccatgacgtgcagcgcctcgtcctcagtgaccagcatgcactggtttcaacagaagtctgggacgagtccgaaacgttggatctacgacacttctaaactcgcctccggtgtgccagcgcgtttttccggttccggctctggtacgtcgtatagcctcacaatttcaataatggaggcagaggatgcggcgacctactattgtcagcagtggaattacaacccgccgatgggaacgttcggtggcggcacgaagctggagatcaagcgtgcagatgctgcgcctaccgttagcatcttcccgccatccagcgagcagctgacgtctggtggtgcaagcgtcgtgtgctttttgaacaatttttaccctaaggatattaacgttaaatggaaaattgacggtagtgaacgacagaatggtgtgctcaacagctggaccgaccaagactctaaggacagcacctattctatgtcaagcactctgacgctgaccaaagatgaatacgagcgccacaactcctatacctgcgaagcgacccataaaacctcaaccagcccgatcgtgaagagcttcaatagaaatgagtgc

SEQ ID NO: 15147 - DNA, 711 bp, Artificial Sequence
  Description of Artificial Sequence: Synthetic coding sequence
atggacttccaggtgcagatcttctccttccttctgatctcggcctccgtgatcatctcccgcggtcagatcgtgctgactcagagccccgccattatgtccgcctcacctggagagaaggtgaccatgacttgctcggcctcctcgtcggtgacttcaatgcactggttccagcagaagagcggaaccagcccaaaaaggtggatttacgacacttcaaagctggcctccggcgtcccggcccggttttcagggtcgggctccggcacctcctactcactgaccatcagcattatggaagccgaggacgctgctacttactactgccaacaatggaattacaatccgccaatgggaactttcgggggcggaacgaaattggagatcaagcgcgcggatgccgctccaaccgtgtcgatcttccctccgtcctccgaacagctgacctcaggcggagcttcagtggtgtgtttcctgaacaatttctatcccaaagacatcaacgtgaagtggaagatcgacggctcagagaggcaaaatggagtgctgaacagctggactgaccaggactctaaggattcaacctattcgatgtcgtcgaccctgacgctcacgaaagacgagtacgagcgccacaactcttacacttgcgaggccactcataagacttcgaccagcccgatcgtgaagagcttcaacagaaacgagtgt

SEQ ID NO: 15148 - DNA, 711 bp, Artificial Sequence
  Description of Artificial Sequence: Synthetic coding sequence
atggatttccaggtgcagatatttagtttccttctgataagcgctagcgtgatcatctcccggggccagattgtgcttacccagtctccggccatcatgagcgcatctccaggtgaaaaagtgactatgacttgtagcgccagcagctcagtgacctctatgcattggttccagcaaaaatctggaacaagcccaaagcggtggatatacgataccagcaaactggcctctggcgtgccagcacggtttagtggtagcggaagcggcacatcttactcacttaccatatcaatcatggaagccgaagatgccgccacttactattgccagcagtggaactacaacccccccatgggcaccttcgggggaggcaccaagctagagattaagcgggccgacgctgcacctaccgtgagcatttttccacccagcagcgaacagcttaccagcggtggtgcatctgtggtctgtttcttaaacaacttctacccaaaggatattaatgtgaagtggaagatcgatggctcagagagacagaatggggtgttaaatagttggacagatcaggattccaaggacagtacctacagcatgtcctctaccctgacactgaccaaggatgagtatgagcgccacaatagctatacttgcgaggctactcataagacatctaccagtcctatagtgaagagcttcaatagaaacgaatgc

SEQ ID NO: 15149 - DNA, 711 bp, Artificial Sequence
  Description of Artificial Sequence: Synthetic coding sequence
atggactttcaagtgcagatattctcttttctcctgattagcgcatccgtgatcatctccagaggccagattgtcttgacccagagccccgccatcatgtcggcttcgccaggcgaaaaggtgactatgacctgttccgcatcttccagcgtcacgagcatgcattggttccaacagaagtccggcacgtcgcctaagcggtggatctatgatacttccaagctggcatctggagtgccagcgagattttccggaagcggatccggaacttcgtactcgctgactatctcaatcatggaagctgaggacgccgcgacctactattgccaacaatggaattacaatccccccatgggcacgttcgggggaggaacgaaactcgagataaagagggccgatgcggcacccactgtgagcatttttcccccgagctccgaacagctgacctcgggtggggcttccgtcgtgtgttttctgaataacttttaccctaaggatatcaacgtgaaatggaagattgatggatcggagaggcaaaacggcgtgcttaactcgtggactgaccaagattccaaggattccacctactcgatgtcctccacccttacccttaccaaggatgagtacgaacgacataactcgtacacttgtgaggcgacccacaagacctccactagccctatcgtgaagtcgtttaatcgcaatgaatgt

SEQ ID NO: 15150 - DNA, 711 bp, Artificial Sequence
  Description of Artificial Sequence: Synthetic coding sequence
atggacttccaggtgcagatattctcatttcttctgatttctgcatctgtaataattagccggggccagatcgttctcacccagtcccctgccattatgagcgccagccccggggagaaggttactatgacctgttccgcttcatctagcgtaacctctatgcattggttccagcaaaaatccgggacctcacctaagagatggatttatgataccagtaaactggcctcaggagttcccgctcgcttctccgggtccggaagcggaaccagttattccctgactatctctataatggaggcagaggacgctgccacctactattgtcagcagtggaactataatccacccatgggaacttttgggggaggtacgaaactggagatcaagcgggcagacgctgcgcccaccgtgagcatcttcccgccaagttccgagcagctgacgtctggcggcgcatccgtagtatgcttcctgaacaacttctacccgaaggatattaatgtgaaatggaaaatcgatggctctgagcgacagaacggtgtgctcaactcctggaccgaccaagatagcaaagacagcacatattcaatgagcagcacactcactctgacgaaggatgagtatgaaagacacaattcctatacctgtgaagccacacacaagacttccaccagtcccattgtgaaaagttttaaccggaacgaatgt

SEQ ID NO: 15151 - DNA, 711 bp, Artificial Sequence
  Description of Artificial Sequence: Synthetic coding sequence
atggactttcaggtgcaaattttctcatttctcctgatttccgcttccgttatcattagcaggggacagatcgtactgacacaaagccccgctatcatgagcgcaagtcccggcgaaaaagtcaccatgacatgtagcgcttctagctctgtgaccagcatgcattggtttcagcagaaatccggaacgtcaccaaagaggtggatctacgatacatctaagctggcttccggtgtaccagctaggttcagcggctctggaagtggaacctcctacagtctgactattagcattatggaagcagaggacgcagctacttactactgccagcagtggaactataaccctcccatgggaacattcggaggaggaaccaagcttgaaatcaagagggccgacgcagcccccaccgtaagtatcttccctccctcttcagaacagttgacgtctggtggcgcgtccgtggtttgctttctcaacaatttctaccctaaggacatcaacgtcaagtggaaaatcgacggatccgagcgccagaatggtgtacttaattcttggaccgaccaagactcaaaggactccacctattccatgtcctccactctgacgcttacaaaagacgaatacgaaagacacaatagctacacatgcgaggcaactcacaagacttcaacatcaccaatcgttaagtcctttaacaggaatgagtgc

SEQ ID NO: 15152 - DNA, 711 bp, Artificial Sequence
  Description of Artificial Sequence: Synthetic coding sequence
atggatttccaggttcagattttttcttttctgctcatcagtgcctccgttattatttctcgcggccagatcgtgctgacccagagccctgctataatgtcagccagtcctggcgagaaagtgaccatgacttgttctgcatcttcaagcgtcactagcatgcactggtttcagcagaaatcggggacctcccccaagagatggatatacgatacgagtaaattggcatccggggtgccggctagattttccgggtccgggtccggaaccagctacagtctgacaattagcataatggaagccgaggacgccgcgacttattactgtcaacaatggaactataaccccccaatgggtacattcggaggtgggaccaaattggagatcaagagagccgatgcggcccctacggtttccatcttccccccaagctcagagcagctgacttccggaggcgcctccgttgtctgctttctcaataacttttatccgaaggacataaacgttaagtggaaaatcgatggttccgaaaggcagaatggtgtgctcaactcctggaccgatcaggacagtaaagacagcacctattccatgtctagtacattaacactgactaaggatgagtatgagcggcacaattcgtatacctgcgaggcaactcacaagacgagcacctctccgatcgtaaagagcttcaataggaatgaatgt

SEQ ID NO: 15153 - DNA, 711 bp, Artificial Sequence
  Description of Artificial Sequence: Synthetic coding sequence
atggacttccaggtgcagatcttttcatttctgctgatttccgccagcgtgatcatctctaggggccagattgttctgacgcagtccccagctatcatgagcgcgagtcctggcgagaaagtgacgatgacctgctccgcgtccagttctgtgacgagcatgcattggttccagcaaaagtcggggacctcccccaagcgatggatttatgacacatccaagctcgcttcaggtgtccctgcccgcttttccggctctggaagcgggaccagttactccctgaccatttcaataatggaagccgaagatgccgccacttactactgtcaacagtggaactataacccaccgatgggcacttttggcggtggtacaaaattagagatcaagcgggctgatgccgctccgactgtgtctatctttccaccttcaagcgagcaactgacgagcggaggcgctagcgttgtttgtttcctcaacaacttctaccccaaggacatcaacgttaaatggaaaattgacggatccgagaggcagaacggtgtgttgaattcttggacagatcaggattccaaagattctacgtactctatgtcctcgaccctcaccctgacaaaggacgaatacgaacgacataactcctatacctgtgaggcaacacataagactagtacatcacccatcgtgaagtcttttaaccggaacgagtgc

SEQ ID NO: 15154 - DNA, 711 bp, Artificial Sequence
  Description of Artificial Sequence: Synthetic coding sequence
atggacttccaggtccagattttctcgttccttcttatctcagcaagcgtgatcattagccgcgggcagattgtgttgacccaatcgcctgcaattatgtctgcctccccgggtgagaaggtgactatgacgtgttcggccagctcctcggtcacgtccatgcactggtttcaacagaagtccgggacttcgcctaagcgctggatttatgatacttctaaactggcgagcggagtgccagcacggttctcaggatcgggaagcggtaccagctactcacttaccatctcgatcatggaggcggaggatgccgctacctactactgtcaacagtggaattacaacccccctatgggtacgtttggcggcggcaccaagctggaaatcaagcgagcggatgcagcgcccaccgtgtccatcttccccccttcatccgaacaactcacgtcaggtggagcctctgtggtgtgttttctgaataacttctacccaaaggacatcaacgtgaaatggaaaatcgatggttcagaacgtcaaaatggagtgcttaattcctggactgatcaagactcgaaagattccacttactccatgtcctcgactctgaccctgacgaaagatgaatacgagcggcataattcttacacgtgcgaagcaactcataagacgtcaactagcccaattgtgaagtcattcaacagaaacgaatgc

SEQ ID NO: 15155 - DNA, 711 bp, Artificial Sequence
  Description of Artificial Sequence: Synthetic coding sequence
atggactttcaagttcaaattttcagctttctcctgatttcagctagcgttatcatcagcagaggccagatcgtattgacccagtctccagctatcatgtctgcatcgccaggcgagaaggtgaccatgacctgttctgcctcaagctccgtcacttcaatgcactggtttcagcagaagagcgggacctcgccaaaacgctggatttatgataccagtaaactggctagtggagtgcctgcccggttctcgggctctggtagcggaacatcatattcattgaccatctctataatggaagccgaagatgcagctacctactactgtcagcagtggaattataaccctcctatgggcacatttgggggaggcaccaaactcgaaattaaaagagccgatgccgctccaactgtttccatttttcccccctcttccgaacagcttacaagcggaggcgcaagcgtcgtgtgctttctgaacaatttctaccctaaagatatcaatgtcaaatggaagatcgatggctctgagagacagaatggagttctgaacagctggacggatcaagattccaaggatagcacctattctatgagttcgacgcttacactgaccaaggacgaatatgaacgccacaatagttacacatgtgaagccacgcacaaaacttcaactagcccgatagttaagagttttaacaggaacgaatgt

SEQ ID NO: 15156 - DNA, 711 bp, Artificial Sequence
  Description of Artificial Sequence: Synthetic coding sequence
atggactttcaggtccaaatcttctccttcttgcttatatcagcttcggtgatcatctccagggggcagattgtattgacgcagtctccagcaatcatgtctgcgtcacccggtgagaaggtaaccatgacctgttctgcctccagctcagtcacgagtatgcactggtttcaacagaagagcggtactagccccaagaggtggatctatgacacgtccaagttggccagtggcgtgcccgccaggttctcaggcagcggatccggtacctcttattctttgacgatctccatcatggaggccgaagacgccgctacttattactgtcaacagtggaactacaatcccccaatggggacctttggaggtggcaccaaattggagattaagcgggcggatgccgcgcctactgtgtccatcttccctcccagctctgagcagctcacctctggaggggccagcgtcgtgtgtttcctgaacaacttttaccccaaagatattaatgtgaagtggaagatagatggcagtgaacgccagaacggagtactgaattcgtggacagatcaggactctaaagacagcacttattccatgtcatccactttgactcttaccaaggatgaatatgagcgacacaacagctacacttgcgaggccactcataaaaccagcacctcgcccatagtaaagagcttcaacaggaacgaatgc

SEQ ID NO: 15157 - DNA, 711 bp, Artificial Sequence
  Description of Artificial Sequence: Synthetic coding sequence
atggactttcaggtccagatattctcatttctgctgatatcagcatctgttatcattagtagaggtcagattgttctgacacagtcaccagcgatcatgtcagccagtcctggcgaaaaggtgactatgacttgtagtgcatcaagcagcgtcactagcatgcactggttccagcagaaaagcggaacgtcaccaaaacgatggatctatgatacctctaagctcgcgtccggcgtgccggcacgctttagcgggagcggaagcggaactagttattctctaactatttccatcatggaggcggaagatgcagccacatactactgccagcagtggaattacaatcctcctatggggacatttggtggagggactaaacttgagataaagcgagctgacgccgcaccaacagtgtccatctttccaccatcttctgaacagttaacttctggcggggcaagcgtggtatgttttctgaacaatttttatccaaaggatatcaacgtgaagtggaagatcgacggatccgaacgccagaacggggtgctgaacagctggaccgatcaggatagcaaggattccacctattccatgtcaagcactttgacattgaccaaggacgagtatgagcgacacaacagttacacttgcgaggcaacgcataagacaagtacatctcccatcgtgaagtctttcaacagaaacgagtgt

SEQ ID NO: 15158 - DNA, 711 bp, Artificial Sequence
  Description of Artificial Sequence: Synthetic coding sequence
atggacttccaggtgcagatctttagcttcctgcttatctcggcttctgtgatcattagccgcggccaaatcgtgttgactcagtcgcctgcgatcatgtcagcttccccgggggaaaaagtcactatgacgtgctccgcctcgtcatccgtcacctccatgcactggttccaacagaaatcgggaacttcacctaagcgctggatttacgacacctcaaagctggcgagcggtgtgccagcacgcttctccggctcgggttcgggaaccagctattcactcacgatcagcatcatggaggctgaggatgcagcgacctactactgccagcagtggaattacaacccgcctatgggtaccttcggcggggggactaaactggaaatcaagcgcgccgacgcggccccaactgtgtcgattttccctccgagctccgaacaactgacttcagggggagcctcggtggtgtgcttcctgaacaacttctaccccaaggacattaacgtcaagtggaagattgatggatccgagcggcagaacggggtgctgaatagctggactgaccaagactccaaggacagcacttactcaatgtcctcaaccctgaccctgaccaaggacgaatacgaacgccacaattcatatacgtgcgaggccactcacaaaacctcaacctcacccatcgtgaagtcattcaataggaacgaatgc

SEQ ID NO: 15159 - DNA, 711 bp, Artificial Sequence
  Description of Artificial Sequence: Synthetic coding sequence
atggactttcaggtccagatcttcagttttctactgatcagtgcgtccgttataatcagccgcgggcagattgtgctgacccagtctccggcaattatgtcggctagccccggtgaaaaagtgacaatgacatgctccgcatcgtcatctgttacatcaatgcattggttccagcaaaaaagtggtactagtccaaaacgatggatctacgacacttccaaactggcatccggggtgcctgctcgcttctccgggtccggctctggtacatcctacagcctgactattagcatcatggaggccgaggacgccgcgacttactactgtcagcaatggaactacaatcccccaatggggactttcggcggagggaccaagctagagatcaagagggcagatgctgcccccacggtatccatctttccgccctcatccgagcagctgacctcaggcggggcttctgtagtgtgtttcctcaacaatttttaccccaaagacattaacgtaaaatggaaaattgacggaagcgagaggcagaatggcgtccttaattcttggacagaccaagactcaaaagattctacatactccatgtcttctaccctgaccctcactaaggatgaatatgagaggcacaactcttacacttgcgaagcaactcataaaacatccacttctcctatcgtcaaatctttcaaccgtaacgagtgc

SEQ ID NO: 15160 - DNA, 711 bp, Artificial Sequence
  Description of Artificial Sequence: Synthetic coding sequence
atggattttcaggtgcaaattttttcctttcttctgatttccgctagcgttattatctctaggggacaaatcgtgctgacacaatcacctgccatcatgagtgcttccccgggcgagaaagttacaatgacatgcagcgccagttcttcagtgacaagcatgcactggtttcagcagaagagtggaacaagccccaagcggtggatatacgatacctccaagctagcatcaggcgtgccagccagattctcaggctccggaagtgggacatcctactctctgactatcagtatcatggaggccgaggacgcggcaacttattattgccagcagtggaactataaccctcctatgggcacttttggaggcgggactaagctggagataaagcgtgcagatgcagcacctaccgtttccatcttcccacctagcagcgaacagctaaccagtggcggggcatcagtcgtttgttttctgaacaacttctacccaaaagacattaacgtcaaatggaaaattgatggatcagagcgccagaatggggttctgaattcctggactgaccaggatagtaaagattccacctactcgatgtcttccacactcacccttacgaaggatgagtatgagcggcacaattcctacacatgtgaagcaacccataagacatctacaagtcctatcgtaaagtcatttaaccggaatgaatgt

SEQ ID NO: 15161 - DNA, 711 bp, Artificial Sequence
  Description of Artificial Sequence: Synthetic coding sequence
atggacttccaagtgcagattttttcattcctcctgatcagtgcttctgtcataatatcacggggacagatcgtcctgacccagtcccctgccatcatgagcgcctctcccggtgaaaaagtcacaatgacctgttctgcctcatctagtgtcaccagcatgcattggttccagcagaagagtgggacatcccccaaaaggtggatctacgatactagcaagctagcaagcggagtcccggctaggttcagtggctccggcagcggcacatcttacagcctgactatttctatcatggaggccgaggacgctgccacgtattattgtcagcagtggaactataacccacctatgggaacctttggcggtggcacaaaattagagataaaacgggccgacgccgcgccaactgtatccatcttccccccttcaagcgagcagctgacctccggcggagcgtctgtcgtgtgtttcttaaacaatttctatcccaaggatatcaatgtcaagtggaaaatcgacgggagtgaaaggcagaacggagttttgaactcctggacggatcaggatagtaaagacagcacatactccatgagcagcactctcactctgacgaaagacgagtacgaacgccacaatagttacacgtgcgaagccacgcataagaccagtacatcccctattgttaagtccttcaatagaaacgaatgc

SEQ ID NO: 15162 - DNA, 711 bp, Artificial Sequence
  Description of Artificial Sequence: Synthetic coding sequence
atggacttccaggtgcagatctttagcttcctgctgatttccgctagcgtaatcatttctagaggacagatcgtgcttacacagagcccggctatcatgtccgcctcccctggagaaaaggtcacaatgacatgttcggcctcaagttccgtgacttccatgcattggttccagcagaagtccgggacgtcaccgaaaaggtggatctatgacacttcaaaactggcgtcaggagtcccagcacgatttagcggctcaggcagcgggacatcctacagcctgactatttctattatggaggctgaggacgccgccacctattactgccagcagtggaattacaatccaccaatgggtaccttcggaggaggaacgaaattggaaattaagagggcagacgctgcacctacggtctccatcttccccccgtccagcgaacaattaacatcaggaggcgcaagcgtcgtctgttttctgaacaacttttaccccaaggatataaatgtgaaatggaagattgatggatccgagcgacaaaatggtgtgcttaattcttggactgatcaagacagcaaagattccacttatagtatgagcagtactctcacccttactaaggatgaatatgagcggcacaattcctacacctgcgaggcaactcataagacgagcacatccccaatagtaaagagcttcaaccggaacgaatgc

SEQ ID NO: 15163 - DNA, 711 bp, Artificial Sequence
  Description of Artificial Sequence: Synthetic coding sequence
atggacttccaagtccaaatcttcagcttcctgctcatctcagcatccgtgatcatctcgcggggacaaatcgtccttactcaatcgcctgcgattatgtcggcctctccaggagagaaagtgaccatgacctgctcggcgtcatcgtcagtcacgagcatgcactggttccaacagaagtctggcacttcacccaagcgctggatctacgacacgtcgaaactcgcatccggagtgccagcccgcttctctggaagcggctcaggaacctcgtattccctgaccatctcgatcatggaagccgaggatgcagcgacctactactgtcaacaatggaattacaacccccctatgggcacctttggagggggcactaagctcgagatcaaacgggcggacgccgctcctaccgtgtccattttcccgccgtcctcagagcagctgacctctggtggggcatcggtggtgtgcttcttgaacaacttttacccaaaagacatcaacgttaagtggaaaatcgacgggagcgagagacagaacggagtcctcaatagctggaccgaccaggactccaaggacagcacctacagcatgtcctccactctgactctcacgaaggacgaatacgagcgccacaactcctacacctgcgaggcgacccacaagacctccaccagcccaatcgtgaaatcatttaaccggaacgagtgc

SEQ ID NO: 15164 - DNA, 711 bp, Artificial Sequence
  Description of Artificial Sequence: Synthetic coding sequence
atggatttccaggtgcaaatcttctccttcctgttgatttccgcatccgtaattatctcgcgcggtcagatagtgttgacgcaatctcccgccataatgagcgcttcacctggagagaaggtgaccatgacctgtagcgccagctcctccgttacatcaatgcactggtttcaacaaaaatccggaacgagccccaaaaggtggatctacgacacttccaagctggcgagcggcgtgcctgctcggttcagcggctcaggatctggtacctcctatagcttaaccattagcattatggaagccgaggatgcggctacatactactgccagcagtggaactacaacccaccaatgggcaccttcggtggaggaactaaactagagatcaaacgggccgacgcagccccaacagtgtcgattttccccccttcctcagagcagttgacgtctgggggcgcgtcagtggtgtgttttctgaacaacttttatcctaaggacatcaatgtgaagtggaaaatagacgggagtgaacgacagaatggcgtcttaaactcttggaccgaccaagactctaaggatagtacctactcaatgtcctcaacgttgaccctgaccaaagatgagtatgagcggcataactcttatacctgtgaggctacacataaaaccagcacttcccctatcgtgaaatcttttaatagaaatgagtgt

SEQ ID NO: 15165 - DNA, 711 bp, Artificial Sequence
  Description of Artificial Sequence: Synthetic coding sequence
atggacttccaagtccagatcttctcttttctgctcatctccgcgtccgtgatcattagccgcggccaaatcgtcctgacccagtcacctgccatcatgtccgcgtcgcctggagagaaagtgacgatgacctgcagcgcatcatcgtccgtgaccagtatgcattggtttcagcagaaaagcggaacctcgccgaaacgctggatttacgacacttcaaaactggcgtccggagtgccggcgcgcttctccggatcgggatcaggcacctcttacagcttgaccatttcgattatggaagcagaagacgccgctacctactactgccaacaatggaattacaatcctcctatgggtactttcggaggcggcaccaagctcgaaatcaagagagccgacgccgctccgaccgtgtcgattttcccaccgtcgagcgagcagttgacctcaggcggagcttcggtcgtttgcttcctgaacaacttctaccctaaggatattaacgtgaagtggaagatcgacgggtcagagcgccaaaacggcgtgttgaacagctggaccgatcaggacagcaaggattccacgtactcgatgtcgagcactctgaccctgacgaaggacgaatacgagcggcataattcctacacgtgcgaagcaacgcacaagaccagcactagcccgatcgtgaaatcctttaatcggaacgagtgt

SEQ ID NO: 15166 - DNA, 711 bp, Artificial Sequence
  Description of Artificial Sequence: Synthetic coding sequence
atggatttccaagtccaaatattctcttttctcttaatcagcgctagcgttatcattagtagaggacagattgtcctcacccaatcgccggccatcatgtctgcatcccctggggaaaaagtcacaatgacatgcagtgcaagcagctccgtgacatcaatgcattggtttcagcaaaagtccggtacatcacctaaaaggtggatttacgatacgagcaagctagccagtggcgtaccggcgcgtttcagcggatcaggcagcggcacatcatatagtctgacgatcagtatcatggaagctgaagatgcggcaacatattattgtcaacagtggaattataacccgccgatggggacttttggggggggcactaagttggaaataaaaagggccgatgctgctcctactgtcagcatttttccaccgagctcagaacagttgacgagtggaggtgcgagtgtagtctgttttctaaataacttttatccgaaagatatcaatgtgaagtggaaaattgacggttcagaaaggcagaatggagtcttgaattcctggacggaccaggattctaaagactctacatacagtatgtcgtcaacactgacactgacgaaagatgaatatgaacggcacaacagctatacatgcgaagcgactcacaaaacttcaacttctccgattgtaaagagctttaaccgtaatgaatgt

SEQ ID NO: 15167 - DNA, 711 bp, Artificial Sequence
  Description of Artificial Sequence: Synthetic coding sequence
atggacttccaggttcaaatcttcagttttctgcttatatctgccagtgtaatcatctctagaggccagatcgttctgacacagagcccggcgattatgagcgcatcccctggtgagaaggtaacgatgacctgctcggcttcaagcagcgtgacctcaatgcactggtttcagcagaagtccgggacctctcccaaacgatggatctacgatacctcaaaattggcaagtggagttcctgcgcggttctccggtagcggttccggaactagctactcccttacaatctccatcatggaggccgaagacgccgccacctattactgccagcaatggaattacaaccctccaatggggaccttcggaggaggtacaaaactcgagattaaaagagcagacgcggctcccacggtgagtatcttccctccctcgagcgaacagctgacttcaggcggcgccagcgttgtatgcttcctgaacaacttttatccaaaggatatcaacgtgaagtggaagatcgatggaagtgaacgacagaatggggtgcttaactcctggaccgatcaggatagcaaggacagtacatacagtatgagcagcaccctgacgctgaccaaagatgaatacgagcgccataattcctatacatgtgaagctacccataagacttcaactagccccatcgttaaatcttttaacagaaatgagtgc

SEQ ID NO: 15168 - DNA, 711 bp, Artificial Sequence
  Description of Artificial Sequence: Synthetic coding sequence
atggatttccaggtgcagatcttctctttcctgctgatttccgcttccgtgatcatcagccgcggccagattgtgctgacccagtcgccggcgataatgtctgcttcccccggcgaaaaagttacaatgacatgcagcgccagtagttccgttacatctatgcactggtttcagcagaagtccggcacctcgccaaagcggtggatctacgacacgtctaaactagcatctggcgtgcctgcccgatttagcggatctgggtccggcacttcttactcgctgacaatatccattatggaagccgaggacgcagctacctattactgccaacaatggaactataatccccccatggggacattcgggggtggaaccaagctagagataaagcgggccgacgccgcacccacagtaagcatctttcccccctctagtgagcagctaacgtcggggggcgcatctgttgtctgctttttaaataatttctatccaaaagatatcaacgtgaagtggaagatagatgggtctgaacgccagaacggcgtgttgaattcttggacagaccaggattccaaggacagcacatacagcatgagcagtactctaactctcactaaagacgagtacgaacggcacaacagttacacatgcgaagctacacataagaccagtactagccctatagtcaagtccttcaaccgcaacgagtgt

SEQ ID NO: 15169 - DNA, 711 bp, Artificial Sequence
  Description of Artificial Sequence: Synthetic coding sequence
atggattttcaggtgcaaatctttagtttcctgctgatctcggcatctgtcatcatttctcgaggtcaaattgttctcactcagtccccagcaattatgtcagcctcgccgggagaaaaagtgaccatgacctgctcggcctcgtcatccgtcacgtcaatgcactggtttcaacaaaaatctggtacttcgccaaagagatggatttacgatacctcaaagctggcctcaggagtcccggcaaggtttagcggcagcggtagcgggacctcgtactcgctgacgatttcgatcatggaggcagaggatgccgcgacctattactgtcaacagtggaactacaaccctccaatgggtactttcggaggagggaccaagctcgaaatcaagcgcgcggatgctgcgccgacggtttcgattttccctccatcgtccgagcagttgacctccggaggcgcgtcggtggtgtgttttctcaataacttttaccccaaggatatcaacgtgaaatggaaaatcgacgggtctgagcgccaaaatggtgtgcttaattcatggactgaccaggatagcaaggattccacgtacagcatgagctccaccctgacgctgacgaaggacgaatatgagcgtcacaactcctacacctgcgaggctactcataagacctcaacttcccccattgtcaagagcttcaacagaaatgaatgt

SEQ ID NO: 15170 - DNA, 711 bp, Artificial Sequence
  Description of Artificial Sequence: Synthetic coding sequence
atggattttcaggtgcagatcttctccttcttgctcatctcagcttcagtcatcattagcagaggccaaattgtgctgactcaatctcctgcgattatgtcagcatcccccggtgaaaaggttaccatgacctgctcagcctcatcatccgtaacttccatgcactggtttcaacagaagtcagggacctcaccaaaacgctggatctacgatacaagcaaacttgcttcgggggtaccagcacggtttagcggcagcggtagcggcacatcatactcattaacaatttctatcatggaagcagaggacgctgccacgtattactgtcagcagtggaactataatcctccgatggggacattcggaggcggaaccaagctcgaaattaagcgggccgatgccgctccgacagtcagcatctttccaccctcctccgagcagcttacgtcaggcggcgccagtgttgtttgtttccttaataatttctaccctaaagacataaatgtgaaatggaaaattgacggttctgaacgccagaatggagtgctgaacagctggaccgaccaggacagcaaggacagcacttactccatgtcatctaccctaaccctgactaaagacgaatacgagcgacacaatagttacacctgcgaagctacacacaagacctctacatcacccatagttaagagtttcaaccggaatgagtgt

SEQ ID NO: 15171 - DNA, 711 bp, Artificial Sequence
  Description of Artificial Sequence: Synthetic coding sequence
atggatttccaggtgcagatcttctcgttcctcctgatctccgcgtcggtgattatctcaagaggccaaatcgtgctcactcagtccccggcgatcatgtcggccagccctggagaaaaggtcaccatgacttgctccgcctcctcaagcgtgacttctatgcattggttccagcaaaagagcgggacgtcaccgaagcggtggatctacgacactagcaaactggctagcggagtcccggcacggttctccggaagcggttctggaacctcctattccctgaccatctccatcatggaagcggaggacgcggcgacttactactgccagcagtggaactacaatccgccgatgggcacctttggaggcggaactaagctggagatcaagcgcgccgatgccgccccaaccgtctcgatcttcccaccatcatcggaacagttgacttcaggaggtgccagcgtggtgtgtttcctcaacaatttctacccgaaagatatcaacgtcaagtggaagatcgatggctccgaaagacagaacggggtcctgaattcgtggaccgatcaagactctaaggacagcacttactctatgtcctccactctcactcttaccaaggacgagtatgagcggcataattcatacacctgcgaggcgactcataagacctcaacttcgccgatcgtcaagtcgttcaatcgcaacgagtgc

SEQ ID NO: 15172 - DNA, 711 bp, Artificial Sequence
  Description of Artificial Sequence: Synthetic coding sequence
atggacttccaagtccagatcttctcgttcctcctgattagcgctagcgtgatcatctcacgaggacagatcgtcctgactcagtctcccgccattatgtccgcgagccctggcgaaaaagtcactatgacctgctccgccagcagctcggtgacttccatgcactggtttcaacaaaagtcaggaacttcacccaagcgctggatctacgatacttccaagctcgcctcaggcgtgccggcgcgattctcgggatcagggtccggaacgtcgtactcgctgaccatctcgatcatggaagctgaggacgccgcgacctactactgccagcaatggaactacaacccacctatgggcaccttcggagggggaaccaaactcgaaatcaagcgcgccgacgccgctccgaccgtgagcatcttcccaccatcgtccgagcagctgacttctggtggggcgagcgtggtctgcttccttaacaacttttacccgaaggacattaacgtgaagtggaagatcgacggatcggaacgccagaacggggtcctcaatagctggaccgatcaggattcgaaagactcgacctacagcatgtcgtcgactctgaccttgacgaaggatgagtatgaacggcacaattcctacacttgcgaagcgacccataagacctcgacttcaccgatcgtgaaatccttcaaccgcaacgagtgt

SEQ ID NO: 15173 - DNA, 711 bp, Artificial Sequence
  Description of Artificial Sequence: Synthetic coding sequence
atggattttcaggtgcaaatattctcattcctccttatcagcgccagcgtgatcatcagcaggggccagatagtcctgacacagagcccggcaatcatgtctgcatcccctggcgaaaaggtgaccatgacctgtagtgcttcctcctccgttacctctatgcactggtttcaacagaaatccggaacatccccaaagagatggatttacgacacgagtaagctggctagcggggtgcccgccaggttcagtggctctggctccgggacaagttacagcctcactatttcaatcatggaggccgaggatgcagccacctactactgccagcagtggaattacaaccctcccatgggtacattcggaggtggtaccaaactggagatcaaacgggcagatgcggctccaaccgtgtctatctttccaccttcgtctgagcagttaacctccggcggagcatcagtggtgtgtttcctaaataacttctaccctaaagatatcaacgtaaaatggaaaatagatggatcggaaaggcagaacggtgtgctgaactcctggaccgatcaggattccaaagactcaacctatagcatgagtagcacccttaccctgacaaaagacgagtatgagcgccacaacagctacacttgcgaggcaactcacaagacaagcacctctcccatcgtgaaatcattcaaccggaacgagtgt

SEQ ID NO: 15174 - DNA, 711 bp, Artificial Sequence
  Description of Artificial Sequence: Synthetic coding sequence
atggacttccaagttcagatattcagtttcttgctcatttctgctagtgtgatcattagtaggggtcagatcgtgctcactcaatctcccgctattatgtccgcttccccaggagagaaagttactatgacctgttctgcttcctcctcagtcacttccatgcactggttccagcagaaaagtggtacttcccccaaacgttggatttacgacacctcaaaactggcctccggagtgcccgccagattcagcggttccggaagcggcacttcttactccctgaccatttcaatcatggaggcagaggacgctgcaacctactattgtcagcagtggaattacaatcctcccatgggtactttcggaggtggaaccaagttggagatcaagcgcgccgatgctgctcccactgtgagcatctttcctcccagctccgaacaattgactagtggtggtgcatccgtagtgtgcttcttgaacaatttctacccaaaggatataaacgtcaaatggaagattgatggttccgaaagacagaatggcgtactgaactcttggacagaccaagactcaaaagacagcacctacagcatgtcatctaccctgacccttaccaaggacgaatacgagagacacaactcctacacctgcgaggccactcataagacctccacttctccaatagttaagagctttaatagaaacgagtgc

SEQ ID NO: 15175 - DNA, 711 bp, Artificial Sequence
  Description of Artificial Sequence: Synthetic coding sequence
atggatttccaggtgcaaatcttcagcttcctgctgatatccgcatcagtgatcatttcgcgaggccagatcgtactgacccaaagtcccgcaataatgtcagcgagtccaggcgaaaaagtgacgatgacgtgttcggcgtcctccagcgtaacctccatgcactggtttcagcagaaatccggcacctccccaaagcggtggatctacgacaccagcaagctggcctccggcgttccggcccgattctcgggctctggctccggtaccagctacagcttgactatctccataatggaggcagaggatgccgccacgtactactgtcagcagtggaactataatccgccgatgggcacctttggaggaggtacgaagctcgaaatcaagcgtgcagatgccgctccgacggtttccatcttccccccatcctccgaacaactcacgagtggtggcgcctccgtcgtgtgctttctcaacaacttctatccgaaggacattaatgttaagtggaagatcgatggttccgagcgtcagaatggagtgctgaactcttggacggatcaagactcaaaggatagcacctacagtatgtcctccactcttacgttgacgaaggatgagtacgagaggcacaactcttacacctgtgaagccactcacaagacgtcgacctcgcctattgtcaagtctttcaataggaatgaatgc

SEQ ID NO: 15176 - DNA, 711 bp, Artificial Sequence
  Description of Artificial Sequence: Synthetic coding sequence
atggattttcaggtccagattttttcttttctgctgatttcggcaagcgtcatcattagccgtgggcagatcgtgctgacgcagagcccagcgattatgtcagccagccctggggagaaggtgaccatgacatgctcagcatcgtcgtccgtcacctcaatgcattggttccagcagaaatccggtacgtctccaaaacggtggatttacgacacttcaaagctagcaagtggtgtacccgcacgattctccggttccggatccggcacctcttacagcctcaccattagcatcatggaagccgaagatgcggctacatactattgtcagcagtggaactataatccccccatgggcacattcggcggcggtaccaaattagagataaaaagagcagacgccgctccaaccgtctctatctttcctccatccagcgagcaactgacaagcggcggggcctctgtggtctgcttcctgaataacttttatccaaaggatattaacgtcaaatggaagatcgatggcagtgaaaggcagaacggagttctgaattcctggactgaccaggactctaaagattctacctacagtatgtcctctactctgaccctgacaaaggatgagtacgaaaggcacaatagttacacctgcgaggccactcacaaaactagtacctcccccatcgtaaaaagctttaatcggaatgagtgc

SEQ ID NO: 15177 - DNA, 711 bp, Artificial Sequence
  Description of Artificial Sequence: Synthetic coding sequence
atggactttcaagtgcagatcttctcctttcttctcatctcagcatccgtgattatcagccggggacagattgtgcttactcagtcaccagcgattatgagcgcatcccctggagagaaagtgactatgacctgctcagcgagttcgtcagtcacctctatgcattggtttcagcaaaaaagcggtaccagccctaagcggtggatttacgataccagcaagctggcaagcggagttcccgcaagattctcgggatccggatcgggaacttcctactcccttactatttcgatcatggaagcggaagatgccgccacttattactgtcagcaatggaactacaatccacccatgggcactttcggagggggtactaaactcgaaatcaaaagagcagatgccgcacctaccgtctcaatcttcccaccttcatcagagcagttgacttcaggtggggcctcagtggtgtgctttctcaataacttctaccccaaggacatcaacgtgaagtggaaaattgatggatcggaacgacaaaacggggtcctgaactcgtggactgaccaggacagcaaggattccacctactcgatgtcgtcgactcttactctgaccaaggatgagtatgagcgccataacagctacacgtgtgaggcaacccataagacttccacgagcccaatcgtgaagtcattcaatagaaacgagtgc

SEQ ID NO: 15178 - DNA, 711 bp, Artificial Sequence
  Description of Artificial Sequence: Synthetic coding sequence
atggactttcaggttcaaatattctcattcctgctgattagtgcttctgtgataatctcacgaggccagatcgtgctgacacagtcccctgcgattatgtcagccagcccaggggagaaggtgacaatgacctgtagcgcgagctccagcgtgacctccatgcattggttccaacaaaagagcggaacgagtcccaagcgctggatctacgatacctccaaattagctagcggggtcccagccaggtttagcggtagcgggagcggcacctcatacagtctcaccatctctatcatggaggcggaggatgctgcaacatactactgtcagcagtggaactacaaccctcccatgggtacattcggcggcggaacgaagctcgagatcaaacgggccgatgccgcgcctaccgtgagcattttcccaccaagctcagagcaactaacctctggcggcgcatcggtagtgtgtttccttaacaatttctatccgaaggatattaatgtgaaatggaaaatagatggttctgagcgtcaaaatggagtcttgaacagctggactgatcaggactcaaaggattctacttattccatgtcttctacgctcactctaacgaaagatgaatatgagaggcacaatagctacacctgcgaagccacccacaagactagtacaagccccatcgtcaaatcctttaataggaatgagtgt

SEQ ID NO: 15179 - DNA, 711 bp, Artificial Sequence
  Description of Artificial Sequence: Synthetic coding sequence
atggactttcaagtgcagatatttagcttcttgctgataagcgccagcgtgattattagcagaggccagatcgtgcttacacagtctcctgccattatgtctgcatcccccggggagaaagtgaccatgacctgttctgcaagctccagcgtgacgtccatgcattggttccagcaaaaatctggcacttcccctaagaggtggatctatgacacctcaaagctggctagtggggtcccggctcggttctccggtagcggctccgggacctcttactccctcaccatcagcatcatggaagccgaggacgccgctacctattattgtcagcagtggaattacaatccccccatggggacgttcggcgggggaacaaagttggaaatcaagcgcgccgacgcagcaccaactgtgagcatttttccaccttcttccgaacagctgacctcaggtggtgcatccgtggtgtgctttctcaacaacttctatccaaaagatattaatgtgaagtggaagatagatggatctgagagacaaaacggggtgcttaacagctggaccgaccaggactccaaagacagcacctatagcatgtcatccaccttgaccctgaccaaagatgagtacgagcggcacaacagttatacctgcgaagcgacacacaaaacaagcacaagcccaatcgtgaaaagcttcaatcggaacgaatgc

SEQ ID NO: 15180 - DNA, 711 bp, Artificial Sequence
  Description of Artificial Sequence: Synthetic coding sequence
atggacttccaggtgcaaatcttttcattcctcttaatttccgctagcgtgatcatttctagaggccagattgttttgacgcagtcaccggcgatcatgtctgcctctcctggggaaaaagttaccatgacatgttctgccagttcctccgtgacttccatgcactggtttcagcaaaaatctgggacgtcacctaaacggtggatctacgatacgtctaaactcgccagcggggtgcctgcaagattttcgggctctggtagtggaacaagctatagcctcacgatatcgataatggaagccgaagacgccgccacctattactgccagcagtggaactataacccacctatgggaaccttcggaggcggaaccaagctggaaataaaacgggctgatgccgcgcctacagtttcaattttccccccatcctctgagcaactcacctctgggggcgcctctgtagtttgctttttaaataatttttatcctaaagacatcaacgtcaaatggaagatcgacgggtcagagcgtcaaaacggtgtgttgaatagctggaccgaccaggactccaaggacagtacttacagcatgagcagtactcttaccttaacgaaggacgaatacgagaggcataactcatacacctgtgaagccacccataagacttctactagtcctattgtgaaaagcttcaaccgaaacgaatgt

SEQ ID NO: 15181 - DNA, 711 bp, Artificial Sequence
  Description of Artificial Sequence: Synthetic coding sequence
atggattttcaagtccagatcttctcctttcttctgatttcagcatccgtaatcatctcaagaggccaaattgtgctgacccagagccccgcaatcatgagcgcgtcgcctggtgaaaaggtgacgatgacctgctccgcaagctcatcagtgacttccatgcactggtttcaacaaaagtccggaacttcccctaagcgatggatttatgatacctccaagctggcttcgggagtgcctgctcgtttctcgggatcaggatcaggtacctcgtactcactcactatttcgatcatggaagccgaggacgcagcgacgtactactgccaacagtggaactataacccacctatgggcacctttggaggaggaactaagctcgaaatcaaacgggcagatgccgcacccactgtgtccattttccctccatcaagcgaacaacttacctcgggaggagcctccgtggtttgtttcctgaataacttttacccgaaggacattaacgtgaagtggaagattgatggaagcgagagacagaacggagtgcttaactcatggactgatcaagactcgaaagactcaacttactcgatgtcgagcaccctcaccctgaccaaggacgaatacgagaggcataattcctacacctgtgaggctactcacaaaacttccacttccccaattgtcaagtcgttcaataggaacgagtgt

SEQ ID NO: 15182 - DNA, 711 bp, Artificial Sequence
  Description of Artificial Sequence: Synthetic coding sequence
atggattttcaggtccagatattcagtttcttgctcatttccgccagcgtgatcatctcgcgcggccagatcgtcctgacacagagtcccgccatcatgtccgcttctccaggggagaaggtgaccatgacatgtagtgcaagttctagcgtgaccagcatgcattggtttcagcagaaatccggtacctctccaaagaggtggatctacgacaccagcaaactagccagcggagtccctgctcggttctcgggaagcggaagcggaaccagctatagcctaaccatctcgattatggaggccgaagatgccgccacatattactgccagcagtggaactataacccacctatgggaacctttgggggcggcaccaagctcgagatcaagcgcgccgatgcagcacctaccgtgagtatttttcccccttctagcgagcagctgactagtggaggtgcatctgtggtgtgttttctaaacaatttctaccctaaagatatcaacgtcaagtggaagattgacggctctgagcgtcagaatggagtcctcaacagctggaccgaccaggatagtaaagattctacgtattctatgtcctctacgctgactctgaccaaggacgagtacgagcgacataacagctacacttgcgaggcgacccacaagaccagtactagcccaatcgtgaaatccttcaaccgaaacgaatgc

SEQ ID NO: 15183 - DNA, 711 bp, Artificial Sequence; identical to SEQ ID NO: 15155
  Description of Artificial Sequence: Synthetic coding sequence

SEQ ID NO: 15184 - DNA, 711 bp, Artificial Sequence
  Description of Artificial Sequence: Synthetic coding sequence
atggatttccaggtacagatcttcagtttccttttgatctcggcatctgtcattatatctagaggtcagattgtcctcactcagagcccagcaattatgtccgcatccccaggtgagaaagttacgatgacatgttccgcatcatcctctgtgacatctatgcactggtttcagcagaaatcaggcaccagcccaaagcggtggatctatgatactagtaagctcgccagcggggtccccgccagattctctggctccgggagtgggacatcctactctctcaccatcagtatcatggaggctgaagatgctgcaacctactattgccagcagtggaattacaatccccccatgggcacgttcggagggggaacaaagttagagatcaagcgagcagacgcggcccccacggtgagtatctttccaccaagttccgaacagttgacctctggtggtgcatccgtcgtgtgctttctaaacaacttttacccgaaagatataaacgttaagtggaagatcgatgggtcagaaagacagaacggcgtgctaaattcatggactgaccaagacagtaaagattctacatactccatgagcagcaccctcaccctgactaaagacgagtacgaacggcataatagttacacctgtgaagccacccataagacttctaccagtccgatcgtgaagtccttcaaccgcaacgaatgt

SEQ ID NO: 15185 - DNA, 711 bp, Artificial Sequence
  Description of Artificial Sequence: Synthetic coding sequence
atggactttcaggtgcagatcttttctttcctgctcatctcggcttctgtgatcatctccagggggcagatcgtgttgacccagtccccagccatcatgtcagcttcgcccggtgaaaaggtgaccatgacttgttccgctagctcatcggtgacttccatgcattggttccagcagaagtccggaacgtccccgaagcggtggatctacgacactagcaagctcgcatcgggcgtcccggcgcgcttttccggatccgggagcggcacgtcttactccctgactatctcaattatggaggcggaggacgccgcaacctactactgccaacagtggaattacaacccacctatgggtaccttcggaggaggcaccaagctggaaatcaagcgggccgatgcggccccgaccgtgagcatcttcccaccctcctcagaacagctgacttccggaggagcgagcgtggtgtgtttcctgaacaatttctacccgaaagatatcaacgtcaagtggaaaatcgacgggtctgaacggcagaatggggtcctgaattcgtggaccgatcaggactccaaggactcaacctactctatgagctccaccctgactctgacgaaggatgagtacgaaagacacaactcctacacctgcgaggcaacccataaaacttcgacttcgccgatcgtcaaatcctttaatcggaatgagtgc

SEQ ID NO: 15186 - DNA, 711 bp, Artificial Sequence
  Description of Artificial Sequence: Synthetic coding sequence
atggactttcaggtgcagatcttctctttcctcttgatctcggcctccgtgatcatctcacgcggtcagatcgtgcttactcaatccccagctatcatgtctgcctccccgggtgaaaaagtcaccatgacttgctcagcgagctcgtctgtgacctcaatgcactggttccaacagaagtcaggcacctcaccgaagagatggatctacgacacttcgaagctggcatcaggagtcccggcacggttcagcgggtctggatcgggaacgtcgtattcgcttaccatctcgattatggaagccgaggatgctgcaacttactactgtcaacaatggaactacaatccgcctatgggcaccttcggcggcggaactaagctggaaatcaagcgtgcggatgccgcccctaccgtgagcatctttcccccctcttcagaacagctcaccagcgggggagcctcggttgtgtgcttcctcaacaacttttacccaaaggatatcaatgtaaagtggaagattgatggatctgaacggcagaatggagtcctgaatagctggaccgaccaggattccaaggactcaacttactcgatgtcgtctaccctgaccctgacgaaagacgagtacgagagacataacagctacacttgcgaagctacccacaaaactagcacttcaccaatcgtcaaatccttcaaccggaacgagtgt

SEQ ID NO: 15187 - DNA, 711 bp, Artificial Sequence
  Description of Artificial Sequence: Synthetic coding sequence
atggattttcaagtccagattttctcgttccttctcatttcagcatcggtgattatcagcagaggacaaatagtgctgactcaaagtcctgccatcatgtcggcttcgcctggcgaaaaggtcaccatgacctgttctgccagctcgtcagtcacctccatgcactggtttcagcagaagtccggtacctcgccaaaaaggtggatttacgacaccagcaaactggcctcgggagttccagcacggttctcagggagcggctcaggcacttcatatagcctgaccatctctataatggaggccgaggacgcagccacctactactgccaacaatggaactacaacccacccatgggtaccttcggtgggggtaccaagttggaaatcaagagggcagatgccgcacctaccgtgtcaatctttcccccttcgtcagaacaactcacttccggaggagccagcgtcgtgtgttttctgaacaatttctaccctaaggacatcaatgtgaagtggaaaattgatggttcggaacggcaaaatggcgtgcttaactcttggacggaccaggattcgaaggattcaacttattccatgtcgtcaaccttgaccctcacgaaagatgaatacgaaagacacaacagctacacctgtgaagcaactcataagacctcgacttcgcctattgtcaagtcattcaacagaaacgagtgc

SEQ ID NO: 15188 - DNA, 711 bp, Artificial Sequence
  Description of Artificial Sequence: Synthetic coding sequence
atggattttcaagttcaaatcttcagctttcttctgatcagcgcatccgtgatcatatccagaggtcaaattgtgcttacccaatcccccgcgatcatgtcggcctcgccaggtgaaaaagtgacgatgacctgttcagcctccagctcggtcacctcgatgcattggtttcaacaaaagtcgggcacctcccctaaaagatggatttacgatactagcaagctggcatccggagtcccagcaaggttctccggatccgggtctggaacctcatactcgctcacgatcagcatcatggaagcggaggatgcagctacctactactgccagcaatggaactacaatccaccgatgggtacttttggtggaggcacgaaacttgagattaagcgtgcagacgcagctcctaccgtttccatcttccccccttcaagtgagcaacttactagcggtggcgcatccgtggtgtgtttcctgaacaacttttatccgaaagacattaacgtgaaatggaaaatcgacgggtcggagcgccagaatggagtgctgaactcgtggaccgatcaggattccaaggacagcacctactcgatgtcgtccactcttacgctgaccaaggatgagtacgaaagacataattcgtacacctgtgaggcaacccataaaacctcaacctcgcctatcgtgaagtccttcaatcgcaacgagtgt

SEQ ID NO: 15189 - DNA, 711 bp, Artificial Sequence
  Description of Artificial Sequence: Synthetic coding sequence
atggacttccaagtgcagattttctcatttctccttatatcggcgtcggtcatcatctcacggggacagattgtgcttactcaaagccctgcgattatgagcgcatcccctggtgagaaggtgaccatgacgtgttcggcatccagctccgtcacttcaatgcactggttccagcaaaagtcggggacctcaccgaagaggtggatatatgatacgagcaagctggcatcaggagtgccggcaagattttctggctccggatctggaacctcttactccctgacgattagcattatggaagccgaagatgccgctacctactactgccaacaatggaactacaacccccctatgggaaccttcggaggaggcactaaacttgagatcaagagagcagacgccgcccctactgtctcgatttttcccccttcctctgaacagctgacctcgggaggagcatcggtcgtgtgttttctgaacaacttttacccaaaggacataaacgtcaaatggaaaatcgatgggtccgagcggcaaaatggcgtgcttaatagctggaccgatcaggactccaaagattcaacctactcaatgtcgtcgacccttaccctgaccaaagacgaatacgaacgccataattcctatacgtgcgaggcaactcataagactagcacctcacctattgtgaaatccttcaacagaaacgaatgt

SEQ ID NO: 15190 - DNA, 711 bp, Artificial Sequence
  Description of Artificial Sequence: Synthetic coding sequence
atggatttccaggtgcagattttctcctttctgcttataagcgcatcagtcattatcagccgcggtcagattgtgctgacccagagtccagcaattatgtctgcctccccgggagagaaggtgacgatgacgtgttctgccagttctagcgtgacttctatgcattggtttcaacagaaatcgggaaccagcccaaagcgatggatttatgacacgagtaagcttgcctctggggtccctgcaagattttccgggagcggatccggtacttcatatagtttgactatttctataatggaggccgaggacgccgctacctactattgccagcagtggaactacaaccccccgatgggtacattcggcggaggcactaaacttgagataaagagagcagatgcagcccccacagtgagcatctttcccccctcctccgagcagctaacctccgggggcgcctctgtggtgtgtttcctgaataatttttaccccaaggatatcaacgtgaagtggaaaatcgatggctccgaacgccagaatggagtgctgaacagttggactgaccaggattcaaaggactcaacctattcaatgagcagcacgctgactcttacaaaggatgaatacgagcggcacaattcttatacctgtgaggctacgcacaagacctccactagtcctatcgtgaagtcctttaaccgcaacgagtgt

SEQ ID NO: 15191 - DNA, 711 bp, Artificial Sequence
  Description of Artificial Sequence: Synthetic coding sequence
atggacttccaggtgcagatcttttcttttttgctgatcagcgccagtgtgatcattagccgcggccaaatcgtgctgacccaaagcccagcaatcatgagcgcgtcacccggagaaaaggtgactatgacgtgctcggcatcatcgtcagtgacttccatgcactggtttcagcagaaaagcggaacctcgccaaagcgctggatttacgacacctcaaagctggcctcgggagtgcctgcccgcttcagcggctccgggtccggcacttcctactctttgactatctccatcatggaagcagaggacgccgcaacctactattgccagcagtggaactacaaccctccaatgggcaccttcggcggcggaactaagctcgaaatcaagcgagcggacgccgccccgactgtgagcatcttcccgccgtcgtccgaacaattgactagcggtggagcaagcgtcgtgtgcttcctgaacaatttctacccgaaagatatcaacgtcaagtggaagattgatgggtcagaaaggcaaaacggagttcttaattcgtggacggatcaggatagcaaagactccacttactcaatgagctcgaccctgactctcacgaaagacgaatacgaacgccacaatagctacacctgcgaggctacccacaaaacctccactagcccaatcgttaagtcgttcaaccggaacgagtgc

SEQ ID NO: 15192 - DNA, 711 bp, Artificial Sequence
  Description of Artificial Sequence: Synthetic coding sequence
atggatttccaagttcaaatcttttcgttcttgctgatctccgcctccgtgatcattagccggggccagatcgtgctgacccagagcccagcaatcatgtcggcatcaccgggagagaaagtgaccatgacctgctcggcatcatcctcagtgacctcaatgcactggttccagcaaaaatctggtacctcgcccaaacgctggatctacgacaccagcaaactggcgtccggagtgccggcacggttctcgggcagcggctcgggcacctcctactcactgacgatctcaatcatggaagctgaggatgccgcaacttactactgccagcagtggaactacaacccaccgatgggaactttcggtggcggaactaagctggagattaagcgagctgatgccgcaccgaccgtgtcgatcttccccccgtcctccgaacagctcacttcaggaggggcctcagtggtctgtttcctgaacaacttttaccccaaggacattaatgtgaaatggaagatagacggatcggagaggcaaaatggggtgctgaattcgtggactgaccaggactcaaaggattcgacttactcgatgtcctcgaccctcactctgaccaaggacgagtatgaaagacacaattcctacacctgcgaagctacgcataaaacctccacctcgcctatcgtgaaatccttcaaccggaacgagtgc

SEQ ID NO: 15193 - DNA, 711 bp, Artificial Sequence
  Description of Artificial Sequence: Synthetic coding sequence
atggattttcaagtacaaatattttcgtttctattaatatcggcgtcggtaataatatcgcgtggtcaaatagttttaacgcaatcgccggcgataatgtcggcgtcgccgggtgaaaaagtaacgatgacgtgttcggcgtcgtcgtcggtaacgtcgatgcattggtttcaacaaaaatcgggtacgtcgccgaaacgttggatatatgatacgtcgaaattagcgtcgggtgtaccggcgcgattttcgggttcgggttcgggtacgtcgtattcgttaacgatatcgataatggaagcggaagatgcggcgacgtattattgtcaacaatggaattataatccgccgatgggtacgtttggtggtggtacgaaattagaaataaaacgtgcggatgcggcgccgacggtttcgatatttccgccgtcgtcggaacaactaacgtcgggtggtgcgtcggtagtatgttttctaaataatttttatccgaaagatataaatgtaaaatggaaaatagatggttcggaacgacaaaatggtgtactaaattcgtggacggatcaagattcgaaagattcgacgtattcgatgtcgtcgacgttaacgctaacgaaagatgaatatgaacgtcataattcgtatacgtgtgaagcgacgcataaaacgtcgacgtcgccgatagtaaaatcgtttaatcgaaatgaatgt

SEQ ID NO: 15194 - DNA, 711 bp, Artificial Sequence
  Description of Artificial Sequence: Synthetic coding sequence
atggattttcaagtccagattttctcgttcctgctcatttcagcgtcagtcatcattagccggggacaaatagtgctgacccagtcgcccgcgatcatgtctgcaagcccgggggaaaaagtgactatgacctgtagcgcctcgtcctcagtcacttcgatgcactggtttcagcaaaagtccggcacttcacctaagcgatggatatatgacacttcgaaattggcatcgggtgtgcctgcccgtttcagcggttcaggatcgggcacttcctactccctgaccatctccatcatggaagctgaagatgctgccacctactactgccagcagtggaactacaacccgccaatgggaacgttcggagggggaaccaagttggaaatcaagagagcggacgcggcacctactgtgagcatttttccccctagctccgagcaactgacgtcaggaggggcaagcgtggtctgttttcttaacaacttttaccctaaagacatcaacgttaagtggaagattgatgggtcggagagacaaaatggagtgctgaacagctggacggaccaagattctaaagattcaacctactcgatgtcctctactcttacccttaccaaggatgaatacgagcgccataattcttacacgtgtgaagctactcataaaacgtccacttcacctatagtcaagagctttaatcgtaacgagtgc

SEQ ID NO: 15195 - DNA, 711 bp, Artificial Sequence
  Description of Artificial Sequence: Synthetic coding sequence
atggacttccaggtgcagatcttctcgtttctgctgatctccgcctccgttatcatttcccggggtcaaattgtccttacgcagtcacctgcaatcatgtctgcctcaccaggcgagaaagtgaccatgacttgctcagcgtcctcgagcgtcacttcaatgcactggttccagcagaagtcaggcacctctccgaagcggtggatctacgatacctcgaaactggccagcggagtgccagccagattctcgggatcgggtagcgggacctcctactccctgactatctccatcatggaggccgaagatgcagccacctactactgccaacagtggaattacaatccgccaatggggactttcggtggtggaactaaactcgagatcaaaagagccgatgcagcacccactgtgtcgatcttccctccgagcagcgaacagctcaccagcggcggagcttcggtggtgtgcttcctgaataacttctatccgaaagacatcaacgtgaagtggaaaatcgatgggtccgagaggcaaaacggtgtgttgaactcgtggacggaccaggacagcaaggattcgacgtactcgatgtcaagcaccctcactctgaccaaggatgaatacgagagacataactcctacacttgtgaggccacccacaagaccagcaccagcccgatcgtgaagagctttaaccggaatgagtgc

SEQ ID NO: 15196 - DNA, 711 bp, Artificial Sequence
  Description of Artificial Sequence: Synthetic coding sequence
atggatttccaagttcagatattctcctttcttctgatcagcgcctctgttattatcagccgcggtcagatcgttctcacacaaagcccggccatcatgagcgcctcaccaggcgaaaaggtgacaatgacctgttccgcctcaagtagcgtgaccagtatgcattggtttcaacagaagagcggtacgtcgccaaagcggtggatttacgatactagcaagttggcctccggggtgcccgcgcggttttctggaagcggatcaggtacaagctattcattgactatttctattatggaggccgaggatgcggctacctattattgtcagcagtggaactataacccgcccatgggcacatttggaggcggtaccaagctggagatcaagcgcgccgacgccgcgcctactgtcagtatcttccccccaagttccgaacagttaacctctggcggggcaagtgtggtgtgctttttgaataatttctacccgaaagacatcaacgttaaatggaagattgatgggagcgagagacagaacggcgtactaaattcctggaccgatcaggatagtaaggactccacctatagcatgagctctaccctgacactgactaaggacgagtatgagcgtcataattcttatacttgtgaagccacccacaagacctctacatctccaattgttaagtcatttaaccggaacgaatgc

SEQ ID NO: 15197 - DNA, 711 bp, Artificial Sequence
  Description of Artificial Sequence: Synthetic coding sequence
atggatttccaagtgcaaatcttctcctttctcctcatttccgcgagcgtcataatctcgcgcggacagatcgtgcttacccaatcccctgcgatcatgtcggcatctcccggtgagaaagtgaccatgacttgctcggcctccagctcagtgaccagcatgcattggttccagcagaagtcaggcacttcaccaaagaggtggatttacgatacttcgaagctggcctcgggtgtcccagctcgcttctcgggctcgggcagcggaactagctacagcctgactatatcaataatggaagcagaggacgcagcaacctactattgtcagcagtggaactataaccccccaatggggacgtttggcggagggacgaagctggagatcaagagagcagatgcagctccaactgtcagcattttccccccttcgtcggagcagttgaccagcgggggagcctcagtggtgtgttttttgaataacttttaccccaaggacattaacgttaagtggaagattgacgggagtgagcggcaaaacggtgtgctgaattcatggaccgatcaagactcaaaggattccacctactccatgtcctcaactcttaccctcactaaggatgagtacgagaggcataacagctacacctgcgaagccacccacaaaacttcaacctcgcctatagttaagtcgtttaaccgaaatgagtgt

SEQ ID NO: 15198 - DNA, 711 bp, Artificial Sequence
  Description of Artificial Sequence: Synthetic coding sequence
atggattttcaggtacaaatcttctcttttctcctaatcagcgcaagtgtcattatcagccgaggccagattgtgctgacccagtctcctgctatcatgtccgcttcccctggtgaaaaggtaaccatgacatgttccgcgtcctcatccgttaccagcatgcattggttccagcaaaagtcagggacatcacctaaacgctggatttacgacacaagcaagttggcttcgggagtgcctgctcgattttctggctctggctccgggacctcttatagcctgactatttcaattatggaggcagaggacgcagctacctattactgtcaacagtggaattacaatcctcctatgggtacatttggtggcggaacaaaactagagatcaaacgggccgatgctgcacccaccgtcagtatattccctccctcttccgagcaactgacatctgggggcgccagtgtcgtttgttttctgaataatttctatcctaaggacatcaatgttaagtggaagatcgatggctctgaacggcagaacggcgtactcaatagttggactgaccaggacagtaaggactccacctacagcatgagctccacactgacactaacgaaggacgagtacgaacgacacaattcctacacttgtgaggccacacataaaacatccacgagtccaattgttaaaagttttaacaggaacgaatgc

SEQ ID NO: 15199 - DNA, 711 bp, Artificial Sequence
  Description of Artificial Sequence: Synthetic coding sequence
atggacttccaagtgcagatcttcagctttctgctcattagcgccagtgtgatcatttcgcggggccagatcgtgctcacccagtccccagcaatcatgagcgcaagcccgggagaaaaggtgactatgacttgcagcgcttcgtcgtcggttacgtccatgcattggttccagcaaaagtccggcacttcgcccaagcgatggatctacgacacgtccaaactggcgtcgggagtgcccgccaggttcagcggctcgggctctggtacctcctactcgctgaccatttcgatcatggaggccgaagatgcagccacttattactgccaacagtggaactacaacccgccaatgggtaccttcggaggtggaactaagctcgaaatcaagcgggcagacgccgcgcccactgtgtcgatctttccgccgtccagcgagcagctgacttccggaggggcctccgtggtgtgctttctcaacaatttctacccgaaagacattaacgtgaaatggaagatcgacggctcggaacggcagaatggggtgttgaattcgtggaccgatcaggactcgaaagacagcacctactcaatgtccagcacccttacgctgactaaggatgaatacgagagacataattcctatacttgcgaggcgactcataagacttcaacttcccccatcgtcaagtcgttcaaccgcaacgaatgc

SEQ ID NO: 15200 - DNA, 711 bp, Artificial Sequence
  Description of Artificial Sequence: Synthetic coding sequence
atggatttccaagtgcagatattcagctttctgctgatcagcgcaagcgtgatcatttcgcgcggtcagattgttctcacccagtcccctgcgatcatgtccgcctcgcctggagaaaaagtcactatgacttgttccgcatcgtcatcggtgacctccatgcattggtttcagcagaaatcaggtactagccctaagaggtggatttacgatactagcaagctcgcctccggcgttcccgcgagattctcgggatcaggtagcggcacctcttactctttgacgatctcgattatggaggcagaagatgccgcgacgtactactgtcaacagtggaattacaacccgcctatggggactttcggaggtgggaccaaactggagattaaacgagcagatgcggcacccaccgtgagcattttccctccgtcatcagaacaactgacctcggggggtgcttccgtcgtgtgttttctgaacaacttttacccgaaggacattaacgtcaagtggaagatcgacgggtcagagagacagaacggtgtcctgaactcctggaccgatcaagatagcaaggatagcacttacagcatgtcgagcaccctgaccctgactaaggatgagtacgaacgccacaattcctacacctgtgaagcaactcataagacttccacctcccctatagtgaaatcgttcaatagaaatgagtgc

SEQ ID NO: 15201 - DNA, 711 bp, Artificial Sequence
  Description of Artificial Sequence: Synthetic coding sequence
atggacttccaggtccagatcttttcgttcctgctcatctcggcaagcgtgattatcagccgcggccagatcgtcctgacccagagcccggccattatgtcagcctcgccgggggaaaaggtgactatgacttgcagcgcgagctcaagcgtgacttccatgcattggttccagcaaaaatcgggcacgtcacccaagagatggatctacgataccagcaagctcgcctcgggagtgcctgccagattctcaggatctggatcgggcacttcctacagcctgaccattagcatcatggaagcagaagatgctgctacttactactgtcaacaatggaactacaacccgccaatgggaacttttgggggaggcacgaagctcgaaatcaagcgcgccgatgccgctcctactgtgtccatcttccccccgtcgtcagagcaactgaccagcgggggcgcctctgtggtgtgtttcctgaacaatttctacccgaaggacattaatgtgaagtggaagatcgacgggtctgaaagacagaacggagtcctgaattcatggaccgaccaggactccaaagactcaacctactcaatgtcctccactctgaccttgaccaaggacgaatacgagcggcacaacagctacacttgcgaagcaactcataagacttccacctcgcctatcgtgaagtcgttcaaccggaacgagtgc

SEQ ID NO: 15202 - DNA, 711 bp, Artificial Sequence
  Description of Artificial Sequence: Synthetic coding sequence
atggattttcaggtgcaaatttttagttttttactcatttccgccagtgtgattatttctcggggacagattgtactgactcaatctccggccatcatgtcggcctccccaggagaaaaggttacgatgacctgttcggcgtcaagtagcgtgacatctatgcactggtttcagcagaaatctggtacaagccctaaacgatggatttatgatacctccaaactggcctcaggcgtcccggctcgcttttcagggagtgggtctggcacctcatacagtcttaccatctcaataatggaggccgaggacgccgctacatattactgccagcagtggaattataatccaccgatgggcaccttcggggggggtactaaactggaaatcaagagagccgacgctgcccccaccgttagcatatttccgccaagtagtgagcagctgacctctggaggtgccagtgtggtgtgctttcttaacaatttctacccaaaggacattaatgttaagtggaaaatagatggttctgagagacagaacggagttctgaattcttggacagatcaggattctaaagatagcacatactccatgtctagtactctgacactcaccaaggatgaatatgaacgacacaactcatacacctgtgaggcaacccacaagaccagcacctccccgatcgtcaagtccttcaacagaaacgaatgc

SEQ ID NO: 15203 - DNA, 711 bp, Artificial Sequence
  Description of Artificial Sequence: Synthetic coding sequence
atggattttcaggttcaaatcttcagctttctgctgatctccgcatccgtcatcattagcagaggccagatcgtgctcactcagtcaccggctattatgtcagcttcaccgggtgaaaaggtcactatgacctgcagcgcgtcatcgtcggtgacctcgatgcattggttccagcaaaagtccggaactagccccaagcggtggatctacgatactagcaagctggcttctggagtgccggcacgcttttctgggtcgggatccggaacgagctactcgctgactatctcaatcatggaagctgaggatgcagccacctactactgccaacaatggaattacaaccctccaatgggcactttcggtggagggaccaagctcgaaatcaagcgtgccgacgcggcccctaccgtgagcatcttcccaccgtcgtcagagcaattgaccagcggaggagcctccgtggtttgcttcctcaacaacttctaccctaaggatatcaacgtcaaatggaagattgacggctcagagcggcagaacggggtcctcaactcctggactgatcaggactcgaaagactcgacctacagcatgtcctcgacgctcactctgactaaggatgaatacgagcggcacaactcgtacacttgcgaggccactcataagacctcaacctcgccgatcgtgaagagctttaaccggaacgagtgt

SEQ ID NO: 15204 - DNA, 711 bp, Artificial Sequence
  Description of Artificial Sequence: Synthetic coding sequence
atggatttccaggttcagatcttctcttttctcctgatctctgctagtgtaatcatctctcgagggcagatagtcctgacacagtctccagcgatcatgtcagcttctcctggagaaaaggtgaccatgacatgctctgctagcagctcagttacctccatgcactggtttcagcagaaatcaggcacaagccccaaacggtggatttacgacacgagtaagctggcttcaggggtcccagccagattcagcggctccgggtcgggcactagctatagcctgaccattagtataatggaggccgaggacgccgcaacatactattgccagcaatggaattataacccacccatgggtaccttcgggggcggtacgaagttggaaatcaaacgcgcagatgccgcacccacggttagcatctttccaccgagttcagaacagctgacctccggaggggcatccgttgtctgttttcttaacaacttctatccgaaggacatcaacgtgaagtggaaaattgatggaagcgaacgccagaacggcgtcttgaattcatggacagatcaggactccaaagacagcacctacagcatgtcaagtactctgacactgaccaaggatgagtatgaacgacacaactcatacacctgcgaggccacacacaaaacgagtacaagtccaatcgtgaagtcgttcaaccggaatgagtgc

SEQ ID NO: 15205 - DNA, 711 bp, Artificial Sequence
  Description of Artificial Sequence: Synthetic coding sequence
atggattttcaagtgcagatcttcagctttctacttatttctgcttccgtgataatttcccgggggcagatagtgctgacccagagtccggctatcatgtcggcttcacctggggaaaaggtcacgatgacttgtagtgcctcgtcgtccgtgacttccatgcattggttccaacagaaatccggaacatcccccaagcggtggatatatgacacatccaagctcgcatctggagtacctgcccgattcagtggaagcggttctgggacctcttatagtctgacaatctccattatggaagcagaggatgccgctacgtattattgtcagcagtggaactacaacccccctatgggcacttttgggggtggaacaaaactcgaaatcaagagggctgatgcggcgcccacggtctctatcttcccccccagctccgagcagctgacctctggcggcgcaagcgtggtgtgctttctgaataacttttatcccaaggacatcaacgtgaagtggaagattgacggctcagaacgccagaatggggtgctgaactcctggaccgaccaagacagcaaggattctacatatagcatgtcgtcaacccttactttaaccaaggacgagtatgaacggcataactcttatacttgtgaagccactcataagacctcgacatcgccaattgtaaagagcttcaaccgaaacgagtgt

SEQ ID NO: 15206 - DNA, 711 bp, Artificial Sequence
  Description of Artificial Sequence: Synthetic coding sequence
atggacttccaggtgcagatcttttcctttctgctgatctctgcctccgtcatcatttccagaggccaaattgtcctgactcaatcgcctgcaattatgtccgcatccccgggagaaaaggtcacgatgacttgttccgcctcctcgtcagttaccagcatgcactggtttcaacagaaatcgggcacttcccctaagcggtggatttacgacacctccaagctggcctcgggcgtgccagccagattttccggctcagggtcaggcacgagctacagcctgaccatatcaattatggaagccgaggatgcagcaacttactactgtcaacaatggaattacaatcctccaatgggtacctttggaggaggcaccaaactggaaatcaagagagcagacgcggcacctactgtgtccatttttcctccttcatccgaacagctcaccagcggaggagcgagcgtcgtgtgttttcttaacaacttttacccaaaagacataaacgtgaaatggaagatcgacggaagcgaacgccaaaacggtgtgcttaactcctggactgaccaagactcaaaagactcaacctattctatgtcgtcaactttgacccttaccaaggatgaatacgagagacataattcctacacgtgcgaggcaacccataagacttcgacgtcgcccattgtgaaatcgtttaacagaaacgaatgc

SEQ ID NO: 15207 - DNA, 711 bp, Artificial Sequence
  Description of Artificial Sequence: Synthetic coding sequence
atggacttccaggtgcaaattttctctttcctgttgatttctgcctctgttatcatatctcgggggcagatcgtcctcacacagtctcctgcaataatgtctgcttctcctggtgaaaaggtgacaatgacttgctcagcctcttcctcagttacatcaatgcactggtttcagcaaaagtcgggtactagccctaaaaggtggatctacgacactagcaagcttgcctccggagtccctgctcgattttcaggtagcggatccggaacttcttactccctgacaattagtatcatggaagcggaagatgcagcaacatattattgccagcagtggaattataacccaccaatgggtaccttcggaggaggtacaaaactcgaaatcaagcgagctgatgccgccccaactgtctccattttccctccttcttctgagcagttgacctccggtggtgcttcagtggtttgcttcctcaataacttttatccaaaggatataaacgtcaaatggaaaatagacggatcagagcgtcaaaacggggtgttgaatagttggaccgatcaggattcaaaggatagtacatatagtatgtccagtacactcactttgacaaaagatgaatacgaaaggcataattcatatacttgcgaagcaactcacaaaacgtccaccagtcctatcgtcaagtcgttcaaccgtaacgagtgt

SEQ ID NO: 15208 - DNA, 711 bp, Artificial Sequence
  Description of Artificial Sequence: Synthetic coding sequence
atggacttccaggtccagatcttctctttcctgctcatatctgcctctgtcattatctcgcgcggtcagatcgttctaactcagagcccagccataatgtctgcatctcccggggagaaggtgacaatgacatgctccgcaagctcatccgtgaccagcatgcactggttccagcagaaatcaggcacatcaccaaagagatggatctatgacaccagtaagctggccagtggggtgcctgctcggtttagcgggagcggatctggaacttcctattctctcacaatttctatcatggaggctgaggatgccgccacatactactgtcagcaatggaactacaaccctcccatgggcacattcggtgggggaactaaacttgagatcaaacgtgctgacgctgcccccactgtgtccatctttccacccagctctgaacagctgacatccggcggggccagcgtagtatgcttcctgaacaatttctacccaaaagatatcaacgttaagtggaagattgacggctccgagcgccagaatggggtgttaaacagctggactgatcaggacagtaaagatagcacttactctatgtcctcaacactaaccctaaccaaggacgagtacgagagacacaacagctacacgtgcgaggctacgcacaaaaccagtacatcccccatagtgaaaagttttaatagaaatgaatgc

SEQ ID NO: 15209 - DNA, 711 bp, Artificial Sequence
  Description of Artificial Sequence: Synthetic coding sequence
atggacttccaggtccagatcttctcgtttctgcttatctcggcaagcgtgatcatctccagaggacaaattgtcttgactcagagcccggctatcatgtcggcctcaccgggcgagaaggttaccatgacctgttctgcaagttcgtccgtcacgtcgatgcactggttccagcagaagtccggaacttccccgaaaaggtggatctacgatacgtcgaaactggcctcaggtgtgccggctcgcttttcaggcagcggatcgggcactagttatagcctcaccatctccattatggaggctgaggatgccgccacctactactgccagcaatggaattacaacccacctatggggactttcggtgggggcactaagctcgaaatcaagagggccgatgctgcccctactgtgtcgatcttcccccctagctcggaacagctgacctcgggaggcgccagcgtcgtgtgcttcctcaacaacttttacccgaaggatatcaatgtgaagtggaaaatcgacggaagcgagcgacagaacggggtcctgaattcctggaccgaccaggattcaaaggactccacttacagcatgtcatccaccctgactctgactaaagatgaatatgaacgccacaattcgtacacttgtgaggccactcacaaaacctcgaccagccctatagtcaagtcgttcaaccgcaacgaatgc

SEQ ID NO: 15210 - DNA, 711 bp, Artificial Sequence
  Description of Artificial Sequence: Synthetic coding sequence
atggattttcaggtccagatctttagctttctgttgatatccgcaagcgtgattatctcaagaggacagatcgtgctgactcaatcgcctgcaattatgagcgcaagccctggggagaaggtgaccatgacttgcagcgcaagctcgtcagttactagcatgcactggtttcaacagaagagcggaaccagccctaagagatggatctacgacacctccaagctcgcatcaggcgtgccagccaggttctcgggctccgggagcggaactagctactcgctcaccatctcaattatggaagcagaagatgcggccacttactactgccaacaatggaactacaacccgcctatgggaacttttgggggtggtaccaagctcgagattaagagagcggatgcagcacctacggtgtcgatttttccaccatcgtcagaacaactgacttcgggtggtgcgtcggtggtgtgttttctcaacaacttctaccccaaagacattaacgtcaagtggaagatagatgggagcgaacgccaaaacggcgtgcttaactcgtggactgaccaggattccaaggattccacttactccatgtcctcgaccttgaccctgaccaaagatgaatacgagaggcataacagctacacctgcgaagcaacgcacaaaacttcgacctcccccattgtgaagtccttcaatcgcaacgagtgt

SEQ ID NO: 15211 - DNA, 711 bp, Artificial Sequence
  Description of Artificial Sequence: Synthetic coding sequence
atggatttccaagtacagatcttttcttttcttttgatttcagcctctgttattatttcacgaggacaaattgtcttgacacaatcaccggctatcatgtcggcgtcaccaggagagaaagtgaccatgacatgctctgcgtctagctctgttacttcaatgcactggttccaacaaaaatctggcacttcacccaaaaggtggatttacgatacctctaagcttgctagtggagtgccggctaggttcagcggatccggaagcgggacctcgtattcattgactatcagcattatggaagcagaggatgcggccacgtactactgtcaacaatggaattacaatcccccaatgggtaccttcggaggaggtacaaagcttgagatcaagagagctgatgctgcaccgactgtctcaatttttcctccatcatccgaacaacttacctccggaggagcgtccgttgtgtgctttttgaataatttctacccgaaagatataaacgttaaatggaaaattgacggatcggagcgacaaaacggagtgctcaactcatggacagatcaagattcgaaagactcaacttactcaatgtcgtcaactttgaccctcacaaaggatgaatacgagcgacacaattcttatacctgtgaggctacacataagacttctacttcaccaattgttaaaagtttcaatcgaaacgaatgt

SEQ ID NO: 15212 - DNA, 711 bp, Artificial Sequence
  Description of Artificial Sequence: Synthetic coding sequence
atggacttccaggtgcagatcttttccttcctcctcatctccgcctcggtgatcatcagccgcggtcaaatcgtcctgactcagagcccggcaatcatgagcgcatccccaggagagaaagtgactatgacttgctcagcctccagctcagtgacctccatgcactggttccaacagaagtcaggtacctctccaaaacgctggatctacgacacctcgaaactcgcgagcggtgtgcctgcacgattttctggatcgggctcgggcacttcgtattcgctgactatcagcatcatggaggcagaggacgccgcgacctactactgtcagcaatggaactacaatcctccaatgggcaccttcggcggaggcaccaaactggaaatcaagcgggccgacgcggcaccgactgtctcgatcttccccccttcgagcgaacaactgacctcgggaggagccagcgtcgtctgctttcttaacaatttctatccgaaggatatcaatgtgaaatggaaaatcgacggttccgagcggcagaatggcgtgctcaattcatggactgatcaagactccaaggattcaacctacagcatgtccagcactctcacccttaccaaggacgaatacgagagacacaactcgtacacctgtgaagccactcataagacctcaacttcaccgatcgtgaagtcctttaatcgcaacgaatgc

SEQ ID NO: 15213 - DNA, 711 bp, Artificial Sequence
  Description of Artificial Sequence: Synthetic coding sequence
atggattttcaggtgcagatcttttctttcctgctgatatcggcttcagtgattatctcccgaggtcaaatcgtgctcactcaatccccggctattatgtcagcctcaccaggagaaaaagtgaccatgacctgttcggcgtcgtcaagcgtgacgtcaatgcattggtttcagcagaagagcgggacttcccctaagagatggatttacgatacttccaagttggcaagcggtgtgccagcgcggttcagcggctcggggtccgggacctcgtactcgcttaccatttcgattatggaggcagaagatgcggcgacctactactgccagcaatggaattacaacccacctatgggaacgtttgggggaggtactaaactggaaatcaaaagggcagatgcagcacccaccgtgagcattttcccaccgtcatccgaacagctgaccagcggaggagcatcagtcgtgtgctttctcaacaacttttaccctaaagatatcaatgtcaagtggaagatcgacgggtcagaaaggcagaatggagtccttaattcgtggaccgatcaagactcaaaggactcgacttactcgatgtcatcgacccttaccctcaccaaggatgaatacgagagacataactcttacacttgtgaagcgacccataaaaccagcacttctccaatcgtcaagtcgttcaacagaaacgagtgc

SEQ ID NO: 15214 - DNA, 711 bp, Artificial Sequence
  Description of Artificial Sequence: Synthetic coding sequence
atggacttccaagtccagatctttagctttctccttatctctgcctcagtcattatctcccgaggacagatagtgttaacacaatctccggccatcatgtctgcttcccctggcgaaaaagtaactatgacgtgcagtgcaagttcaagtgtcacttcaatgcattggttccagcaaaagagcggaacatctcctaagcggtggatctacgatacatcaaagctggcctctggtgtgcctgcacgtttctccggatccggttctggtaccagctactcactgaccatctccattatggaggctgaggacgcagccacctattattgtcaacagtggaattacaacccaccaatgggaacatttggtggtgggactaaactggaaataaaaagggcagatgctgccccaactgtctctattttcccaccctccagtgaacaactgacaagcggtggtgctagcgtggtatgtttcctgaataacttttacccaaaagacatcaatgtcaaatggaaaatcgacggctctgaaaggcaaaacggagtcctgaattcctggactgaccaggactctaaggacagtacctacagtatgtcttccacactcactttgacaaaagacgaatacgagaggcataactcatacacctgtgaagcgacccataagacaagcacgtcaccaatcgtaaagtctttcaacaggaacgaatgc

SEQ ID NO: 15215 - DNA, 711 bp, Artificial Sequence
  Description of Artificial Sequence: Synthetic coding sequence
atggattttcaagtgcagatcttttccttcctgctgatttccgcctcagtgattatcagcagaggccagattgtgctgacccaatccccagcaataatgtccgcctcaccgggagaaaaggtcactatgacttgttcggcaagcagctcggtcacctccatgcattggttccaacaaaagtcgggcacttcccctaagcgctggatctacgacacttcaaaactcgcatccggagtgccagcgcgattctcgggatccggaagcggtacttcatactcgctcactatttcaatcatggaagcagaagatgcggcgacttattactgtcaacaatggaactacaatccaccaatgggaacttttggaggcggaacgaagctggaaatcaagagggcggacgccgcacctaccgtctccatttttcctccctcaagcgaacagctgacttccggtggcgcatccgtggtgtgctttcttaacaacttttaccctaaggacataaatgtcaagtggaagattgatggaagcgagagacaaaacggagttcttaatagctggactgatcaggatagcaaggattccacttactcgatgtcatcgactctgacgctcaccaaggacgaatacgaaaggcacaattcgtacacctgtgaggctacccataagacctcgacttcacctattgtgaagagctttaatcgaaacgagtgc

SEQ ID NO: 15216 - DNA, 711 bp, Artificial Sequence
  Description of Artificial Sequence: Synthetic coding sequence
atggatttccaggttcagatattctcatttttgctgatctcagcatcagtcatcatttctaggggacaaatagtgcttactcaatcaccagcgatcatgtcagcctcccccggcgagaaagtcacgatgacgtgtagcgcttccagctctgtgactagcatgcactggtttcaacaaaagagcggcacctcgcctaaacggtggatttacgacactagcaagttggcctccggggtgcccgcgcggttttctggttcgggttcgggaacttcctactccctgactatttcgattatggaggcagaagatgcggccacctactactgtcagcagtggaattacaatccaccgatgggtacgtttgggggaggtaccaaacttgaaatcaagagggcagatgccgcaccaaccgtgagcatatttcctccatcctcggagcagcttacgtcggggggagcatccgtggtgtgcttccttaacaacttttacccaaaggacataaacgtcaaatggaagatcgacggatctgaaagacagaacggggtcctcaacagctggactgatcaagattcgaaagattcgacttactcgatgtcatcgactcttactctcaccaaagatgaatacgaacgccataactcctacacctgtgaagcaacccataaaactagcaccagccccatcgtgaagtcattcaacagaaacgagtgt

SEQ ID NO: 15217 - DNA, 711 bp, Artificial Sequence
  Description of Artificial Sequence: Synthetic coding sequence
atggattttcaggtccagatattctcgttcctacttatatcggcttccgtaattatctctagagggcagatagtactgactcagtctccagcaataatgtcggcttccccaggggaaaaagtcactatgacatgttctgcttctagttctgtaacatcaatgcattggtttcagcagaaatctgggacttcacctaaacgctggatatatgatacatccaaactagcctccggggtccctgcgagattctcggggtccggatccggaactagttactcgctcactatttccatcatggaagcagaagatgctgccacatattactgccaacagtggaactataacccaccaatggggacgttcggggggggaactaaacttgaaataaaacgagctgatgctgcacctacagtatctatctttcccccaagttcagaacagctaacatcagggggagcttctgtggtgtgtttcctcaacaacttttatcccaaggatataaatgtaaagtggaaaatcgatggaagtgaacggcaaaatggagtcctcaactcttggactgatcaggacagtaaagattccacatattcgatgtcttcaacactgactctaacaaaagatgaatatgagaggcacaactcatatacatgtgaggctacacataaaacttctacaagtccaatcgttaaatcttttaataggaacgagtgc

SEQ ID NO: 15218 - DNA, 711 bp, Artificial Sequence
  Description of Artificial Sequence: Synthetic coding sequence
atggcggtgatggcacctcgcacattggtacttttgcttagtggagccttggccttgacacaaacttgggccgacatacaaatgacacagagcccgtccaccctgtctgcctcagttggagacagagtgaccattacgtgtaaatgccagctcagtgtcggctatatgcattggtatcagcagaagccaggcaaggcaccgaagctgctcatctatgacacctcaaaactggcctctggagtgccatctcgctttagcggcagtggatcagggacggagtttaccctcaccatcagttctctgcagccagatgacttcgctacctactattgttttcaggggagcggttatcctttcacttttggtggaggaactaagctcgagattaaaagaacggtcgcagcgccatccgttttcatatttcccccgtccgatgagcaactgaaatctggcaccgccagcgtggtgtgtctcctgaacaatttctaccctcgtgaggcaaaagttcaatggaaggtagataatgcgttacagagcggcaattcgcaggaaagcgttacagagcaggactccaaagatagtacgtattctctgtcgtctactctgacgctgtcaaaggccgactacgaaaagcacaaagtctacgcttgtgaagttacacatcagggactgagttctccggttacgaagtcttttaatcgcggcgagtgt

SEQ ID NO: 15219 - DNA, 711 bp, Artificial Sequence
  Description of Artificial Sequence: Synthetic coding sequence
atggcagtaatggcaccacgcaccctggtgcttttattgagtggagcgctcgccttaacccaaacttgggccgatatccaaatgactcagtcgccctcgacactatctgcgagtgttggcgaccgggtaaccattacgtgcaaatgccagctctccgtagggtacatgcactggtaccagcaaaaaccaggtaaggcccccaagctactgatctatgacaccagcaagctggcttctggcgtgccctccagattttcgggaagcggaagtggaactgaatttactctgacaattagtagcctacagcccgatgatttcgccacctattattgtttccagggcagcggctacccattcacctttggaggaggtactaaactagagataaagaggacagtcgccgcaccgtctgtctttatctttcccccatcagacgaacagctcaaatcaggtaccgcctccgttgtgtgcctgctgaacaatttctaccctcgagaggcgaaagtgcaatggaaagtggataacgccttgcaaagcggaaattcccaggaaagcgtgacagaacaggactctaaagattccacctatagtctctcatctacccttactttaagcaaagccgattacgaaaagcacaaggtttatgcctgcgaggtaactcaccagggtttatcttctcccgtcacgaaatcatttaatcggggcgaatgt

SEQ ID NO: 15220 - DNA, 711 bp, Artificial Sequence
  Description of Artificial Sequence: Synthetic coding sequence
atggcagtcatggctccgcgcaccctggtgctcctgttgtccggggcactggcactgacgcagacttgggccgacatccaaatgacccaatcaccatcaaccctgagcgcgtccgtgggcgatcgcgtcactatcacttgtaagtgtcagctctcagtgggctacatgcactggtaccaacaaaaaccgggaaaggcgcccaagctgctcatctacgataccagcaagctcgcttcgggagtgccttcgcgcttctcgggaagcggtagcggaacggaattcaccttgactatctcgagtctgcagccggacgacttcgcgacctactattgctttcagggatccggatacccattcacgttcgggggaggtactaagttggaaatcaagagaaccgttgccgccccatccgtattcatcttcccgccatccgacgagcaactcaagagcggtactgcttcggtcgtctgcctgctgaacaatttctacccgcgcgaggctaaggtgcagtggaaagtggataacgctttgcagtctggaaactcacaggagagcgtcacggagcaggacagcaaggactccacgtactccctgtcctcgaccttgactctgtcgaaggctgattacgaaaaacacaaggtgtatgcatgcgaggtgacgcatcagggactctcgtcccccgtgactaagtcgttcaaccggggggaatgt

SEQ ID NO: 15221 - DNA, 711 bp, Artificial Sequence
  Description of Artificial Sequence: Synthetic coding sequence
atggcagtgatggcgccccgcaccttggtcctgctcctgtcgggagcgctggcgctgacccagacttgggcagatattcaaatgacccaatcaccttcgactctttccgcgtcagtcggcgatcgagtgactataacctgtaagtgccaactgtcagtcggttatatgcattggtaccaacagaagcctggcaaggccccaaaactgctcatttacgacacctccaagctggcgtcgggagtcccatcgagattttcgggttccggatcaggaactgagttcacccttaccatttcctccctccagcctgacgatttcgcaacttactactgttttcaaggatcagggtacccttttacgtttggtggtggcaccaaacttgaaatcaagcggacggtggcggcaccctccgtgttcattttccctccttcagacgagcagctcaagtcaggtactgcctccgtggtctgtctgcttaacaatttctatcctcgggaggcaaaggtgcagtggaaagtggataacgcactgcagtccgggaacagccaagagtcagttaccgaacaagattcaaaggattccacctactcactgtcatctactcttaccctctcaaaggctgattacgaaaagcataaggtctacgcatgtgaagtcacccaccaaggactgagcagccctgtgactaagtcgttcaataggggtgaatgc

SEQ ID NO: 15222 - DNA, 711 bp, Artificial Sequence
  Description of Artificial Sequence: Synthetic coding sequence
atggctgtgatggccccgagaacactggtcctcctgttgagcggtgctttggctcttactcagacctgggccgacatccagatgacacagagcccatccaccctctctgcaagcgtgggcgatcgcgtgaccatcacttgtaagtgtcagctcagcgtcggatatatgcactggtaccagcaaaagccaggcaaggcccccaagcttctgatctacgacaccagcaagctggcatcgggcgttccaagtcgcttttccggctcaggttctggcacagagtttaccctgactatatcctcgcttcagcccgatgacttcgccacttattattgctttcaaggttcaggttatccattcacctttggaggcggtacaaaacttgaaatcaagagaaccgtggcagcaccttccgtgttcatcttccctcctagtgatgagcagctaaaatctggaacagcaagcgtcgtctgtctgttgaataacttttatccccgggaggcaaaagtacagtggaaggtcgataacgccctgcagtctggaaactcccaggagtcggtgaccgagcaggacagcaaggattctacgtattctttgtcaagtaccctaactctttcaaaagccgattacgaaaaacataaagtatacgcttgtgaggtgacacaccaggggctatcttctcccgtgacaaaatcctttaatcgaggcgaatgc

SEQ ID NO: 15223 - DNA, 711 bp, Artificial Sequence
  Description of Artificial Sequence: Synthetic coding sequence
atggcggtgatggccccaagaaccctggtccttctcctgtcaggcgccctggcccttacccaaacgtgggcagatattcaaatgactcagtccccttcgactctgagcgcctcggtgggtgatcgcgtcactatcacttgcaaatgtcagctgtcagtgggttacatgcactggtaccagcagaagcccgggaaagcgccaaagctgctgatatacgatacttcaaagttggcgtccggagtgccatcgcggttttcagggtcgggtagcggaactgaatttacccttacgataagctctctgcagcccgacgattttgcaacgtattactgcttccaaggatctgggtacccattcacctttggtggaggaactaagctcgagatcaagagaaccgtggccgctccatcggtgttcatcttccctccatcggacgaacaactgaagagcggcaccgcaagcgtcgtgtgtctcctcaacaacttttaccctcgggaggccaaggtgcaatggaaggtggataatgcccttcaatcgggaaattcccaagagtcggtcactgaacaggacagcaaggattcgacctacagcctcagcagcaccctgactctgtccaaggcggattacgagaagcataaggtgtacgcctgcgaagtcacccatcagggactttcctccccagtgaccaagagctttaatcggggcgaatgc

SEQ ID NO: 15224 - DNA, 711 bp, Artificial Sequence
  Description of Artificial Sequence: Synthetic coding sequence
atggccgtgatggccccacgcactctagtcctactgctgtctggagccctagcgttgacgcagacatgggctgatatacagatgactcagagtccctccaccctcagtgcttcggtgggtgatcgtgtgacgataacgtgtaagtgccaactgtcggtgggctacatgcattggtatcagcaaaagcctggcaaagcccctaagcttctaatctacgatacctctaagctagcttcaggggtcccctctcgctttagtggcagtgggagcggtacggagtttacactgacaatcagctccctacagcccgatgattttgcgacctattactgtttccaggggagcggctaccctttcaccttcggtggtggtaccaaattggagatcaagaggacagtcgcagccccaagcgtgtttatctttccaccgagcgacgaacaactgaaatcaggcaccgcgtctgtggtttgcctccttaacaacttttatccgcgagaggctaaagttcagtggaaggtcgacaatgccctgcagtctggcaactcccaggaatccgtcacagagcaggactcaaaggacagtacatatagtctcagcagcacactcactttaagcaaggctgactacgaaaagcacaaagtgtatgcctgcgaagtgactcaccagggtttgtcttcccctgtgacaaagtcattcaatcgaggggagtgt

SEQ ID NO: 15225 - DNA, 711 bp, Artificial Sequence
  Description of Artificial Sequence: Synthetic coding sequence
atggctgtgatggcacctcggactctggtgctgctcctctcgggagccctggctctgacccagacctgggcggatatccagatgacccaatccccgtcaactctgagcgcctctgtgggcgatagagttaccataacgtgcaagtgccagctctcggtgggatacatgcactggtaccagcagaaaccaggcaaggcaccaaagctcctcatctacgacaccagcaaactggcatcgggggtgccatcccggttctcagggtccggatcaggaacggaattcaccttgaccatctcctccctccagccggatgactttgccacgtactactgctttcaaggatcaggatacccatttactttcggaggtggcaccaagctcgagatcaaacgcaccgtggcagcaccgagcgtgttcatcttcccgccgtcagacgagcagctgaaatctggcactgcatcggtcgtctgcctcctgaacaacttttacccacgggaagcgaaagtgcagtggaaggtggacaacgctctgcagtcgggaaattcccaagaaagcgtgactgaacaggattcgaaggattccacctactcgctttcgtccacgctgacgctgtccaaggccgattatgaaaagcataaggtctacgcgtgcgaggtgacgcaccagggactgtcgtcgccggtgactaagtcgttcaacaggggtgaatgc

SEQ ID NO: 15226 - DNA, 711 bp, Artificial Sequence
  Description of Artificial Sequence: Synthetic coding sequence
atggccgtgatggctccacgaactttggtcctcttgctctcaggggcgttggcactgacccaaacctgggcagatatccagatgactcagagcccaagcactttgtcagcaagcgtgggtgatagagtgaccataacctgcaagtgtcaactctcggttggatacatgcattggtaccagcagaagccgggtaaggcacccaaactgctcatttacgatactagcaagctcgcatcgggagtgccttcacgttttagcggttcggggagcggtaccgaattcaccctgactatttcatctcttcaacctgatgactttgcaacgtactactgctttcaaggttccggttaccccttcaccttcggaggtggtaccaagctggaaatcaaaagaactgtggccgcacctagtgtctttatctttcctccttcggacgagcagctgaagagcggcaccgccagcgtggtgtgccttctgaacaatttctatccacgggaagcaaaggtgcaatggaaggtcgataacgcccttcaaagcggcaatagccaggagtcagtgaccgagcaagattccaaggatagcacctactcgcttagcagcactctgactctctcgaaggcagattacgaaaaacacaaggtgtacgcatgtgaggtgacgcaccagggactcagctccccggtgactaaatcattcaaccgaggtgaatgt

SEQ ID NO: 15227 - DNA, 711 bp, Artificial Sequence
  Description of Artificial Sequence: Synthetic coding sequence
atggccgtgatggctcctcgcacattagtgcttctgctgtctggagcactcgccctgacacagacttgggcagatatccagatgactcagtctccctcaactctatctgcaagtgtgggggatagggtaacaattacatgtaaatgccagcttagtgtgggatatatgcattggtatcagcagaaacccggaaaagcacccaagttactaatatatgatacatctaaacttgcttctggggtcccctccaggttttccggatctggatccggaacagaatttactctgacaatatcgtccctgcaacccgatgatttcgccacttactattgtttccagggaagtgggtatccttttacatttggggggggaactaagttagaaatcaaaaggacagttgccgcaccttctgtcttcattttcccaccttcagatgaacagctcaaatctgggacagccagtgttgtatgtctacttaataacttctatccccgggaagctaaagtacagtggaaagtggacaacgcccttcagtctgggaacagtcaggaatctgtcacagaacaggattctaaagactctacttattctctttcatcgacacttacactgtctaaagcagattatgaaaaacacaaggtgtatgcctgtgaggtcacgcatcagggactgtcgtctcccgtgactaaatctttcaaccgaggagaatgc

SEQ ID NO: 15228 - DNA, 711 bp, Artificial Sequence
  Description of Artificial Sequence: Synthetic coding sequence
atggcagttatggcccccaggactctcgtattactgctttcaggcgccttggcactgacgcagacctgggctgatatccagatgactcagtctccatcaactctttcagcttcagtaggagatagagtaaccatcacatgcaaatgccagttgtcggtcggttacatgcactggtaccaacagaagcctgggaaggcccctaaattgttgatatacgatacttctaagctggcctccggagtaccgtctcgcttctccggctccgggtccggaacagagttcaccctgactataagctctctgcaacctgacgacttcgccacttactactgcttccaggggtctggatatccgttcaccttcgggggcggtacaaaactggaaattaagaggaccgtcgccgccccctccgttttcatctttcctccatctgatgagcagctgaagagcgggaccgccagtgtagtgtgcctgcttaataacttctatcccagagaggctaaggtgcaatggaaagtcgacaacgcgctgcaaagcggaaactcccaggagagtgtcaccgaacaggattccaaggatagcacctacagcttaagctcaacactgacactgtcaaaagcagattacgagaaacacaaagtgtacgcctgtgaggtaacccaccaagggctgtcctctcccgtgaccaaaagcttcaacagaggcgaatgt

SEQ ID NO: 15229 - DNA, 711 bp, Artificial Sequence
  Description of Artificial Sequence: Synthetic coding sequence
atggcggtgatggctcctagaaccctcgtcttgctcctctcaggtgccctcgccctgacccaaacttgggccgacattcagatgacccagtccccgagcactctgtcggcatcagtaggtgaccgggttaccatcacttgtaaatgtcaactctcagtcggatacatgcactggtaccaacagaagcctggaaaggcgccgaaacttctgatctacgatacttcgaagctggcgagcggagtcccgtcccgcttttccgggtccggatctggcactgagtttaccctcaccatctccagcctgcaacccgacgacttcgcaacctactactgtttccaaggttccggataccctttcacgtttgggggaggtaccaagctcgaaatcaagagaactgtcgcagccccatccgttttcatttttccgccgtcagacgagcagctgaaatccggaaccgccagcgtcgtctgcttgctgaacaacttctatccgcgggaagcgaaggtgcagtggaaggtggacaatgcactccagagcggaaattctcaggaatcggtgactgagcaagactccaaggattcaacctactcgttgtcatcgaccctcaccctgtctaaggccgattatgaaaagcataaggtgtacgcctgtgaagtgacccaccaaggactctccagcccagtgactaagagtttcaaccgcggagaatgc

SEQ ID NO: 15230 - DNA, 711 bp, Artificial Sequence
  Description of Artificial Sequence: Synthetic coding sequence
atggctgtcatggccccgcgcactttggtgctgctgctgtcaggcgccttggcgctcacacagacgtgggctgatattcagatgacgcagagtccctctaccctgtcagcctccgttggtgatcgcgtaactattacttgcaaatgtcagctttctgtagggtacatgcattggtatcagcagaaaccaggaaaagccccaaaactgttgatctacgatactagcaaacttgcctctggggttccctcccgcttctccgggagtgggtcagggactgagttcacgttgaccatatcttcccttcaaccagacgacttcgccacatactactgtttccagggctccggataccctttcacctttgggggcgggaccaagttggaaatcaaacgcacggtagctgccccatccgtgttcatctttcccccgtccgatgaacagttgaagagtggaactgccagtgtggtctgcctcctgaacaacttttacccgagagaagccaaggttcagtggaaagtggataatgccctgcaatcagggaattcccaggagtctgttacagagcaggactctaaagactccacgtacagcctgtcttcaacgctgacactctcaaaggctgattacgaaaagcacaaagtctatgcttgcgaggtcactcaccaaggccttagcagccccgtcacaaaatccttcaaccgcggagagtgc

SEQ ID NO: 15231 - DNA, 711 bp, Artificial Sequence
  Description of Artificial Sequence: Synthetic coding sequence
atggcggtgatggctccacgcactctggtattgctgttgagcggtgccctggctctgacccagacctgggctgatatccaaatgacccaatcacctagcactctgagcgctagcgtgggtgaccgtgtgaccattacttgtaagtgccagctgagcgtgggctatatgcactggtatcagcagaaaccggggaaggctcctaagctgctgatctacgatacgtccaagctcgcgtccggtgtgcctagccgcttctcaggcagcggttccggtactgagttcaccctcactatctccagcttgcaaccagatgacttcgctacctattactgctttcaggggtccggatacccttttaccttcggtgggggtacgaagcttgagattaagagaaccgtcgcagcaccgtctgtttttatttttcctccgagcgatgagcaattgaagtccggcaccgcatctgttgtctgcctcctgaacaacttttatccgcgcgaggcaaaggtgcagtggaaagtggacaacgccctacagagcggtaatagccaggagagcgttaccgaacaggacagcaaggatagcacctactctctgtccagcaccctgactctctctaaggctgactacgaaaagcataaggtctatgcctgcgaggtcacccaccagggcctgagctctccggtgacgaagagtttcaatcgcggcgaatgc

SEQ ID NO: 15232 - DNA, 711 bp, Artificial Sequence
  Description of Artificial Sequence: Synthetic coding sequence
atggcagtgatggctcccagaaccttggtgctgctcctcagcggggccttggccctcacccagacatgggcagacattcagatgacccagtccccaagtaccttgtcagcctccgtgggtgatcgcgtcactatcacgtgcaaatgccagcttagtgtggggtacatgcactggtatcagcagaagcccggtaaggccccaaagctgctgatatacgatacaagcaagctcgctagcggggtcccatccaggttttctgggtccgggtcaggcactgaatttaccctgaccatttcctccctccagcccgatgacttcgctacatattactgttttcaggggagcggatatccttttacctttggtggggggaccaaattggagatcaagcgaaccgtcgcggctcccagcgtctttattttccctcctagtgatgaacagctgaagtccgggaccgcctcagtcgtctgtctgctgaataatttttaccccagagaggccaaagttcagtggaaggtcgacaatgccctgcagtccggaaattcacaggagtccgtcactgagcaggacagcaaggattccacatatagtttgtcttccacactcactttgagtaaggctgattatgagaagcataaagtgtatgcttgcgaggtcactcaccaaggcctcagctcacctgtgaccaagtcattcaaccgaggggaatgc

SEQ ID NO: 15233 - DNA, 711 bp, Artificial Sequence
  Description of Artificial Sequence: Synthetic coding sequence
atggccgtgatggcacctcggacactggtactgctgctgtccggcgctctggctctgactcagacctgggctgacattcagatgactcagagtccaagcaccttgtccgccagcgtgggtgatagggtgacaatcacgtgcaagtgccagctgtctgtcggttatatgcactggtatcaacaaaagccaggtaaggccccaaagctgctgatctacgatacctccaagctcgcgtctggcgtaccttcccggttttcaggcagcgggtccggcaccgaatttacccttactatcagcagcctgcagccagacgatttcgctacgtactattgtttccagggatccggctaccctttcaccttcggaggcggtacaaagctcgagatcaagcggaccgtagctgccccaagtgtttttatctttccgcctagcgacgagcaactcaaatctggcactgcttccgttgtctgccttctcaacaatttctacccccgggaagccaaggtgcagtggaaggtcgacaatgcactgcaatctggtaactctcaggaaagtgtgacagagcaggatagtaaagactccacctacagcctgtctagcacactcacactctcaaaggccgactacgaaaagcataaagtatacgcatgcgaagtgacccatcaagggctgtccagccctgtgacaaagagttttaacaggggcgaatgc

SEQ ID NO: 15234 - DNA, 711 bp, Artificial Sequence
  Description of Artificial Sequence: Synthetic coding sequence
atggcagtgatggcaccaaggaccctggtcttgctgctttcaggggcattggcgctcactcagacctgggcggacattcaaatgacccagtcgcccagcacgcttagcgcctcggtgggagatcgagtgactattacttgcaagtgccaactctcagtgggatacatgcactggtaccagcagaagcctgggaaagcacctaaactgctgatatacgatacgtccaagctggcaagcggagtgccaagcagattctccgggtcaggttcaggcactgaatttacgctcacgatctcatccctgcaacctgatgattttgcaacttactactgttttcaaggctcaggatatccatttacttttgggggcggtactaagctggagatcaagcgtaccgttgcagctccttcggttttcatatttccccctagcgacgaacagctgaagtcgggaactgcgtccgtcgtctgtctcctgaacaatttctacccaagagaagcaaaggtccaatggaaggtcgacaacgctcttcaatcaggtaatagccaggaatccgtgaccgagcaagacagcaaggattcgacgtattcgctgtcatccactcttacgctctccaaagcagactacgaaaaacataaggtgtacgcttgtgaagtgacccatcagggccttagctcacctgtgaccaagtcattcaaccgtggggagtgc

SEQ ID NO: 15235 - DNA, 711 bp, Artificial Sequence
  Description of Artificial Sequence: Synthetic coding sequence
atggcagtcatggcccctaggactcttgtcctgctgcttagcggagcccttgcactgacacaaacgtgggcagacattcagatgacccaatctccgagtacactttctgctagtgtgggcgaccgcgtgaccatcacctgcaagtgtcagttgagtgtcggctacatgcactggtatcagcagaagccaggcaaggcaccgaagctgctaatctacgatacaagtaaactggccagtggcgttccttcccggttctcaggttccggaagcgggacagagttcacactgactatctcatcactccagccagatgactttgcgacttattactgctttcaggggagtggatacccctttacttttggaggtggcacaaaactcgagattaagcgtaccgtggcagcaccatctgtgttcatattccctccatccgatgagcaactgaagagtgggaccgcatctgttgtatgtctcctcaacaacttttacccacgggaggcgaaggtgcagtggaaagtcgataatgcgttacaaagcgggaactcacaggaatccgttaccgaacaagatagcaaagactcgacttacagcctgtcttctactttgactctgtctaaggcagactacgagaagcataaagtgtatgcctgcgaagtaacccatcagggtctatctagccccgtgactaagtcgtttaataggggcgaatgc

SEQ ID NO: 15236 - DNA, 711 bp, Artificial Sequence
  Description of Artificial Sequence: Synthetic coding sequence
atggcagttatggctcccagaactctcgtgctcctgctgtctggtgccctcgcgttgacacaaacatgggccgacattcagatgacacaatcacccagtaccctgtctgcatcagtgggcgaccgcgtcacaatcacctgtaagtgtcagctgagcgtgggctatatgcactggtaccaacagaagcctggcaaggcgcccaagctgctcatctatgatacaagcaagcttgcctctggcgtacctagcaggtttagtggcagtggtagcggcaccgagtttacccttactatatcttccctccagcccgacgattttgccacgtactactgcttccaaggttcaggctatccattcacatttggaggtggtaccaagctcgagatcaaacgcaccgtagccgctccatccgtgttcatcttccctccttctgacgaacaactgaaatccggcacggcttccgtagtctgcttgttgaataacttctatcccagagaggccaaggtacagtggaaggtggataacgcgctgcaaagtggaaactcccaggagtctgtcactgaacaggactctaaggactccacttattccttgagctccaccctgactctttctaaagccgattatgagaagcacaaagtatacgcatgcgaggtgactcaccagggcctcagcagtccagttacaaaaagtttcaacagaggagagtgt

SEQ ID NO: 15237 - DNA, 711 bp, Artificial Sequence
  Description of Artificial Sequence: Synthetic coding sequence
atggctgtgatggcccccaggacgttggtgctgctgctttcgggtgcgctggccttgacccagacttgggccgatatccagatgacacaaagcccatcgacactgtcggcttctgtgggtgatcgcgtgaccatcacttgcaagtgccaactgtcagtgggttacatgcattggtaccagcaaaagccaggcaaggcccctaagctgctgatctatgacacaagtaagctggcgagcggcgtcccatctcgtttctcgggttccggctctggtacagaattcactttaactatctcgtcgcttcaacccgacgattttgccacctattactgcttccagggcagcggctacccgtttacttttggaggggggactaaactggaaattaagaggacagttgccgctccgagcgtgttcatattccctccctcggatgagcagctcaaatctggtactgcctcagtggtttgccttcttaacaacttttatccgcgggaggccaaggtacaatggaaggtagataatgccctgcaaagcggcaatagccaggagagcgtgacggaacaagactcgaaggactcaacgtacagcctgagttcgaccttaaccctcagcaaagccgattacgagaagcacaaggtctacgcctgcgaggtaacgcaccagggactgtcgagccccgtgacgaagagcttcaaccgcggcgagtgc

SEQ ID NO: 15238 - DNA, 711 bp, Artificial Sequence
  Description of Artificial Sequence: Synthetic coding sequence
atggcagttatggctccgcggaccctggtgctgctgctcagcggcgcgttagcactcactcagacttgggcagacatccagatgacacagtctccttcaaccctgagtgcttctgttggagacagggtgaccattacatgtaaatgccagcttagtgtagggtatatgcactggtaccagcagaagccaggtaaggcgcctaaactactgatatacgatacatcaaaactagcctctggagttccttcgcggttcagtggctctggttctggaacagagtttacgctgaccatctccagtctgcagcccgatgatttcgctacgtattactgttttcagggcagcggctacccattcacttttggcgggggaaccaagctcgagatcaaacgaacagtggccgcgccttctgttttcatcttccctcccagtgacgaacagctgaaatctggcacggcgtcagtggtttgtttgctcaacaacttctatccgagagaggcaaaggttcaatggaaggtggataacgccctgcagtccggaaatagccaagaaagtgtgactgaacaagattctaaggatagtacttactctctgtcatctactctgactctctccaaagccgattacgaaaagcacaaggtgtacgcgtgtgaagtgacacatcaaggcctgtcttccccagttaccaagtccttcaaccgaggagagtgc

SEQ ID NO: 15239 - DNA, 711 bp, Artificial Sequence
  Description of Artificial Sequence: Synthetic coding sequence
atggcagtaatggcacccaggacccttgtcctgcttctgtcgggcgcactcgctctgactcagacttgggccgacattcaaatgacccagtcgccttcgacgctcagcgcatccgttggagatagagtcactattacctgcaaatgtcaactttctgtcggttacatgcactggtaccaacaaaagcctggtaaggcgccaaaattgctgatatacgacaccagcaagctggcttcaggcgtaccaagccggttttccggatcggggagtggaaccgaatttaccctgaccatttcttctctgcaaccagatgattttgcaacttactactgtttccagggctccggctatccattcaccttcggaggtggaaccaaacttgagatcaaacggacggtggctgcacctagcgtgtttatctttcctccgtccgacgagcagctcaagtcgggtactgcctcagtggtgtgtctcctgaacaacttttacccccgcgaagcaaaggttcaatggaaggtggacaatgcgcttcagtcagggaattctcaagaatcagtgactgaacaggattcgaaggattccacctactcattgagctcgaccttgactctttccaaagccgattacgaaaagcataaggtgtacgcgtgtgaagtgactcatcagggactttcctcgcccgttaccaagtccttcaaccgaggggagtgc

SEQ ID NO: 15240 - DNA, 711 bp, Artificial Sequence
  Description of Artificial Sequence: Synthetic coding sequence
atggctgtgatggccccacgcactcttgtgctgctgctgtccggagcgctggcgctcacccagacttgggcagacatccagatgactcagtcgccttcaacgctcagtgctagcgtaggtgaccgcgtgactataacctgcaaatgccaactgagcgtcggatacatgcattggtatcaacaaaagccggggaaagccccgaagctcctgatctacgatacctctaagctggcctccggggtgccatcacggttttccgggtcaggctcgggcaccgagttcaccttgaccatttcgagtttgcagcctgacgactttgccacgtactactgcttccagggtagcggataccccttcaccttcggaggaggcaccaagctggagatcaagaggactgtggcagccccttcggtgttcatcttccccccgtcagatgaacaacttaagagtgggacggcctccgtggtctgcctcctgaacaatttctatccgagagaagcgaaggtccagtggaaggtcgacaacgctctgcagtcgggtaactcgcaagagtcggtgactgaacaggactcaaaagatagcacctacagcctttcatcaactttgaccctctcgaaagcggattacgaaaagcacaaagtgtacgcatgtgaggtcacgcatcagggcctctcgagccccgtgactaagtcgtttaatcgaggcgaatgt

SEQ ID NO: 15241 - DNA, 711 bp, Artificial Sequence
  Description of Artificial Sequence: Synthetic coding sequence
atggcagttatggccccacgcactctcgttctattgttgagtggtgcactagcgttaacgcaaacgtgggctgatatccaaatgactcagagtccatccactctttctgcttccgtcggcgatcgagtcacaataacttgtaaatgtcaattaagcgtgggatacatgcactggtatcaacagaaacccggtaaagcgccaaaacttctcatttatgatacatctaagttggcctcaggagtgccgtccagattctcaggttctggatcaggtaccgagttcacgctcactataagtagcctccagccggatgattttgccacatactattgcttccaaggttctggctatccattcacatttgggggaggaactaaacttgagataaaacggacagtggcagccccatcagtctttatctttccaccttcggatgaacaactgaaatcaggtactgcttctgtggtgtgcctccttaacaacttctacccaagagaagcaaaagttcagtggaaggtggacaatgctttacaatccggaaactcgcaggaatccgtgacggagcaggattctaaagactcgacctattcactctcctcaacattgaccctttccaaagcagattatgagaaacacaaagtttacgcttgtgaggttacccaccaaggactttcatctccggttacgaagtctttcaacagaggagagtgt

SEQ ID NO: 15242 - DNA, 711 bp, Artificial Sequence
  Description of Artificial Sequence: Synthetic coding sequence
atggcagtcatggcccctcgcacactggtcctgctgctcagcggagctctcgcactgactcagacctgggcggacatccagatgacgcagtctccctctacattgagcgcgagtgtgggggatcgggtaacaatcacctgtaaatgtcaattgtccgtaggttatatgcattggtatcagcagaaacccgggaaagccccgaaactcctgatttacgacacatccaagctagcctccggcgtgcccagcagattttcaggctctggttcaggcaccgaatttactctgaccatctcctctttgcagcccgacgatttcgccacttattactgtttccagggatctgggtacccattcacattcggtggtgggactaagctggaaatcaagcgcactgtcgccgctcctagcgtgtttatattcccgcctagtgatgagcagttgaagtctggtacagcttccgtagtatgcttgctgaataatttttaccctcgggaagctaaagtgcagtggaaagtcgacaatgcactacagtcaggaaactcacaggaatctgttactgagcaggatagtaaggactccacctactccttgtcaagcacccttactctgagcaaagccgactatgaaaagcataaggtttacgcttgcgaagtgacccaccaggggctgagttctccagtaaccaaaagtttcaatcggggcgaatgt

SEQ ID NO: 15243 - DNA, 711 bp, Artificial Sequence
  Description of Artificial Sequence: Synthetic coding sequence
atggctgttatggctccccgaaccttggtcttgctgctgagtggtgcgctggcgctcactcagacatgggcagacatccagatgacccagtcgccttctaccctatctgcctcagttggagacagggtcacaatcacctgcaaatgccaactttctgtcgggtacatgcactggtaccagcaaaagcctgggaaggctcctaagctgctgatctacgatacatccaagctggcaagtggagttcccagccgcttcagtggcagcgggagcgggacagaatttacactaacgatctcatcccttcagccagacgattttgcgacctactattgtttccagggaagtggttatccattcactttcggaggaggtaccaaattagaaataaagagaaccgttgcagccccctcagtgttcatattccctcccagcgatgagcaactgaagtccgggaccgctagtgttgtgtgtctgctgaataatttttaccccagggaggccaaggtgcagtggaaagtggataacgctctgcagagcgggaactctcaggaatctgtgacagagcaggactctaaggatagtacatatagcctgagttcgaccctgactttgtccaaggccgattacgagaagcacaaggtctacgcatgtgaggtcacccatcaaggcttatcctcacccgttacaaaatcgtttaaccgcggagagtgt

SEQ ID NO: 15244 - DNA, 711 bp, Artificial Sequence
  Description of Artificial Sequence: Synthetic coding sequence
atggctgtgatggctccacgcacacttgtgcttctgctttcaggagcactcgcattgacacagacctgggcagatatacaaatgactcaatccccttccactctttctgcttccgtgggtgacagggtgactattacctgtaagtgccaacttagcgttgggtatatgcactggtaccaacagaaaccgggtaaggcaccaaagcttctgatctatgatacttccaagttagcttctggtgttccaagccggttctctgggtccggaagtggaaccgagttcacactcacaatcagctctcttcagcccgatgattttgctacgtactattgctttcagggtagtggttatccttttacatttggaggcggaaccaagctcgagattaaaagaactgttgctgcccctagcgttttcatcttccctccatctgacgaacaacttaaaagcggaacggcctctgttgtttgcctgttgaacaacttctatcccagggaagcaaaagtccagtggaaagtagataacgcattgcagtctggtaactctcaagagtccgtcaccgagcaagactctaaggacagtacttacagcctgtcttcaaccttgacattgtctaaagctgactatgaaaagcataaagtttatgcttgtgaggtaacccaccaggggttatccagtcccgtgaccaaaagttttaatcgtggggaatgc

SEQ ID NO: 15245 - DNA, 711 bp, Artificial Sequence
  Description of Artificial Sequence: Synthetic coding sequence
atggccgtgatggccccaaggaccctggtgctgttactgtccggagccctggcccttacccagacatgggccgacatccagatgacccagtctcccagcactctatctgcatctgtgggcgaccgagtcacgattacttgtaagtgccagctgtccgtcggttacatgcactggtatcagcagaaaccgggcaaggctcccaagctgctgatatacgacacatcgaaactggcatcaggcgtgccatcaagattctccgggtccgggtccggcaccgagtttaccctcacgattagctccctgcagccagatgatttcgcgacttactattgtttccagggttccggttacccttttacatttggcgggggaacgaagttagagattaagcgaaccgtcgcggcgccgtcggtcttcattttcccaccatctgacgagcagttgaagtcggggaccgcttctgtcgtctgtctattgaataacttctatcccagggaggccaaggtacagtggaaggtggataacgcactgcagagcggcaactcgcaagagtccgtgacagagcaggatagcaaagatagcacttactcactaagcagcacgcttaccttgagtaaagccgactacgagaaacacaaagtctacgcatgtgaggtcactcatcagggactgagttcccccgttacaaagtcattcaacaggggcgaatgc

SEQ ID NO: 15246 - DNA, 711 bp, Artificial Sequence
  Description of Artificial Sequence: Synthetic coding sequence
atggccgtgatggcacctagaactctggtgcttctgctgtccggagcactggcacttacccaaacttgggcagacattcagatgactcaatcaccttccaccctgtcggcatccgttggagatagagtgactattacgtgtaagtgccagctctccgtcgggtacatgcattggtaccagcaaaagccagggaaggcgcccaagctgctgatctacgatactagcaaactggcatcaggagtgccttcgcgctttagcggctccggttccgggaccgagtttacgctcacgatttcctcccttcaaccagatgattttgcgacctactattgtttccagggttccgggtacccttttactttcggaggaggaaccaaacttgagatcaagaggaccgtggccgcaccttcggtgttcatcttcccaccttctgatgagcagctgaagtccggaaccgcatcagtggtttgcctgctcaataacttttacccgcgagaagcaaaggtgcagtggaaagtggacaatgcacttcaatcgggaaattcacaagagtccgtgactgaacaagactcgaaagacagcacttactccctctctagcaccctgaccctgtccaaggcagattacgaaaaacacaaggtgtatgcctgtgaggtgacccatcaaggactgtcctcgcctgtgacgaaatcgttcaacagaggcgaatgc

SEQ ID NO: 15247 - DNA, 711 bp, Artificial Sequence
  Description of Artificial Sequence: Synthetic coding sequence
atggcggtgatggccccccggacccttgtgttgctgttaagcggagcattggccctcacgcagacgtgggctgacatccagatgacccagtccccaagcacactgtccgctagtgtcggcgaccgagtgaccattacctgcaagtgccaattatccgtggggtatatgcactggtaccagcagaagcctgggaaggcccccaagctgttaatttacgacacctccaagctcgccagcggtgtcccctctcgattttctggatccggaagtggtacagagtttacactgacgatctctagcctgcagcctgacgactttgccacttactactgttttcaagggtcaggctacccttttacttttggtggtggtacaaagctcgagatcaagcgcaccgtggctgcgccctcagtcttcatatttcccccttctgatgagcagctgaagtcaggcacagctagcgtggtgtgtttgctgaataatttttacccgagggaagctaaagtccagtggaaggtagacaacgcattacagagtggcaacagccaggaatcagttactgaacaggattccaaggattcgacctactcactgagctctaccctaaccctgagtaaggccgattatgagaagcataaagtgtatgcttgtgaagtgactcaccagggcctttctagtcctgtgactaaatctttcaaccgcggcgaatgt

SEQ ID NO: 15248 - DNA, 711 bp, Artificial Sequence
  Description of Artificial Sequence: Synthetic coding sequence
atggccgtcatggcaccccgcaccctggtcttgttattgtcgggagcattggctcttacccaaacttgggccgacattcagatgacccagtcaccgagcacactgagcgcctcagtgggtgacagggtgaccatcacttgtaaatgtcaattatccgtaggttatatgcactggtaccagcagaaaccggggaaggcgcctaagcttctgatttacgacacgtccaagcttgcttcaggtgtgcccagccggttcagcggaagcggctctggaactgagttcaccctcaccataagtagcctgcaaccggacgattttgctacgtactactgttttcaaggcagtggttaccctttcacgtttgggggtgggactaagctggaaattaaaaggaccgtcgccgcaccttcagtgtttattttccctcccagtgacgaacagttaaaatctgggactgcgtccgtagtatgtctgctaaataacttttatccccgtgaagctaaggtccagtggaaagtggacaatgccctgcaatcaggaaattctcaggaatccgtgaccgagcaagacagcaaagacagcacctactcactcagcagcacccttacgttgagtaaggctgattacgagaaacacaaggtctacgcctgcgaggtcacccaccagggcctttcctctcccgtgacaaaatcattcaacaggggcgagtgt

SEQ ID NO: 15249 - DNA, 711 bp, Artificial Sequence
  Description of Artificial Sequence: Synthetic coding sequence
atggccgttatggccccaaggaccctggtactccttctgagtggggctctggcgctgacacagacttgggctgacatccagatgactcagagtccttcaaccttatccgcctccgtgggcgatcgtgtcaccatcacgtgtaagtgccagctgagcgtaggctacatgcattggtatcagcagaagccgggaaaagcgccgaagttgcttatttacgatacttctaagctggcctccggtgtcccctctcgatttagcggaagcgggtccgggacggaattcaccctaactattagcagtctgcagcccgatgattttgccacttactattgcttccagggctcaggatacccatttaccttcgggggtggtactaaactggaaattaagagaaccgttgcggcccccagcgtgttcatctttccaccttctgacgaacagctgaagtccggcacagcctcggtggtgtgtcttctgaataacttctatccacgggaagccaaggttcagtggaaggtggataacgcgctgcaaagcggcaattctcaggagtctgtcacagaacaggactcaaaggattcaacatatagcctttccagcacccttacactgtccaaggccgactacgaaaagcacaaggtgtacgcatgcgaggtgactcatcagggcctgtccagtccagtcaccaagtcttttaataggggagagtgc

SEQ ID NO: 15250 - DNA, 711 bp, Artificial Sequence
  Description of Artificial Sequence: Synthetic coding sequence
atggcagtgatggcacctcgcactctcgtgctcctgctgtccggtgcactggcactcactcaaacttgggcagatattcaaatgactcagtcaccttcgactctgtcagccagcgtgggagatcgagtgaccattacctgcaagtgccagctgagcgtcggatacatgcattggtaccaacagaagcctggtaaggcaccaaagttgcttatctacgatacctcaaagctggcatccggtgtgccttcccggttttccggttctggatccgggaccgagtttactctcaccatctcctcccttcaacctgacgacttcgcgacctactactgttttcaaggatccggttacccttttacttttggaggtggaaccaaactggagattaagagaaccgtggctgccccatcagtgtttatcttccctccaagcgacgagcagctgaagtcgggcactgcatccgtggtgtgtctgcttaacaatttctaccccagagaagcaaaggtccagtggaaggtcgataacgcactccagagcggtaactcccaggaaagcgtgactgagcaggattcaaaggactcgacctattccttgtcctcaactcttactctttcgaaagcagattacgagaagcacaaggtgtacgcatgtgaagttacgcatcaaggactgtcgagccccgtcactaagtcgtttaaccgcggcgaatgt

SEQ ID NO: 15251 - DNA, 711 bp, Artificial Sequence
  Description of Artificial Sequence: Synthetic coding sequence
atggcagtcatggcccctagaacactggtcctccttctgagcggggcactggctctaacacaaacatgggcagatatccagatgacacagagtccgagcactttgtccgctagcgtgggcgatcgagtcacaataacatgtaagtgtcagctcagtgtcggttacatgcattggtaccagcagaagcctggaaaggcacctaaattgctgatctacgacactagtaagttggcgagtggagttccttcacggttttcaggctccgggagcgggaccgaatttaccctcaccattagcagcctgcagccagacgatttcgccacttattactgttttcaaggatccggataccccttcacattcggtggcggtaccaaactggaaattaagaggactgtggctgctcctagcgtgttcatcttcccgccctccgacgagcagcttaagagcggaacagcctccgttgtgtgtctcctgaacaatttctatccgagggaagcaaaagttcagtggaaggtggacaacgctcttcagtctggaaactcgcaggagagtgtgactgaacaagacagcaaagactctacttactccttgtctagcaccctgaccctctccaaagctgattatgaaaagcacaaggtatacgcgtgcgaggtaacacatcaggggcttagctcccccgtgactaagtcgttcaatcggggggagtgc

SEQ ID NO: 15252 - DNA, 711 bp, Artificial Sequence
  Description of Artificial Sequence: Synthetic coding sequence
atggcggtgatggccccaagaacgcttgtgctgctcctttcgggagcgctcgccctgacccagacctgggctgacatccaaatgactcaatctccctcgaccttgtccgcgtcggtgggcgaccgcgttactatcacctgtaaatgtcagctcagtgtgggctacatgcactggtaccagcagaagcctggcaaggccccgaagctccttatctacgataccagcaaactggcctcaggagtgccttcacgcttttccggaagcggatcagggaccgaattcaccctgactatctcctccctccaaccggacgacttcgccacctactactgctttcaaggttccggctacccattcacctttggcggcggtaccaaactcgagatcaagcgcaccgtggctgccccgtcggttttcatcttcccaccgtcggatgaacagcttaaatcaggaaccgcgtcagtggtgtgcctcctgaataacttctaccctagagaggccaaggtgcagtggaaggtggacaatgcactgcagtcgggcaactcacaggaatccgtgactgaacaggactccaaagactcgacgtactccctgagctcaacgctcaccctgagcaaggcggactatgagaagcacaaggtctacgcctgcgaggtcactcatcagggcctctcgtcgccagtgactaaatcgttcaataggggtgagtgc

SEQ ID NO: 15253 - DNA, 711 bp, Artificial Sequence
  Description of Artificial Sequence: Synthetic coding sequence
atggcagtgatggcaccgcgcacgctggtgctgttgctgtccggggcactggccctcacgcagacctgggctgatatccaaatgacgcagtccccatccaccctgagtgctagcgtgggtgaccgcgtcaccataacatgcaaatgtcagttgagcgtgggctacatgcattggtaccagcagaaacccggcaaggcccctaagctgctgatttatgatacttcaaagctagcttcaggtgtgccatccaggtttagcgggtccggcagcggcacagaatttactctgactatatcttcgctgcagcccgatgactttgcaacttattattgctttcaggggagtggctacccatttacattcggtggtgggacgaagctggaaatcaaacggaccgtcgcggcgccatcagtattcatcttcccgccctccgacgagcaactgaaatccggtaccgcgagtgtggtgtgccttctaaataacttctaccccagagaagctaaggtgcaatggaaagtggataacgccctacaatctggaaatagccaggagtcagtgaccgaacaagatagcaaggattcgacctactcactctctagcacgctcacgttgagtaaggcagattacgagaaacataaggtatacgcatgtgaagtgacccatcagggtctctctagccccgtgaccaaaagtttcaaccggggagaatgt

SEQ ID NO: 15254 - DNA, 711 bp, Artificial Sequence; identical to SEQ ID NO: 15249
  Description of Artificial Sequence: Synthetic coding sequence

SEQ ID NO: 15255 - DNA, 711 bp, Artificial Sequence
  Description of Artificial Sequence: Synthetic coding sequence
atggctgtgatggcaccacggactctcgttctgcttctttcaggcgcactcgccctgacgcaaacttgggctgacatacaaatgactcagtctccctctacgcttagcgcaagtgtgggtgacagggttactattacgtgtaagtgccaactgtcagtgggatacatgcactggtaccagcaaaagcccggcaaggcaccaaaattgcttatctacgatacctccaagctggcgagcggagtcccctcgagattctcggggagcggctcgggaaccgaatttactctgactattagctcccttcagcctgatgactttgccacctactactgttttcaaggtagtggttatccattcacctttggaggagggaccaagttggagatcaaacgcaccgtggcagcgccatccgtgtttatcttccctccttcggacgagcagttgaagtcaggcaccgcatcagtcgtgtgtctgctcaacaatttctaccctcgggaagcgaaggtgcaatggaaagtagataacgccctccagtccggaaattctcaggagtccgtcaccgaacaagattcgaaggatagcacttactcactgtcgtctactctcaccctttccaaggctgattacgaaaaacataaagtgtacgcatgtgaagtgacccatcagggactctcttcacctgtgaccaaatcgtttaaccgaggggaatgc

SEQ ID NO: 15256 - DNA, 711 bp, Artificial Sequence
  Description of Artificial Sequence: Synthetic coding sequence
atggcagtgatggcgccaagaacgctggtgctgctcctgtcaggcgccctcgctcttactcagacgtgggcagatattcagatgactcaatcgccctcaactctttccgcatccgtcggcgatcgagtgaccattacctgtaagtgccaattgtcagtcggctacatgcactggtaccaacaaaagccaggaaaggcaccaaaattgctcatctacgatacctccaagctcgcctcgggtgtcccgagcaggttcagcggctccggctcaggcactgaatttacccttaccatttcgtcgctgcagcccgatgactttgccacctactattgttttcagggatcaggttacccatttactttcgggggaggaactaagttggagattaaacgcaccgtggccgcaccttcagtgtttatcttccctcctagcgacgaacagctgaagtccggcacggcctcggtggtgtgtctgctcaataacttctatccgcgggaggcaaaggtgcagtggaaggtcgacaacgcgctccagtcgggaaacagccaagagagcgtgactgagcaagatagcaaggactcaacttacagcctgtcgtctaccctgactctttcaaaagctgattatgagaaacataaggtctacgcatgcgaggtcactcatcaaggccttagctcgcccgtgactaagagctttaatcgcggagaatgt

SEQ ID NO: 15257 - DNA, 711 bp, Artificial Sequence
  Description of Artificial Sequence: Synthetic coding sequence
atggccgtaatggcaccaaggacgttagtgttactgttaagcggggcactcgccctgactcaaacctgggccgatattcaaatgactcaatcgccttccactctctcagcgtcggttggcgatagagtaacaatcacgtgtaaatgtcagctatccgttgggtacatgcactggtatcagcaaaaacccggcaaagctcctaagcttctcatatacgacacaagtaaattggcaagcggggtcccttctaggtttagcggatctgggtccggcacagagttcactcttactatttccagtctccaaccagatgatttcgctacctactattgcttccagggctccgggtatccattcacattcggcggggggaccaagttagagataaagcggaccgtggctgcaccttctgtgttcatcttccccccaagcgacgaacagctcaaaagcggcactgccagcgtggtgtgcttgctcaacaacttttacccacgcgaggctaaggtacagtggaaggtggataacgcccttcagtccggcaacagtcaagagagtgtgacagagcaggattctaaggattctacctactctctcagcagtacactgaccctaagtaaggcagactatgagaaacacaaggtatatgcctgtgaagtgacacatcaggggctaagtagccccgttacaaaaagttttaaccgtggcgagtgc

SEQ ID NO: 15258 - DNA, 711 bp, Artificial Sequence
  Description of Artificial Sequence: Synthetic coding sequence
atggcggtgatggccccgaggaccctcgtcctgctcctgagcggagccctggctctcacccaaacttgggccgacattcaaatgactcaatcgcctagcaccctgtcggcgtcggtgggagatcgggtgactataacgtgcaaatgtcaactgtcggtgggctacatgcattggtatcagcaaaagccaggaaaggcgccaaagctgttgatctacgacacgagcaagctcgcctccggagtcccatcccgcttctccgggtccggatcggggactgagtttaccctgactatcagctccctccagccagatgactttgcgacctattactgcttccagggatcgggatacccgttcactttcggaggaggaactaaactggagatcaagcggactgtggcggctccctccgtgttcatcttcccgccttcggatgaacagctcaagtccggaaccgcctcggtggtctgcctgctgaacaatttctacccgcgcgaggcaaaagttcaatggaaggtcgacaacgccctgcaatcgggaaattcacaggagtccgtcactgagcaggacagcaaggattcaacttactccctgtcatccaccctgaccttgtcaaaggctgattacgagaagcataaggtgtacgcttgtgaggtgactcaccagggtttgtcgtcgccagtgactaaatccttcaatagaggcgaatgc

SEQ ID NO: 15259 - DNA, 711 bp, Artificial Sequence
  Description of Artificial Sequence: Synthetic coding sequence
atggccgtgatggcaccacgcactttggtgctgctgctgtcaggggctctcgcgttgacccaaacttgggccgacatccaaatgactcagagcccgagcaccctgtctgccagcgtcggagatagagtgaccatcacctgcaagtgccaactgagcgtgggttacatgcattggtaccagcagaagccgggaaaggcgcccaaactgctgatctacgacacgtccaagctggcttcaggagtgccttcgcggttctcgggctccggatcggggactgagtttacccttactatcagctcgctccaaccggatgatttcgcgacgtactactgctttcagggctcgggatacccgttcacttttggtggcggaaccaagctcgaaatcaaacggactgtggcggccccttcagttttcattttccccccgtcagacgaacagctcaagtccgggacggcctccgtcgtctgtctcctgaacaatttctacccaagggaggcaaaagtccagtggaaggtcgacaatgctttgcagtccggcaactcgcaggagtccgtgactgaacaggattcgaaagacagcacttactcactcagctcgaccctgaccctttcgaaggccgactatgagaagcacaaagtgtacgcatgtgaagtgacccaccaaggactgtccagtccagtgaccaagtccttcaaccgcggagaatgc

SEQ ID NO: 15260 - DNA, 711 bp, Artificial Sequence
  Description of Artificial Sequence: Synthetic coding sequence
atggcagtgatggcgccacgtactcttgtgctgctgctttccggagcccttgcgttgactcaaacgtgggcggacattcagatgacgcaatcgccatctaccctttcggcctcggtcggggatcgggtcaccatcacttgtaaatgccagctgagcgtcggatacatgcattggtatcagcaaaagcccggaaaggcacccaaactccttatctacgatactagcaaactggcctcgggggtgccttcaaggttcagcggcagcggctcgggaacggaatttaccctcaccatttcctcgctgcaacctgatgattttgctacctattactgcttccagggtagtggctaccctttcacttttggtggtggcactaagctggagattaagagaactgtggcggcaccatcagtgtttatcttcccgccaagcgatgagcagttgaagtcgggaactgcttctgtcgtgtgtttgttgaacaacttctaccccagagaggccaaggtgcagtggaaggtggataacgcactgcaatccggtaattcacaagaatcagtcactgaacaggacagcaaagactcgacgtactcactttcatcgaccctgaccctgtcgaaggcggactacgaaaaacacaaggtgtacgcgtgcgaagtcacccatcagggtttgagctcccctgtcactaagtcgtttaatcggggagaatgt

SEQ ID NO: 15261 - DNA, 711 bp, Artificial Sequence
  Description of Artificial Sequence: Synthetic coding sequence
atggctgtgatggccccacggactctcgtgctgttgttatctggagctctggccctgacccaaacctgggcggacattcagatgacccagtctccctcaacgctgtctgcatccgttggcgaccgcgtaacgatcacttgcaagtgtcagctgagcgttggttacatgcactggtatcagcaaaaaccaggaaaggccccgaaactcctgatctacgatacatctaagctcgcaagcggtgtgcccagcaggttctctggcagtggatctgggactgagttcactctcacaatatcctctctgcagcctgacgacttcgccacctactattgttttcagggcagcggctatccgtttacttttggtggaggcactaagctcgaaattaagcggaccgtggcagctccatcagtctttatcttcccaccatctgacgaacagctgaaaagtggtactgcatcagtggtgtgtctgctgaacaatttctatccccgggaggccaaggtccagtggaaggtcgacaacgccctgcagtccggcaacagccaagagtccgtaaccgagcaggatagcaaagacagcacatacagcctatcatctactctcactctgagcaaagcagattatgaaaagcataaggtttacgcctgcgaagtcactcaccagggcctctcctcacccgtaaccaagagttttaatcgaggggaatgc

SEQ ID NO: 15262 - DNA, 711 bp, Artificial Sequence
  Description of Artificial Sequence: Synthetic coding sequence
atggcagtcatggcaccccgcacgctcgtccttctgctcagcggtgcgctcgccttgactcagacctgggcggatatccaaatgactcagtcgccatcgactctgtcggcctctgtcggtgatagggtgaccattacttgcaaatgccagctgtcggtgggatatatgcactggtaccagcaaaagcccggaaaggcgcctaaacttttgatctacgacacctccaaattggcatccggagtcccttcacggttttcggggtcgggatcgggaactgaatttacccttacgatctcgtcacttcagccggatgacttcgcaacctattactgctttcaagggtccggttacccttttacttttggcggtggaactaaactggagattaagcgaaccgtggcagcccccagcgtgttcatattcccaccatccgatgaacagctcaagtcgggcaccgcctcagttgtgtgtctccttaacaatttctacccgagagaagccaaagtgcaatggaaagtggataacgcactccaatccggaaattcccaagaatcggtcaccgagcaagattcgaaagatagcacctactcactttcgtccactcttaccctgtcaaaggcggactacgagaaacataaggtgtacgcatgcgaagtgacccatcagggactttcctcccctgtgactaagagctttaaccgtggagaatgc

SEQ ID NO: 15263 - DNA, 711 bp, Artificial Sequence
  Description of Artificial Sequence: Synthetic coding sequence
atggctgtcatggctccccgcacgttggtgcttctactgtccggcgctttagcactcactcaaacgtgggcagatatccagatgacgcagtctccctcgaccctctctgctagtgtcggggatagggtgaccatcacctgcaagtgccagctgtctgtcggttatatgcattggtaccagcagaagccgggtaaagccccgaagcttctcatctacgacaccagcaagctcgcctctggagtgccctctcgcttctcgggtagcggcagcggcaccgagttcaccctcaccatttcttcactgcaaccggacgatttcgcaacttactactgcttccagggaagcggttacccttttactttcggtggaggaaccaagttggagatcaagcgtacggtcgctgctcctagtgtcttcattttcccccctagcgatgagcaactcaaatctggcaccgccagcgtcgtctgcctcctgaacaacttttatccacgtgaagctaaggtgcagtggaaggtcgacaatgcacttcagagtggcaattctcaagagagcgtcaccgaacaggacagcaaggattcgacttactctctgtcgtccaccctcaccttgtccaaggccgactacgaaaagcataaggtctatgcctgtgaggtcacacaccagggcctcagctcgccagtgacgaagtcctttaaccggggagagtgc

SEQ ID NO: 15264 - DNA, 711 bp, Artificial Sequence
  Description of Artificial Sequence: Synthetic coding sequence
atggccgtgatggccccacggactctggtgctgctcctgtctggcgccctggcactcacccaaacctgggccgatatccagatgactcagtcaccgagcacgctgtcagccagtgtgggggaccgcgtgacgataacgtgcaagtgccagctcagcgtcggatatatgcactggtaccagcagaagccgggcaaggccccgaagttgctgatctacgatacctccaaactggcatcgggtgtgccgtcgaggttctccggaagcggctcgggaactgagttcactctgaccatctcatcactgcagccggatgatttcgcgacgtactactgcttccaaggttccggttacccctttacttttggaggcggaaccaaactcgaaatcaagcggaccgttgccgccccatccgtgtttatcttcccaccgtcggatgaacaactgaaatcgggcaccgctagcgtggtctgtctgctcaataacttttacccgcgggaggccaaggtgcagtggaaagtcgacaatgcgctgcaaagcggaaattcccaggaatcggtgactgaacaggattcaaaagattcaacctactcgctgtcctcaaccctcaccctgtccaaggctgactacgagaagcataaagtctacgcttgcgaggtcactcaccaaggactgtcatcgcccgtcaccaagtcctttaaccggggagagtgc

SEQ ID NO: 15265 - DNA, 711 bp, Artificial Sequence
  Description of Artificial Sequence: Synthetic coding sequence
atggcggttatggcgccgcgtacgttagtactattactatcgggtgcgttagcgttaacgcaaacgtgggcggatatacaaatgacgcaatcgccgtcgacgttatcggcgtcggttggtgatcgagtaacgataacgtgtaaatgtcaattatcggtaggttatatgcattggtatcaacaaaaaccgggtaaagcgccgaaactattaatatatgatacgtcgaaactagcgtcgggtgttccgtcgcgtttttcgggttcgggttcgggtacggaatttacgttaacgatatcgtcgttacaaccggatgattttgcgacgtattattgttttcaaggttcgggttatccgtttacgtttggtggtggtacgaaactagaaataaaacgaacggtagcggcgccgtcggtatttatatttccgccgtcggatgaacaactaaaatcgggtacggcgtcggtagtttgtctattaaataatttttatccgcgtgaagcgaaagttcaatggaaagtagataatgcgttacaatcgggtaattcgcaagaatcggtaacggaacaagattcgaaagattcgacgtattcgttatcgtcgacgttaacgctatcgaaagcggattatgaaaaacataaagtatatgcgtgtgaagttacgcatcaaggtctatcgtcgccggttacgaaatcgtttaatcgtggtgaatgt

SEQ ID NO: 15266 - DNA, 711 bp, Artificial Sequence
  Description of Artificial Sequence: Synthetic coding sequence
atggccgtaatggcccccagaacgcttgtgttgttgctgtcaggagccctcgcactgacacaaacgtgggcagatatccagatgacccaaagtccatcaacccttagcgccagcgtcggcgacagagttactattacatgcaaatgtcagctcagcgttggttatatgcactggtaccagcagaagccgggcaaagctcccaaacttcttatttatgatactagcaagttggccagtggcgtacctagccgtttcagcggttccggatccggcacagagttcactttgacaattagctcactgcaaccggatgactttgctacttactattgcttccaggggtcagggtatccattcacattcggaggcgggaccaagttagagatcaaacgaaccgtggccgctccaagtgtatttatttttcctccgtccgacgaacaactcaagagcgggactgcgtcagtggtttgcctcctaaataatttttatcctcgtgaagctaaagtgcagtggaaggtagacaatgccctgcagagcggcaatagccaggaatctgttacagagcaggacagtaaagactcaacgtacagcctgagcagtacattgacgttgtccaaggctgactatgagaaacataaagtgtatgcctgtgaggtgacccatcagggtctatcctcacctgtgactaaatcctttaaccgcggcgagtgc

SEQ ID NO: 15267 - DNA, 711 bp, Artificial Sequence
  Description of Artificial Sequence: Synthetic coding sequence
atggcggtgatggcacctcggactttggtgttgctgctctccggcgccctcgcgctcactcaaacatgggctgacatacaaatgacccaaagtccgtctacactgtcggctagcgttggagatagagtcaccattacgtgcaagtgtcagctaagcgttgggtacatgcactggtaccagcagaagccaggaaaggccccaaagttgctgatttacgacacaagcaagcttgcgtctggcgtccctagtcgcttctctgggtccggatctggcaccgaattcaccctcacaatcagctcattgcagccagacgatttcgctacgtattattgcttccagggaagcggatacccctttacgtttgggggcggcaccaaactggagattaaaagaactgttgcagccccctccgtgttcatctttcccccttctgatgaacagctaaagtcaggcaccgcttcagtcgtatgtctcctgaacaatttttaccctagagaggcaaaagtgcagtggaaagtggacaatgcactgcagtcgggcaattctcaggagtccgtgactgaacaggacagtaaggactccacctatagcctgtcctcaaccctgacattatccaaagcagattatgagaagcacaaggtttacgcatgcgaggtaacacaccaggggctgagctccccagtaacgaaatcgttcaatcgaggggagtgc

SEQ ID NO: 15268 - DNA, 711 bp, Artificial Sequence
  Description of Artificial Sequence: Synthetic coding sequence
atggctgtcatggctccacggaccctcgttctactgctgtccggcgcgctcgctcttacccagacttgggccgatatccagatgacacagagcccaagcaccctgagtgcctctgtcggcgacagggttaccatcacatgcaagtgccagttgtctgtgggatacatgcactggtaccagcagaaacccgggaaggctccaaagcttctgatctacgacacctcaaaacttgccagtggcgttccctcgcggttttctggcagcggatcaggaactgaattcaccctcaccatttcctcgctgcagccagacgactttgccacttactattgctttcagggaagcggctacccatttactttcggaggaggcaccaaactggagatcaaacgcacagtagccgccccaagtgttttcatcttccccccatctgatgaacagctgaaatcgggcacggcatccgtagtgtgtctcctaaacaacttttacccaagggaggctaaggtccagtggaaggtggataacgcccttcagtcagggaactctcaagaaagtgttacggaacaggacagtaaagattctacctacagcctgagcagcaccctgactttgtctaaggctgattacgagaagcacaaggtttacgcatgtgaagtgacacaccagggcctgagctcaccggtgaccaaatctttcaaccggggcgaatgc

SEQ ID NO: 15269 - DNA, 711 bp, Artificial Sequence
  Description of Artificial Sequence: Synthetic coding sequence
atggccgtgatggctcccaggactttggtcctcttgttaagtggcgcccttgctctgacccagacctgggccgacattcagatgacacagtccccgtctacactttcagcgtccgttggagaccgcgtcacgatcacttgtaagtgtcaattgagcgtggggtatatgcactggtaccagcagaagcctgggaaagcacctaagttgcttatctacgacacatctaagctggcctcaggagtcccctcccggttttcagggtcgggaagcggcaccgagttcacactgaccatatcctcccttcagccggacgactttgccacctattactgctttcagggaagcggctatccttttacattcggaggcggcaccaagcttgaaatcaagcgcaccgtcgctgcgcccagtgtatttatattcccgccctctgatgagcagctgaagtctggaaccgcatctgtggtctgtctgctcaataatttctatcccagggaagcaaaggtacagtggaaagtcgataacgccttacagtcaggcaacagccaagagtccgtgacggagcaggattctaaagacagtacttattccctctccagcaccctcacgttgtcgaaagctgactatgagaagcataaagtatatgcctgtgaagtaacacaccagggactgtcctccccagtcactaaatcatttaacagaggcgagtgc

SEQ ID NO: 15270 - DNA, 711 bp, Artificial Sequence
  Description of Artificial Sequence: Synthetic coding sequence
atggcagtcatggcgccaagaacccttgtcctgctgctgtcgggagcactggcattgactcagacctgggcagacatccagatgacccagtcaccttcgaccctctcggcctccgtcggtgatagggtcactatcacctgtaaatgtcagctttcagtgggctacatgcactggtaccaacaaaaaccgggcaaggctccaaagctgctcatatacgatacctcgaagctcgcatcaggtgtcccttcgaggttttccggaagcggatccgggaccgaattcaccctgaccatctcgtcactccagcccgatgactttgcaacctactactgttttcaaggaagcggatacccatttacctttggaggaggaactaagttggagattaagcgaaccgtggcagcgccttcggttttcatcttccctcctagcgatgagcaacttaagtcggggactgcatccgtggtttgtcttttgaacaacttttatcctcgggaagctaaggtgcaatggaaagtcgataatgcactgcaaagcggaaactcccaggaatcagtgacggaacaggactccaaagattccacgtactcactgtccagcactttgactctttccaaagccgattacgaaaaacacaaagtgtatgcatgtgaagtgacccaccagggcctgagcagccccgtgacgaaatccttcaaccggggagagtgc

SEQ ID NO: 15271 - DNA, 711 bp, Artificial Sequence
  Description of Artificial Sequence: Synthetic coding sequence
atggccgtgatggctcctcgcaccctcgttttgcttctgtctggggctcttgccttgactcaaacctgggctgatatacagatgacccagtctccctctaccctatctgcaagtgttggtgaccgcgtcacaatcacgtgcaagtgtcagttgtctgtggggtatatgcattggtaccagcagaaaccaggaaaggctccaaaactcctcatctacgacacctccaagttggcctcaggggtgccgagtcgtttcagtgggagcggttctgggaccgagttcactctgacaatcagtagcttgcaaccagacgatttcgcaacttactactgttttcaggggagcgggtacccattcacgttcggcggcggaactaagctggagattaagagaaccgtggccgcccctagtgtttttatcttccccccatcagatgaacagttaaagtccgggaccgcaagcgtggtttgcctacttaataacttttatccgcgggaggctaaggtccagtggaaagtggacaatgctttgcagagcggcaacagccaagagtcagtgactgaacaggattcgaaggattcaacttactccctttcttccactcttaccctgtcgaaggccgactatgagaagcataaagtctatgcatgcgaggttacccaccaaggactttcctctccagtgaccaagtccttcaataggggcgaatgc

SEQ ID NO: 15272 - DNA, 711 bp, Artificial Sequence
  Description of Artificial Sequence: Synthetic coding sequence
atggcagttatggctccaagaacacttgttttattattaagtggagctcttgcattaacccaaacttgggcagatattcaaatgacacaatcaccaagtacattatctgcatctgttggagacagagttaccattacctgtaaatgccaattaagtgttggttatatgcattggtatcaacaaaaaccaggtaaggctccaaaattattaatttatgatacatctaagttagcttcaggagttccatctagattttcaggatcaggttcaggtactgaatttacattaacaatttcatcattacaaccagatgatttcgcaacatattattgttttcaaggtagtggataccctttcactttcggaggaggaacaaagttggaaataaaacgaactgtcgctgctccatcagtattcatttttccaccatcagatgaacaacttaaatcaggaacagcttcagttgtttgtttgcttaataatttttatcctagagaagctaaagtacaatggaaagtggataatgcattgcaaagtgggaattcacaagaatctgttacagaacaagattcaaaagattcaacatattctcttagtagtacattaacattaagtaaagctgattacgaaaaacataaagtttatgcatgtgaagtaactcatcaaggactttcaagtccagttacaaaatcatttaatagaggtgaatgt

SEQ ID NO: 15273 - DNA, 711 bp, Artificial Sequence
  Description of Artificial Sequence: Synthetic coding sequence
atggccgtgatggcacctaggaccctggtcctgctgctttccggtgcacttgcactgacccagacttgggcagatatccaaatgactcagtcccctagcactctttcggcatcggtcggagacagagtgaccataacttgcaagtgtcaactgtcagtgggatacatgcactggtaccagcaaaagcccggaaaggcccctaaacttctgatttacgatacgtcgaagctggcatcaggcgtgccttcacgcttttcaggttcgggatcggggaccgagtttactcttaccatatcctcactccaaccggatgacttcgcaacgtattactgttttcaagggtcaggctaccctttcaccttcggcggaggtaccaaactggagattaagcgcacggtggccgcaccatcggtgtttatcttcccaccttcggatgaacagctgaagtccggaaccgcatccgtggtctgtctgctcaataacttttaccctcgggaagctaaggtccagtggaaagtcgacaacgcgctgcaatcaggtaacagccaagagtcagtgaccgagcaggattctaaggatagcacctactcgctcagctcgactcttaccctttcaaaggcagactacgagaaacataaggtctacgcatgtgaggtgacccaccaaggtttgtcgtcacctgttactaaatcatttaacagaggcgagtgc

SEQ ID NO: 15274 - DNA, 711 bp, Artificial Sequence
  Description of Artificial Sequence: Synthetic coding sequence
atggcggtgatggccccgcggacgctcgtcctgctgctcagcggagccctggccctcactcaaacctgggctgatatccaaatgactcagtcgccgagcactttgtcagcctctgtgggtgatcgagtcactattacgtgcaagtgtcagctgagcgtcggatatatgcactggtaccagcagaaaccaggtaaggcacccaaattgctgatctacgatactagcaaactggcatcgggagtccctagcagattcagcggatccggcagcggcaccgagttcactctcactatctcgtcactgcagccggacgacttcgccacgtactactgctttcagggatctggctacccgttcaccttcggaggaggtaccaagctggagatcaagaggactgtcgcggccccctccgtgtttatcttcccgccctccgatgaacaattgaagtccgggaccgcgagcgtggtgtgcctgttgaataacttttaccctcgtgaggctaaagtgcagtggaaggtggacaatgccctccaatcaggaaacagtcaggaatcggtcactgagcaggactcgaaagactcgacctactcattgtcgtccactcttaccctttccaaggcagactacgaaaagcataaggtttacgcgtgcgaagtaacccaccaaggcttgtccagcccggtgaccaagtcgttcaaccgcggggagtgt

SEQ ID NO: 15275 - DNA, 711 bp, Artificial Sequence
  Description of Artificial Sequence: Synthetic coding sequence
atggccgtgatggccccgcgcacccttgtgctgctcctgtccggggcgctggcgctgacccaaacttgggccgacatacagatgactcagagcccgagcacgctctctgcatcggtcggcgatcgggtcactattacctgcaagtgtcagctttcagtgggatatatgcactggtaccaacagaaaccgggaaaagcgcctaagctgttgatctatgacacgtcgaagctggcaagcggagtgccttcccgctttagcgggtcaggatcggggactgaattcacccttactatttcgtcccttcaaccagatgattttgccacttactactgcttccaggggagcggttacccattcactttcggaggtgggactaaactggagatcaagagaaccgtcgctgcaccttcggtgttcatcttcccaccatcggatgagcagctcaaatccggaaccgcgtccgtcgtctgcttgttgaacaatttctacccgcgcgaagcaaaagtgcaatggaaggtggataatgcgctccaatccggcaattctcaggagagcgtgaccgaacaagactcaaaggacagcacttactccctgtcatccaccctcactctctcgaaggcggattacgaaaagcacaaagtgtacgcctgcgaagtcacccatcagggacttagctcaccggtaaccaagtcgttcaaccgaggagagtgc

SEQ ID NO: 15276 - DNA, 711 bp, Artificial Sequence
  Description of Artificial Sequence: Synthetic coding sequence
atggctgtcatggcacctaggaccctcgttctgttgttgagtggcgccctggccttgacacagacatgggctgatatccaaatgacccagtccccttctactcttagcgcttccgtgggcgaccgtgtaactatcacctgtaagtgtcagttgagtgtcggctatatgcactggtaccagcagaaacctggaaaggctcctaagctgctgatttacgacactagtaagttggctagcggagttccctccagattctcaggaagcggttcaggcacagaattcacccttacaatcagttccctccagcctgatgacttcgcaacctattactgttttcagggatctggatatccatttaccttcggcggcggaaccaagttggaaattaaaaggaccgtcgcagccccatcagtgtttatctttcccccttccgacgaacagttgaagtcaggtactgcttccgtggtctgtttgctgaacaacttttaccctcgtgaggccaaggtgcagtggaaggtagacaatgcccttcagtcaggcaactcacaggagagcgtaacagaacaggattccaaggactctacatactccctgtctagcactctgactctctccaaggctgattatgagaagcataaggtatacgcatgcgaggttacccaccaaggtctctcttcccccgtgaccaagagttttaataggggcgaatgc

SEQ ID NO: 15277 - DNA, 711 bp, Artificial Sequence
  Description of Artificial Sequence: Synthetic coding sequence
atggcagtgatggcccctcgcaccttggtcctgcttctgtccggagcgcttgccctgactcaaacgtgggccgatatccagatgacccagtcgccgtcgaccctgtccgcgtccgttggcgaccgggtcaccattacttgcaagtgccagttgtcggttggctacatgcattggtatcagcagaagccggggaaggcaccgaagctcctcatctacgacacctccaagctcgcaagcggagtgccatccagattctcggggagcggttcgggaactgaattcaccctcactatttcaagcctccagccggatgactttgccacctactactgcttccaaggttcaggttaccctttcactttcggcggcgggaccaaacttgagatcaagcgtaccgtggcagctccttctgtgttcatctttccgccgtccgatgaacaactgaagtcgggcaccgccagcgtggtttgtctcctgaacaatttctacccgcgcgaagccaaggtgcagtggaaagtcgacaacgcgctgcaatcaggaaacagccaggaatcggtcactgagcaagactcgaaagacagcacctattcactttcctctacgctgaccctgagcaaggctgattacgaaaaacacaaggtgtacgcttgcgaggtcactcatcagggcttgtcgtcgcccgtgaccaaatcatttaacagaggggagtgt

SEQ ID NO: 15278 - DNA, 711 bp, Artificial Sequence
  Description of Artificial Sequence: Synthetic coding sequence
atggcagtcatggcccctcggacgcttgtgctgctgctctcgggcgcgcttgcattgactcagacctgggccgacatacaaatgacccagtccccgtctacgctgagcgcatccgtgggagacagagtcacgataacctgtaagtgtcaactgtccgtggggtacatgcactggtaccaacagaaacctggcaaagcacccaaacttctgatttacgataccagcaagctggcatcaggagtgccatcgcgcttttccggctccggttcggggactgaatttactctcacgatctctagcctgcaaccagacgacttcgcgacctattactgctttcagggatcgggttacccctttacctttggaggaggaaccaaactggagatcaagcgcaccgttgcagcgccatccgtgttcatttttcctccttccgacgaacaactgaaatccggaactgcatcggtggtctgtctccttaacaacttttaccccagggaggcaaaggttcagtggaaggtggataatgcacttcaatcgggtaactcccaggaatccgtgactgaacaagacagcaaggactccacctactcgctgtcctccacgctcactcttagcaaggccgactacgagaagcataaagtgtatgcatgcgaagtgacgcatcaaggcctttcgtcccctgtgactaagtcgttcaatcgtggtgaatgc

SEQ ID NO: 15279 - DNA, 711 bp, Artificial Sequence
  Description of Artificial Sequence: Synthetic coding sequence
atggcagtcatggctccccgaacgctggtgctcctgttgtccggcgccctcgcgttgacccagacctgggctgatatccaaatgactcaaagcccatctacattgtccgcctcggttggagaccgagttacaatcacctgtaaatgccagctgtctgttggctatatgcactggtaccaacagaagcccggaaaagctcctaagctgctgatttatgacactagcaagctcgcctccggagtgcctagccgattttccgggagtggaagcggaacggagtttaccctcactatctcttccctgcaacccgatgatttcgcaacctactattgctttcaaggttcaggatacccgtttactttcggcggtggcacaaaacttgaaatcaaaaggactgttgccgccccatccgtgttcatcttccccccgtctgatgagcaactgaaatccggcacagcctccgtcgtatgccttctcaataatttctacccaagggaggccaaggtgcagtggaaggtggacaacgctctacagagcggcaactctcaggagtcggtgactgaacaggatagcaaggactcaacatacagtttgagcagtacgttgactctctcaaaggcagactacgaaaagcacaaagtctatgcttgtgaagtgacacaccaagggctgtctagcccggttacaaaaagctttaacagaggcgaatgc

SEQ ID NO: 15280 - DNA, 711 bp, Artificial Sequence
  Description of Artificial Sequence: Synthetic coding sequence
atggcagtgatggcaccacggacgctggtcctgctgttgtcgggcgcactggcgctcactcagacctgggccgacatccaaatgacccagagtccaagcacgctgtcggcttcggtgggagatcgggtcaccatcacctgtaagtgtcagctgtccgtggggtacatgcactggtaccagcagaagccaggcaaagctcccaagctgctcatttacgacacctcaaagctggcgtcgggagtcccctccagattctcaggatccggcagcggcaccgaattcacccttaccatcagctcgctgcagccagatgacttcgctacctactactgcttccagggatccggatacccgtttactttcgggggcggaaccaaactcgaaatcaagcgcaccgtggctgccccttccgtgttcatttttccgccgagcgacgagcagctcaagtcgggaactgctagcgtcgtgtgcctgctgaataacttctaccctcgggaggccaaggtgcagtggaaagtcgacaatgctctccaaagcggcaattcacaggaatccgtgactgagcaagactcaaaggactccacctactccctttcttcgactctgaccctgtcgaaggcagactacgaaaaacacaaggtgtacgcctgcgaagtgactcatcaaggcctgtcgtccccagtcactaaatcctttaacaggggcgaatgc

SEQ ID NO: 15281 - DNA, 711 bp, Artificial Sequence
  Description of Artificial Sequence: Synthetic coding sequence
atggctgtgatggctccgcggacccttgtgctgctcctctcaggcgcactggccctgacgcaaacctgggcggatattcagatgactcagtcgccgtccaccctgtcggcctccgtaggcgatcgcgtgaccatcacctgtaagtgccaactctccgtcggatatatgcactggtaccagcaaaaaccaggcaaggcaccgaaactgctgatctacgatacttcgaagctggcctcgggggtgccgtcgagattttcgggttcagggtcaggaactgagttcactctgaccatctcgtccctgcagccggatgacttcgccacttactactgcttccagggaagcggatacccttttactttcggaggaggtactaagctggagatcaagcgcaccgtggccgcaccgagcgttttcatttttccgccatcggatgaacaactgaaatccggcaccgcaagcgtggtgtgcctccttaacaacttttatccgcgggaggcgaaagtgcaatggaaagttgacaacgcattgcagagcggaaactctcaggaatccgtcaccgaacaagactcgaaagactccacgtacagcctgagctcaacgctcacgctcagcaaggcggactacgaaaagcacaaggtgtacgcctgcgaggttacccatcagggcctttcttcgccggtgaccaaatctttcaaccggggagagtgc

SEQ ID NO: 15282 - DNA, 711 bp, Artificial Sequence
  Description of Artificial Sequence: Synthetic coding sequence
atggctgttatggctccacgtaccctggttttgctgttaagcggcgcactggcattaacccagacctgggccgatatccagatgacacaatccccatccactctgtccgcctcagtcggcgaccgggttactatcacctgcaagtgtcaactgtccgtgggctatatgcactggtatcaacagaaacctggcaaagcccccaagttactcatttatgatacatcaaaactcgctagtggcgtgcctagccgttttagtgggtctggcagcggcactgaattcacactaactatatcttctctacagccagacgatttcgctacatattactgctttcaggggtccggatatcctttcacttttgggggtggtactaagctcgaaataaagagaacagtggccgctccatccgtgtttatattccctcccagcgacgaacaattaaagtctgggactgcttctgtggtctgcctattaaacaacttctacccaagggaggctaaggtgcagtggaaggtcgacaatgccctccagagcggcaacagccaggagagcgttacagagcaggattccaaagattctacatacagtttatctagtactctgaccctgtcaaaagccgactatgaaaagcacaaagtatacgcttgtgaagtgacacaccagggattgtccagtcctgtgaccaaatcttttaaccgaggggagtgt

SEQ ID NO: 15283 - DNA, 711 bp, Artificial Sequence
  Description of Artificial Sequence: Synthetic coding sequence
atggcggtgatggcaccaagaaccctcgtcttgctgctgtccggggcgcttgccctcactcaaacctgggcggatattcagatgacccagtccccgtcaactctgtcggcatcggtgggagatcgggtgaccatcacgtgcaaatgtcagctcagcgtgggctacatgcactggtaccaacagaagccagggaaggcgcctaagttgctgatctacgacacctcaaaactggcctcgggggtcccgtcaaggttctcgggatccggatcggggaccgagttcaccctcactatctccagcctccagccggacgacttcgcaacctactattgcttccaaggctcaggatacccctttacttttgggggaggaactaagctggagatcaagcggactgtcgcagccccatccgtgttcatcttcccaccctccgatgaacagctgaagagcggaactgcatcggtggtctgccttctgaacaacttctaccctcgggaggccaaggttcaatggaaagtggacaacgcactgcaatccggcaattcccaagaatccgtgaccgaacaagactccaaggattcgacctactcactgtcgtccacgctcaccctgtcgaaggctgactacgaaaagcataaggtgtacgcatgcgaagtcacccaccagggcctttcgtccccggtgactaagagcttcaacagaggagagtgc

SEQ ID NO: 15284 - DNA, 711 bp, Artificial Sequence
  Description of Artificial Sequence: Synthetic coding sequence
atggcggtgatggcgccacggacattggtgctgctgctgtccggagctctggcattgactcaaacctgggccgacattcaaatgacccagtctccctccacactttcggcctccgtcggggatagggtcacgatcacttgcaagtgtcaactctctgtgggatatatgcactggtatcagcagaagccagggaaagccccgaaacttcttatctacgatacctccaagctggcgtctggagttccgtcacgcttctccggaagtggctccggcaccgaattcaccctgactattagctccctccagccagacgacttcgctacatactattgtttccagggatcagggtaccctttcacgttcggggggggcactaaactggaaatcaaacggacggtggccgccccatcagtgttcatctttccaccgtccgacgagcagcttaaatccggaacagcgagcgttgtatgtttacttaataatttctatccgagggaagccaaggttcagtggaaggtcgacaacgccctccaatccggcaactcacaggaatccgttacagaacaagatagcaaggactcaacctattccttatcaagtaccttgaccttgagtaaagccgactacgagaaacacaaggtttatgcctgtgaagtgactcatcaaggcctctcctcaccagtcaccaagagtttcaacagaggagaatgc

SEQ ID NO: 15285 - DNA, 711 bp, Artificial Sequence
  Description of Artificial Sequence: Synthetic coding sequence
atggcagtcatggcaccccggaccctagtgctgctccttagtggagctctggcactcacacagacttgggctgacatacagatgacgcagagtcccagcaccctgtccgccagcgtcggcgatcgcgtcactatcacctgcaagtgtcagttgtccgtaggatatatgcactggtaccagcagaagcccggaaaggcccccaagttactgatttacgacacgagcaagctggcgtccggggtgccatccagattctccggttccggttctggcacggagtttacgctgacgatttcgtccctccaacctgacgacttcgccacctactattgtttccagggatccggctatcctttcactttcgggggcggaacaaagctcgagatcaagcggactgtggcagcgccttcagttttcatctttccaccatccgacgagcaacttaagagtggcacagccagtgtggtatgcctgctgaataatttctatccccgcgaggccaaggttcagtggaaagtggacaacgcactgcagtctggtaactcccaagaatctgtgacagaacaggatagtaaagactccacttatagcctcagctctactctgactctttccaaggccgattacgagaagcacaaggtttatgcctgcgaggtgacccaccagggactctccagtcctgtcacaaaatccttcaaccggggggagtgc

SEQ ID NO: 15286 - DNA, 711 bp, Artificial Sequence
  Description of Artificial Sequence: Synthetic coding sequence
atggcagtcatggcaccccggacactagtccttcttctctccggagctctagcactcactcagacatgggcagatatccagatgacacagtctccctccacactgtctgcctccgtaggagatagggtgacaataacatgcaaatgtcagttaagtgtagggtatatgcattggtatcagcagaagcctgggaaagcacctaaactcctcatctacgatacaagtaaattagcctctggagttccctcgcgctttagtgggagtgggtccgggacagagtttactctcacaatctcgtcgctgcagcctgatgattttgcaacttattattgcttccagggatccggatatccattcacatttgggggaggaactaaactagaaattaaaagaactgtggcagctccctccgtcttcatctttcctccatccgatgaacagctaaaatccggaactgcctctgtggtgtgtttgctgaataacttctaccctagagaagccaaagtgcagtggaaggtggataacgctcttcagtcagggaattctcaggaatcagtgactgaacaggatagtaaagactccacatatagtcttagtagtacactcacattatcaaaggcagattatgagaagcataaagtctatgcctgcgaagtgacacatcagggattatcaagtcccgtcacaaaatcattcaatcggggggagtgt

SEQ ID NO: 15287 - DNA, 711 bp, Artificial Sequence
  Description of Artificial Sequence: Synthetic coding sequence
atggctgtcatggcacctagaacgttggttctgctgctctctggcgcgctcgccctgacccagacttgggccgacatccagatgacgcagtcgcccagcaccctgtccgcttcagtgggggatcgagtaaccatcacctgtaagtgccagctttccgtgggctacatgcattggtaccagcaaaagccaggaaaagctcccaagctccttatttatgacactagtaaactggcatcgggcgttcccagtagattctccggctcaggcagtgggacagaatttacactgacgatcagttcgctgcagccagacgatttcgccacctactactgtttccaagggagtgggtaccctttcaccttcggcggcgggacgaagctcgaaattaaaagaaccgtagccgcacctagcgtttttatctttccaccctccgacgagcagttgaaatctggaactgccagtgttgtttgtttgttaaacaacttctatcctcgggaggcgaaggtacaatggaaagtggataatgccctgcagagcgggaattcccaggaatctgttactgagcaggattctaaggattccacctactccctgtcttccaccctgacactcagtaaagcagactatgaaaagcacaaggtctatgcatgcgaagttacccaccagggcttatcctccccagtgacgaaaagcttcaatcgtggggaatgc

SEQ ID NO: 15288 - DNA, 711 bp, Artificial Sequence
  Description of Artificial Sequence: Synthetic coding sequence
atggccgttatggcaccccgtaccttagtgctgctcttgagcggtgctttggccctaacccaaacttgggctgatattcagatgacccagagtcctagcacccttagcgcctctgtaggagatcgtgttactatcacctgcaaatgccagctttctgtgggctacatgcattggtatcaacagaagcccggaaaagcacccaagctgcttatttacgacacctcaaaactggccagcggagtcccatctcgcttttccggctctggttcgggcaccgaatttaccttgaccatctcaagccttcaaccagatgatttcgctacttactattgctttcaaggctcaggataccctttcacattcgggggtggtaccaagctggagatcaaaaggacagtggcagcacccagcgtttttatatttcccccttcggatgagcaacttaagagcggcacagctagtgtagtgtgccttcttaacaacttctaccctagggaggccaaggtccagtggaaggtggataacgcacttcaaagcggcaatagccaagagtccgtcacagagcaggacagcaaggatagtacatacagcctctcctcaacccttacattatccaaggccgactacgagaaacacaaggtctacgcctgtgaggtcacccaccaggggctctcatcgccggtgaccaagtcattcaaccgtggagaatgc

SEQ ID NO: 15289 - DNA, 711 bp, Artificial Sequence
  Description of Artificial Sequence: Synthetic coding sequence
atggcagtgatggctccccgcacccttgtgctcctgctctcgggtgccctggcgcttacccagacttgggcagacatccagatgactcagagcccatcgacgctgtcagcctcagtcggagatagggtgactattacgtgcaagtgccagctctcagtgggatacatgcattggtaccaacaaaagccaggtaaggcacccaaactgttgatttacgatacctcaaaacttgcatcgggtgtgccttcacggttttcgggttcagggagcgggactgaatttacccttactatttcgagccttcaaccagatgacttcgccacttactactgttttcaaggttccggatatccattcacttttgggggtggcaccaagctggaaatcaagcgcactgtggccgcacctagcgtgttcatatttcctccttcggatgaacagctcaagtccggtactgcatcggtggtctgtctgctgaacaacttctaccctagagaagctaaggtccaatggaaagtggataacgcactgcaatcgggtaacagccaggagtcggtgaccgaacaggatagcaaggactcgacttactccctttcgtcaactctcaccctttccaaagcggactacgagaagcataaggtgtacgcatgtgaagtgacccatcaaggactttcctcaccagtgaccaaatcgtttaatcgaggggagtgc

SEQ ID NO: 15290 - DNA, 711 bp, Artificial Sequence
  Description of Artificial Sequence: Synthetic coding sequence
atggccgttatggctccacggactcttgtgctgctgctctccggagcactggcattgacccagacttgggccgatatccagatgacacagtcaccctcaacgctgagcgcaagtgtaggcgatagggtcaccatcacatgtaagtgtcagctctctgttggttatatgcattggtaccagcagaaacccggaaaggctccaaagctcctaatctacgatacatccaaactcgcgtcaggtgtcccgagccggttcagcggtagtggatccggaaccgaattcacgctgaccataagctcattgcagccagacgactttgcaacctactactgcttccaaggcagtggctatcctttcacgttcggcggcggtacaaaactggaaattaagagaaccgtcgcagctcctagcgtgtttattttcccaccctcagacgagcagctcaaatcagggactgcttccgtagtttgcctcctgaacaacttttacccacgcgaggccaaagtgcagtggaaggtggataatgccctgcaatcaggaaactctcaagaatcagtgacagagcaggattcaaaagatagtacttactcactgtcctccaccctgaccctgtcaaaagccgattatgaaaagcataaggtatacgcctgcgaagtcacccatcagggactgtcgtcacctgtcacgaaaagctttaaccggggggaatgt

SEQ ID NO: 15291 - DNA, 711 bp, Artificial Sequence
  Description of Artificial Sequence: Synthetic coding sequence
atggccgtcatggcaccaagaactctcgtgcttctgctctccggtgctctcgcgcttactcagacttgggcggatattcaaatgacccaatcaccttccacgctgtcggcgagcgtgggagacagagtcaccatcacttgtaagtgccagctttccgtcggttacatgcactggtaccagcaaaaaccgggaaaggcccccaagctgttgatctatgatactagcaagctcgcctccggcgtgccgtcccgctttagcggatctggaagcggaaccgagttcactcttactatttcttcgttgcagccagacgattttgcgacgtactactgctttcagggctccggatacccgttcactttcgggggtggcactaagctggaaatcaagagaactgtggctgcccctagcgtgttcatcttcccaccgagcgatgagcagctgaagtccggcaccgcttcggttgtgtgcctgctgaataacttctaccctagagaggccaaagtccagtggaaggtggacaacgctctgcagtcgggtaattcccaggagtcggttaccgaacaggacagcaaagattcaacctattccctgagcagcactctgaccctgtccaaggcagactacgaaaagcacaaagtctacgcgtgtgaggtgacccaccagggattgagctcaccagtaacgaagtccttcaataggggggaatgc

SEQ ID NO: 15292 - DNA, 711 bp, Artificial Sequence
  Description of Artificial Sequence: Synthetic coding sequence
atggcagtgatggccccgcgcaccctcgtccttctgttgtcaggagctctggcactgacccagacgtgggcggatatccagatgactcagtccccttcgactctcagcgcatcagtgggggatcgagtgaccatcacctgcaagtgtcagctttcagtgggctacatgcattggtaccaacagaagccgggcaaggctccgaagctcctgatctacgacacctccaaactggcgtccggcgtgccatcccgcttctccggcagcggttcgggcactgaattcacgttgactattagctccctgcaacccgacgactttgctacctactattgcttccaaggctccggatacccttttaccttcggcggagggacgaagctggaaatcaagcgcactgtcgcggccccttccgtgttcatcttcccgccgtcggacgagcagctcaagtccggaaccgcctctgtggtctgtctcctgaacaacttctacccgcgcgaggcaaaggttcagtggaaggtggacaatgcgcttcaatcgggtaactcacaggaatcggtgactgagcaggacagcaaagatagcacttacagcctctcaagcactctgaccctgtctaaagcggattacgagaagcacaaagtgtacgcatgcgaggtgacccaccagggactgtcaagccccgttacgaaatcattcaatcgcggggaatgc

SEQ ID NO: 15293 - DNA, 711 bp, Artificial Sequence
  Description of Artificial Sequence: Synthetic coding sequence
atggccgtgatggcaccacggaccctggtgcttctcctgtcgggagcactggcactcactcaaacctgggcggatatccaaatgacgcagtcaccgtcgaccctgagcgcatcggtcggcgatagagtgactataacctgcaagtgccaactgagcgtcggatacatgcactggtaccaacaaaagcctggtaaggcaccgaaacttttgatatacgatacttcgaaacttgcatcaggagtgccttcgcgcttctccggatcgggaagcggtactgaattcactctcaccatttcgtcactgcaacccgacgattttgcaacttactactgttttcagggctccggctacccttttaccttcggtggaggcaccaagctggagattaagcggactgtggccgcaccttcggtattcatatttcccccgtcggacgagcagcttaagtccggcactgcatcggttgtttgcttgcttaacaacttctatccaagagaagcgaaagtacagtggaaggtggacaatgcgctgcaaagcgggaattcacaagaatcagtgaccgagcaggactcgaaggactccacctactcactgagcagcacgcttacgcttagcaaggctgattacgagaaacacaaagtctacgcctgtgaggtgacccatcagggtctttccagcccggtgaccaagtcatttaaccgcggcgaatgt

SEQ ID NO: 15294 - DNA, 711 bp, Artificial Sequence
  Description of Artificial Sequence: Synthetic coding sequence
atggcggtgatggcaccaaggaccctggttctgctgctgtctggcgcacttgccctgacgcagacttgggcagacattcaaatgacccaaagcccctccactctttccgcatcagtcggagatcgtgtcaccattacgtgtaaatgtcagctcagcgttgggtacatgcattggtaccaacagaagcccggaaaagcccctaagttgctgatctacgatacctccaaactggcgtccggcgtcccctcaagattttcgggttcgggaagcggtaccgaatttaccctcaccattagctccctccagcctgacgatttcgccacgtactattgctttcaaggttcgggttaccccttcacttttggaggaggtactaagctggaaatcaagagaactgtggcagcaccaagcgttttcatctttccaccttcagatgaacagcttaagtccggcaccgcatcggttgtgtgccttctgaacaacttttaccctagagaggccaaggtccaatggaaggtggataatgcgctccaatcgggaaattcacaagagtccgtgacggaacaggattccaaagactcgacctactctctttcatccactctgactctgagcaaggctgactacgaaaagcacaaagtgtacgcatgtgaggtgacccatcaaggactctcgtcgccagttactaagtcctttaaccggggcgaatgt

SEQ ID NO: 15295 - DNA, 711 bp, Artificial Sequence
  Description of Artificial Sequence: Synthetic coding sequence
atggctgtgatggcccccagaactctggtgttgctgctctcgggcgccctggcgctgacccaaacttgggcggacatccaaatgacccagtcgccgtcaaccctgtctgcatcagtcggagatcgcgtgactatcacgtgcaaatgccagctctctgtaggatacatgcattggtaccagcagaagccgggaaaggcccctaagctgttgatatacgatacctcaaaacttgcgtccggagtgccctcgcggttctcggggtccggttcagggactgaatttaccctcaccatttccagcctccaaccggacgacttcgcgacctactactgtttccagggctccggttatccgtttaccttcggtggcggaactaagctggaaatcaagaggacggtcgctgcaccgagcgttttcatctttccaccttcagacgaacagctgaagagcggaactgcctcagtggtctgcctgctgaataacttctatccgcgagaggcaaaagtccagtggaaggtggataatgctcttcaatccgggaactcccaggaaagtgtgactgaacaggactccaaggattccacttacagtttgagctccacgcttacccttagcaaggcggattacgagaagcacaaggtgtacgcctgcgaggtgacccaccaaggcctgtcgagtccagtgacgaaatctttcaaccggggtgagtgt

SEQ ID NO: 15296 - DNA, 711 bp, Artificial Sequence
  Description of Artificial Sequence: Synthetic coding sequence
atggccgtaatggcccctcggacgctggtgcttctcctcagcggcgccctggcgctcacgcagacatgggcggacattcagatgacccagtcccccagcacattatcggcctctgtgggcgatcgcgtgactattacatgcaaatgccagctgtccgtgggatatatgcattggtatcagcagaagcccggcaaggctccgaagcttctgatctacgatactagcaaacttgcaagtggtgtgccatccagattctcgggatctgggagcgggacagaattcacacttactatctcctctctgcagcctgacgactttgctacctactactgcttccaggggtctgggtatccctttacctttggcggcgggacaaagctcgaaattaaacggacagtggcagcaccctcagtttttatctttccaccatctgatgagcaacttaagtcgggcactgcttccgtagtctgtctgctgaacaatttctaccctcgtgaagcaaaagtacagtggaaagtagacaatgcgttacaatctggcaattcccaagaaagcgtgactgagcaggactctaaagattctacctattcgttgagctccaccctgacattgagcaaagctgactacgagaaacacaaggtgtatgcatgcgaggtgacccaccaggggctgtcttccccggtaaccaagagcttcaaccggggtgagtgt

SEQ ID NO: 15297 - DNA, 711 bp, Artificial Sequence
  Description of Artificial Sequence: Synthetic coding sequence
atggcagtgatggcccctcgtacacttgttcttctacttagcggcgcactggctttaacccagacatgggcagacatccagatgacgcagtcaccctctacattatccgcaagcgtcggagatagagttactattacatgcaaatgccagctaagcgttggctatatgcattggtaccaacaaaaaccgggaaaagcacctaaattgcttatctacgatacatcaaagcttgcttcgggtgttccgagccggttttcaggctcgggaagtggaacagaatttacactgacaatttcatcattgcagcccgatgattttgcgacatattactgttttcaaggcagtggttatcccttcacatttggcggtggcacaaaacttgaaataaaacgtaccgtggcagctccgtctgtgtttatttttcctccgtctgatgaacaactgaagtcaggaacggcttctgtcgtttgcctgttaaacaacttttacccgcgggaagctaaagtccaatggaaagtggacaacgcgcttcaatccggaaattctcaagagtcagttacggaacaggactccaaggactctacatatagtctgtcgtctacactcactctgtctaaggctgactacgagaaacacaaagtgtatgcgtgtgaagtaacccatcagggactctccagcccagtcactaaaagctttaatcgaggcgaatgc

SEQ ID NO: 15298 - DNA, 711 bp, Artificial Sequence
  Description of Artificial Sequence: Synthetic coding sequence
atggcggttatggcccccaggactcttgtcctccttctgtcgggtgcgctcgccctgactcagacgtgggccgacatccagatgactcagtccccatcaactctgtctgcctccgtgggcgatcgcgtgactatcacctgcaaatgccagctgtcagtgggatacatgcactggtaccagcaaaaacctggcaaggcaccaaaactgctgatctacgacacctcgaagctggcctcgggagtaccgtcccgcttctctggcagcggaagtgggaccgagtttaccctcacgataagctcgcttcagccggacgactttgccacctattactgtttccaaggatcgggataccctttcaccttcggagggggcactaagctcgagattaagagaaccgtggccgccccatcagtgtttatcttcccaccgagcgatgagcaattgaagtccggaactgcgtccgtggtctgcttgctcaacaacttctacccgcgcgaagcaaaagtgcagtggaaagttgataacgctctgcagtctggcaattcccaggagtcagtcaccgaacaggactccaaggactcaacttactccctgtcctccactctcaccctgtccaaggccgactacgaaaagcacaaggtctacgcttgcgaagtcacccatcaaggactttcctcacccgtgactaagtcttttaaccgcggagaatgc

SEQ ID NO: 15299 - DNA, 711 bp, Artificial Sequence
  Description of Artificial Sequence: Synthetic coding sequence
atggctgtgatggcaccccgcacactcgtgctcctgttgtctggcgctctggcactgacacagacctgggctgacattcagatgacacagtctccatcaaccctgtcagcctctgttggcgacagggtgaccattacctgcaaatgtcagctgtctgtgggctatatgcattggtatcaacaaaagcctggcaaagctccgaaacttctcatctacgacacttccaagctggccagtggcgtgccatctcgattctcagggtccgggtccggaactgagttcacactcaccatctcttccttacaaccagatgactttgccacctattactgttttcagggctccgggtacccgttcaccttcggtggaggaactaagctggagattaagcggactgtagcggcccccagcgtgttcatttttcctccttccgacgagcagctaaaaagtgggaccgcgagcgtggtttgtctgctgaacaatttctatcctcgtgaagcaaaggtacagtggaaggtagataacgcccttcaaagtggaaactctcaggaaagtgtgacggagcaggattctaaggacagcacctatagcctgtcatccacgttaacgctgtcaaaagcagactatgaaaagcataaggtctacgcctgtgaggttacccatcaaggtctgagctcccccgttacaaaatctttcaatcgaggagagtgt

SEQ ID NO: 15300 - DNA, 711 bp, Artificial Sequence
  Description of Artificial Sequence: Synthetic coding sequence
atggcggttatggcgccgcgaaccttggtattgctgttgagcggtgctctggcattaacccaaacctgggcggatattcagatgactcagtctccatcgactctttcagcctccgtcggtgatagagtaaccataacatgcaagtgccagttgagtgtcgggtacatgcattggtatcagcagaagcccgggaaggctccaaaactccttatctacgatacgtctaagctggcatccggagttccctctaggttctcgggtagtgggagcggaacagagttcaccttaactatttcttccctgcagcccgatgactttgctacgtactattgtttccaagggtccggctacccgttcacctttggaggcggtactaagttggaaattaagcgtactgtggctgctccctctgtgttcatctttccgccttccgacgagcaacttaagagtggcaccgcatccgttgtttgtttgctgaacaacttttatcccagagaggccaaggttcagtggaaggtggataacgcgctacaatccggaaattcacaggagtccgtcacggaacaagacagtaaggattcgacctacagcttaagttccacattgactctatccaaggccgactacgagaagcacaaggtatacgcttgcgaggtcactcaccaggggctgtcttctccggtgaccaagtcgttcaaccgtggagagtgc

SEQ ID NO: 15301 - DNA, 711 bp, Artificial Sequence
  Description of Artificial Sequence: Synthetic coding sequence
atggcagttatggcgcccagaacattggtcctcctgctgtcgggcgccctggccctcacacaaacttgggcagacatccagatgactcagagtccttctacactgtcagcctcagtgggtgaccgggtcaccatcacttgcaaatgccaactgagtgtgggctacatgcactggtatcagcagaaacctggtaaggcaccgaagctgttgatttacgatacctctaagctggcctccggggtgcccagccgctttagtgggtctgggagtgggaccgaattcactttgaccatatcctcactgcaacctgatgactttgccacctactactgctttcagggcagtggatatcctttcaccttcgggggaggcacgaaattggagattaaacggaccgttgccgccccaagtgtgtttatcttcccaccttctgatgaacagctgaagagtggcaccgcgtctgtagtatgcctgctaaacaacttttatccacgagaggcgaaagtgcaatggaaagttgacaacgccctccagtcagggaattcccaggaatcggttactgagcaggactccaaagattccacatactctttatcttccacactgacattgagcaaggcagattatgaaaagcataaggtgtatgcttgcgaagtgacgcatcagggcctttcctcccctgtgacaaagtcattcaacaggggggagtgt

SEQ ID NO: 15302 - DNA, 711 bp, Artificial Sequence
  Description of Artificial Sequence: Synthetic coding sequence
atggcggtgatggctccccggactcttgtactcctcctttccggcgcgctggcccttacacagacttgggctgacatccagatgacccaatccccttctactctgagtgcttctgtgggagacagggtgacaatcacttgtaagtgccaactgagcgtgggctatatgcactggtaccagcagaagcccggcaaagcccccaagctgttaatttacgacaccagcaaactggcaagcggggtgccttctagattttcaggctccggatctggcacagaatttacgctgacgatctcaagcctccagcccgacgacttcgctacctactattgcttccaaggatccgggtatccattcaccttcggaggagggactaagctggagatcaaaagaacagtcgctgcaccctccgtgttcatctttccacccagtgacgagcaactgaagagcggaacagcatcagtagtgtgcctacttaataacttctatcccagggaggctaaggtgcagtggaaagtcgacaatgcgctgcagagcggaaactcgcaggaatccgtgaccgaacaggattccaaagattctacatattccctctcatcaacccttaccctaagtaaggctgattacgagaagcataaggtatatgcttgcgaggtgacccatcagggcttgtcatctccagtcactaagtcatttaatagaggcgagtgc

SEQ ID NO: 15303 - DNA, 711 bp, Artificial Sequence
  Description of Artificial Sequence: Synthetic coding sequence
atggcggttatggctccgcgtaccctggtgctgctcctgtcgggcgccctcgccctgacccagacatgggctgacatccaaatgacccaatcgccttctaccctgagcgccagcgttggcgacagggttactattacttgtaagtgccaactgagcgtgggatacatgcactggtaccagcagaagccgggaaaagcacccaaactcctgatctatgacacttctaaactggcctcaggcgtgccctctcggttttctggatctggcagcggaacagagttcactctcaccatctcttctctgcagccagatgacttcgccacgtactactgttttcagggcagtggctatcccttcacctttggaggaggtactaaattggaaatcaagagaacagtcgctgcgccttccgtcttcatcttcccaccctccgatgaacagctaaaaagtgggaccgcctcggtcgtgtgcttgctgaacaatttttaccctagagaagcgaaagttcagtggaaagttgacaacgcactgcagtctggtaatagccaagaaagtgttacggagcaggacagcaaggactccacatactctttaagtagcacgctaaccctgtccaaggccgattacgagaaacacaaagtctacgcttgtgaggtgacccaccagggtctttcctctcccgtgaccaagtcttttaatcgtggcgagtgt

SEQ ID NO: 15304 - DNA, 711 bp, Artificial Sequence
  Description of Artificial Sequence: Synthetic coding sequence
atggccgtgatggcgcctagaactctggtgttgctcctgtccggagcactggcactgacccagacttgggccgacattcaaatgactcaatcaccttcaacgttgtcggcctccgtgggtgaccgcgtgaccatcacctgtaagtgtcagttgtccgtcggatacatgcattggtaccagcagaagccgggaaaggctccaaaactgttgatctatgatacctcgaaactggcaagcggagtgccctcgcgcttctcgggctcgggaagcgggaccgagtttactctgactatctcatccctgcagccggatgatttcgctacgtactactgcttccagggcagcgggtacccctttaccttcggtgggggcaccaagctggagatcaaacgcaccgtggcggccccatccgtgtttatcttcccgccatccgacgagcagctcaaatcgggaactgcctcggtagtgtgcctcctgaacaatttctacccccgcgaagccaaagtgcagtggaaagtcgacaatgcactgcaaagcggaaattcacaggagagtgtcaccgaacaagactctaaggatagcacttactccctctcgagcactctcactctgtcgaaagccgactacgagaagcataaagtctacgcttgcgaggtgactcaccagggtctgagctccccagtcaccaaatcattcaataggggggagtgc

SEQ ID NO: 15305 - DNA, 714 bp, Artificial Sequence
  Description of Artificial Sequence: Synthetic coding sequence
atggcagtgatggcaccacgcacactggtcctcctgctctctggcgccctggccctgacgcaaacatgggccgatattcagatgacccagtctccaagttccttgagtgcatccgtcggggatcgcgtcacgatcacttgtcgggccagtcaggatgtgaatactgcggtcgcatggtatcagcagaagcccggaaaggctccgaaactgctgatttactcagctagttttttgtacagtggtgtgccctcccgtttctctggcagcagatcgggcactgatttcacactgactatttcctccctgcagcctgaggactttgccacatattattgccagcaacattacaccacccctccgacgttcgggcagggaacaaaggttgagatcaagaggaccgtcgccgcaccctctgtctttattttccctcccagtgacgagcaattaaagagtggcacagctagtgttgtgtgcctgttaaataacttttatccacgcgaagccaaagtccaatggaaagtcgacaacgcgctgcagtcaggaaattctcaggagtcagtgactgagcaggactcgaaggattcaacatactccctgagctccactctgaccctgtctaaggctgactatgagaaacacaaagtctatgcgtgtgaagtcactcaccagggattgtcatcccctgttacaaagtcgttcaatcgcggcgagtgt

SEQ ID NO: 15306 - DNA, 714 bp, Artificial Sequence
  Description of Artificial Sequence: Synthetic coding sequence
atggccgttatggctcccagaaccttggtgctgctgctctcaggcgctttagccttgacacagacgtgggctgatattcagatgacccaatctccgtcgtctttatccgcgtcagttggggatcgggtgaccataacatgtagggccagtcaagacgtgaatactgccgttgcttggtaccagcagaagcctgggaaagctccaaaacttttgatttactctgcatctttcttgtatagcggggtgcccagcaggttttccggatctagatccggcaccgacttcactctgacaatcagcagccttcagccagaagattttgcaacatactactgtcagcagcattacactaccccaccgacgtttggtcaagggaccaaggtggagattaaacggactgttgccgccccctccgttttcattttccctccatctgatgaacagcttaagtccgggaccgcgtccgtggtgtgtcttctcaataatttctatcccagggaagcaaaggtgcaatggaaagtggacaacgcacttcaaagcgggaacagtcaggagtctgttacagagcaggactctaaggacagcacgtacagtctatcgagtacactaacgctgtctaaagccgactacgaaaagcataaagtctacgcctgcgaagtgacacaccagggtctgagttctccggtgactaagtccttcaataggggggagtgc

SEQ ID NO: 15307 - DNA, 714 bp, Artificial Sequence
  Description of Artificial Sequence: Synthetic coding sequence
atggcggttatggccccccggaccctcgtgctcctgctgtcgggtgcgctcgcactgactcaaacctgggccgacatacaaatgacccagtcaccttcgagcctctccgcttccgtgggagatcgcgtcaccatcacgtgtcgggcgagccaggatgtgaacactgcagtcgcatggtaccagcagaagccaggcaaggccccgaaactcttgatctatagcgcctccttcctctactccggagtgccgagccggttctccggatcgcgctctggcactgactttaccctgactatttcctcgctgcagccagaggattttgctacctactactgccagcaacactacaccactcctccgacttttggacaaggaaccaaggtggaaatcaagcgcaccgtggcagctccttctgttttcatcttcccgccttccgatgaacagttgaaatcagggacggcttctgtcgtgtgcctcctgaataacttctacccaagagaagccaaagtgcagtggaaggtcgacaacgccctccagtccggaaacagccaagaatcagtgaccgagcaagactcaaaggacagcacgtactctctttcgtccactctgaccctgtcaaaagcagactacgaaaagcacaaggtgtatgcttgtgaggtgacccatcagggtctttcctcgcccgtgactaagtccttcaataggggcgagtgc

SEQ ID NO: 15308 - DNA, 714 bp, Artificial Sequence
  Description of Artificial Sequence: Synthetic coding sequence
atggcagtcatggcccctcggactctcgtgctgctgctgtctggggcactggccctgacgcaaacgtgggcggatatccaaatgacccaatcaccgtcgtccctgtccgcgtccgtcggagatcgcgtgactattacctgccgggcaagccaggacgtgaacactgcagtggcctggtaccagcagaaacctgggaaagcacctaagttgctgatctacagcgcatcattcctgtactctggagtgccatcaagattcagcggatcccggagcggaaccgacttcaccctcaccatctcgtcactgcagccagaggacttcgcgacttactactgtcagcagcattataccactccgccaactttcgggcagggcacgaaggtcgaaatcaaacgcactgtggccgctccgtcagtgttcatctttccaccctcagatgagcagctcaaatcgggaaccgcttccgtggtctgcctgttgaataacttctacccgcgcgaggcgaaagtgcaatggaaagttgacaacgccttgcagtcgggcaattcgcaggaatcggtgactgagcaggactctaaggattcgacctactcgctgtcaagcactctcacgctgtccaaggctgactacgaaaagcacaaggtgtacgcttgtgaggtcacccaccagggactgtcctcgccggtcactaagagcttcaatcgcggagagtgt

SEQ ID NO: 15309 - DNA, 714 bp, Artificial Sequence
  Description of Artificial Sequence: Synthetic coding sequence
atggcagtgatggcaccccgcactctcgtgctgctcctttcaggagcactggctctcacgcaaacttgggcagatattcagatgacccagtcaccttccagcttgtcggcttcggtgggagatcgggtgacgattacctgtagagcgtcacaagatgtgaataccgcagtggcatggtatcaacagaaacccggaaaggcacctaaacttctgatttacagcgccagctttctgtactccggtgtgccatcgaggttctccggttcgcgtagcggaaccgattttaccttgaccatctcaagcctgcaaccagaagattttgcaacttactactgtcaacagcactacactacccctccgaccttcggccagggaaccaaggtggagattaagcgaactgttgccgcaccctccgtattcattttccctccctcggacgagcagcttaaatctggaacggcgagcgtggtgtgtctgctgaataacttctacccacgcgaagcaaaggtccagtggaaggtcgataacgcactgcagagcggtaactcacaggagtcggtcactgaacaagatagcaaagacagcacttactcactgtcgtccacgctgactctttccaaagcagattacgaaaagcacaaggtgtacgcatgtgaagtgacgcatcaagggctgtcgtcgcccgtcaccaaatcattcaatagaggcgaatgt

SEQ ID NO: 15310 - DNA, 714 bp, Artificial Sequence
  Description of Artificial Sequence: Synthetic coding sequence
atggccgtgatggcaccgcgcactttggttcttctgctctcgggagcactggcgctgactcagacttgggccgacatccagatgacccagtccccgtcctcgttgtcggcatcagtgggggacagagtgaccatcacctgccgcgcctctcaagacgtgaatactgcagtggcatggtaccaacagaagcctggcaaagcgccgaagctcctcatctactcagccagctttctgtactcgggtgtccctagccgctttagcgggtcccggtccggtactgacttcactctcacgatctcaagcctgcagcccgaggacttcgctacttattactgccagcagcattacactacgccgcctactttcggtcagggaaccaaggtggaaatcaagcgcactgtcgctgcgcccagcgtctttatcttccctcctagcgacgaacagctgaagtccggaactgcaagcgtcgtctgcctcctcaacaacttttacccgagggaagcgaaggtgcagtggaaggtggataacgccctccaatcaggaaactcgcaggaatcggtcactgaacaggatagcaaggactctacgtattcgcttagttcgactctgaccctttcaaaagctgattacgaaaagcacaaagtctacgcgtgcgaggtgacccatcaaggactgtcctcacccgtgaccaaatccttcaatcgcggggaatgc

SEQ ID NO: 15311 - DNA, 714 bp, Artificial Sequence
  Description of Artificial Sequence: Synthetic coding sequence
atggctgtcatggcgccacgcacactggtgcttctgctgagcggtgctctggccctgacccagacctgggccgatattcagatgacacaaagcccatccagcctgtcggcgtctgtaggcgaccgcgtaacgattacgtgtcgggcaagtcaggacgtaaacacggctgtggcctggtatcagcagaagccaggcaaggcgcccaagcttctgatctactccgcgagctttctctattccggagtcccttcgcgcttttccggtagccgctcaggcacggacttcacattgacgatttcttctttgcagcctgaggacttcgcgacgtactactgccaacagcactataccacgcctccaacgtttggccagggtactaaagtggagattaaaaggaccgttgcagctccgtccgtctttatttttcctccgtctgatgagcagctgaaaagcggcaccgcgagcgtcgtctgccttctgaacaatttctatccacgggaggcaaaagtgcagtggaaggtggataacgcattacagtctggtaacagccaggagagcgtcaccgaacaggatagcaaggatagcacgtactccctgtctagtactctcacgctgagcaaggccgattatgagaaacacaaggtttacgcgtgcgaagtgactcaccagggcctgtcgtccccagtcactaagtcttttaaccgtggtgaatgt

SEQ ID NO: 15312 - DNA, 714 bp, Artificial Sequence
  Description of Artificial Sequence: Synthetic coding sequence
atggctgtgatggccccacggactctcgtcttgctgttatccggggcactggccttgactcagacctgggccgatattcaaatgacccagtctccatcttccctcagtgcctctgttggtgatcgagtgactattacttgtcgcgcgtcccaggatgtgaatacggccgtcgcatggtatcagcagaaacccggcaaagctcccaaacttctcatttactccgctagctttctgtattccggggtgccgtcccgattctcaggatccaggtcagggacagatttcacactgacaattagctcattgcagcccgaggacttcgccacatattactgccagcaacattatactacacctcctacattcggccagggcactaaggttgagatcaaacgaacagtggcagctcccagcgtgttcattttcccacccagcgacgaacaactaaagtctggcactgcatctgttgtgtgcctcttgaataatttttacccgagagaggctaaggtccagtggaaggtggataatgccttacagtccggcaactcacaggaaagcgtgaccgagcaagactctaaggattctacttactccctgtctagtacattgacgttgtcaaaagctgattacgaaaagcataaggtgtacgcttgcgaggtgactcaccagggccttagtagccctgtgacaaagagcttcaataggggcgagtgc

SEQ ID NO: 15313 - DNA, 714 bp, Artificial Sequence
  Description of Artificial Sequence: Synthetic coding sequence
atggccgtgatggcaccccgcacccttgtgctcttgttgtccggcgcgctggcacttacgcagacctgggcggacatccaaatgacgcaaagcccttcatccctgagcgcatcggtgggtgatcgtgtgactattacctgtcgagcttcacaagatgtcaacacggcggtcgcatggtaccagcaaaagccgggcaaggcacccaagctgctcatatacagcgcatcgttcctgtactcgggagttccttcgagattctcaggttcacgtagcggaaccgactttacgcttactatctcctcgttgcaacctgaagattttgcgacttactactgtcagcagcattacactaccccgccaacgttcggacaaggtaccaaggtggagattaagagaaccgtcgctgcaccttcagtctttatctttcctccgtcggatgagcagcttaaatccggcactgcaagcgtggtgtgcctcctgaataacttttaccctcgcgaggcaaaagtacaatggaaggtggacaatgcactccagtccggaaactcacaagagtcggtcaccgaacaagattcgaaggattccacttattcgctcagctcaaccctgaccctttcaaaagctgattacgagaaacacaaagtctacgcatgtgaagtgactcatcagggtctttcgtcccctgtgaccaagtctttcaatcggggagaatgt

SEQ ID NO: 15314 - DNA, 714 bp, Artificial Sequence
  Description of Artificial Sequence: Synthetic coding sequence
atggcggtcatggcgcctagaacccttgttcttctgcttagcggagccctggctctgactcagacctgggcagatatccaaatgactcaatcgccttcctcactcagcgcatccgtgggcgaccgagtcactattacctgtagggcatcccaggatgtgaataccgcagtggcatggtaccaacaaaaacctggaaaggcacctaagttgctgatctactcggcatcctttctttactcaggagtcccatcgaggttttcagggtcacgatccggtactgacttcactcttactatttcaagccttcaacccgaggatttcgcaacttactactgtcaacaacattacaccactcctccaacctttggacaggggacgaaggtggaaatcaagcggacggtcgcagccccaagcgtctttatctttccgccttcggatgaacaacttaagtccggtactgctagcgtcgtgtgcctgctgaacaacttctaccctagagaagcaaaggtccaatggaaggtggacaacgctcttcagtcgggtaattcacaggaatccgtgaccgaacaagattccaaggactcgacttactcgctgtcatcgacgctcaccctgagcaaggcagattacgaaaagcataaagtctacgcttgcgaagtgacccatcaggggctttcatcccctgtgacgaagagctttaatcgcggagaatgt

SEQ ID NO: 15315 - DNA, 714 bp, Artificial Sequence
  Description of Artificial Sequence: Synthetic coding sequence
atggctgtgatggctccccggacactggtgctgttgctgtcaggggctctggctctcacgcagacctgggctgacatccagatgacccagtcaccttctagcctctctgccagcgtaggggacagagtcacaattacttgcagggccagccaggacgttaatacggctgtcgcatggtaccagcagaaacccggtaaagctcccaagcttctgatttactctgcgtcctttttatactccggtgtgccatctcggttctctggatccagatccggcaccgacttcacactgaccatatcatccttgcagcccgaggacttcgcaacctattactgtcagcaacactacacgaccccccctacgtttggacaaggcaccaaggtggagatcaaaagaactgtggcggctccctctgtcttcatcttcccaccctcagacgaacagctcaagagcgggactgccagtgtggtttgtctgttgaacaatttctatccaagggaagccaaggtccaatggaaggtcgataacgcgctgcaatccggcaattcccaggagagtgtcaccgagcaggattcaaaggattctacctattccttgtcaagtacactgaccctgagcaaagcggactatgagaaacataaggtgtacgcatgtgaggttacacatcagggtctgagcagtccagtgaccaaaagcttcaaccgcggggaatgt

SEQ ID NO: 15316 - DNA, 714 bp, Artificial Sequence
  Description of Artificial Sequence: Synthetic coding sequence
atggcggtcatggccccccggacactcgtactgctcttgagcggggcccttgccttgacccaaacttgggccgacatccaaatgacccagtccccgtccagcctttctgcaagcgttggagatagggtgacaattacctgccgagcctcacaggacgtcaataccgccgtggcctggtatcagcagaaaccaggcaaggctccgaagctgctgatttattctgcctctttcctgtactccggggtgccgagccgcttctccggaagccgtagtggaactgatttcacccttacaatatcctcgctgcaacccgaagactttgctacctactattgccagcagcattacacgacccctcctaccttcggacaagggaccaaggtggaaatcaaacgcacagtggcagcgccttccgtgttcattttccccccctccgacgagcaactcaagagcgggaccgcatccgtcgtgtgcctgctgaacaacttctatccccgcgaggcaaaagtgcagtggaaggtagacaatgccctgcaatctggcaattctcaggaatcggtaacagagcaggacagtaaagattccacatacagcctgtcctctaccctgactctaagcaaggctgattatgaaaagcataaagtctatgcatgcgaggttacccaccaggggctgagttcccccgtgaccaagtcctttaacaggggggagtgc

SEQ ID NO: 15317 - DNA, 714 bp, Artificial Sequence
  Description of Artificial Sequence: Synthetic coding sequence
atggcagtcatggctccccggaccctcgttctgctcttgtctggggcactcgccctgactcagacttgggctgacatccagatgacgcagtcgccgagctccctcagcgcatcagtcggggaccgggtcacgatcacctgtcgtgcttcgcaggacgtgaataccgctgtcgcgtggtaccaacaaaagccgggcaaagccccgaaactcctcatctactccgcgagctttttgtacagcggtgtgccatcaagattctccggctcaagatcgggaactgacttcacccttactatttcttccctgcagccggaagattttgccacttactactgccaacagcactataccacccctcccactttcggacaaggaacgaaggtggagatcaagcggactgtcgcggccccaagtgtgtttatctttccaccgagcgatgagcagttgaagtctgggaccgcgtccgtcgtatgcctgcttaacaatttctacccacgcgaagccaaggtccaatggaaggtggataacgcactgcagagcggtaacagccaggaaagcgtgacggaacaagattcgaaggactcaacttacagcctctcctcaacgctgactttgagcaaggcggactacgaaaagcataaagtttacgcatgcgaagtcactcaccagggcctgtcctctcctgtgacgaagagcttcaatagaggagagtgc

SEQ ID NO: 15318 - DNA, 714 bp, Artificial Sequence
  Description of Artificial Sequence: Synthetic coding sequence
atggctgtcatggcgccaagaactctggtgctgctgctctccggcgccttagcattaacccaaacctgggccgacatccagatgacccagagtcctagcagtcttagcgcctctgtgggagacagggtgactatcacatgtagagcatcacaggatgttaatactgctgttgcatggtaccagcagaagccagggaaggctcctaagctattgatctactccgcatcattcctgtatagcggcgtgccctctaggttttcaggatcccgcagcggcaccgatttcaccttaaccatttcatctttgcagccggaagactttgcaacttactactgccaacagcactatacaaccccacccacatttggccaggggactaaagtggaaattaagcggacggtggcagctccgtcagtctttattttccctccttctgacgaacagctcaaatccggtacagcctcagtggtgtgccttctgaataacttctatcctagagaggcaaaggttcaatggaaggtggataacgccctccagagcggcaattctcaggagagcgtgaccgaacaggatagcaaggactcaacttactccttgtcttctaccctaacgctatcaaaggccgactacgagaagcacaaagtctatgcatgcgaggtgacacaccaaggtcttagcagccccgtcaccaagagctttaatcgaggagaatgt

SEQ ID NO: 15319 - DNA, 714 bp, Artificial Sequence
  Description of Artificial Sequence: Synthetic coding sequence
atggcggttatggcgccgcgaacgctagtattactattatcgggtgcgctagcgttaacgcaaacgtgggcggatatacaaatgacgcaatcgccgtcgtcgctatcggcgtcggtaggtgatcgtgtaacgataacgtgtcgagcgtcgcaagatgtaaatacggcggtagcgtggtatcaacaaaaaccgggtaaagcgccgaaactattaatatattcggcgtcgtttttatattcgggtgttccgtcgcgattttcgggttcgcgttcgggtacggattttacgttaacgatatcgtcgctacaaccggaagattttgcgacgtattattgtcaacaacattatacgacgccgccgacgtttggtcaaggtacgaaagtagaaataaaacgtacggtagcggcgccgtcggtatttatatttccgccgtcggatgaacaactaaaatcgggtacggcgtcggttgtatgtttattaaataatttttatccgcgagaagcgaaagtacaatggaaagttgataatgcgttacaatcgggtaattcgcaagaatcggttacggaacaagattcgaaagattcgacgtattcgttatcgtcgacgctaacgttatcgaaagcggattatgaaaaacataaagtatatgcgtgtgaagtaacgcatcaaggtttatcgtcgccggttacgaaatcgtttaatcgtggtgaatgt

SEQ ID NO: 15320 - DNA, 714 bp, Artificial Sequence
  Description of Artificial Sequence: Synthetic coding sequence
atggccgtgatggccccacgcactttggtgctgttgttgtcaggcgctcttgcgcttacccagacttgggcggacatccagatgactcagtcacctagcagcttatccgcatctgtcggtgatcgcgtgacaattacttgtcgcgcctcccaggatgttaacacagctgtggcatggtaccagcagaagccagggaaggctcccaagctcctgatctatagtgcctcctttctctatagcggggtacccagccggttctccgggtctcgctctgggactgacttcacactcacaattagcagcctacaaccggaagatttcgctacctactattgtcagcagcactataccactcccccgactttcgggcagggaactaaggtggagattaagcgcactgtggcagcacctagcgtgttcatcttccctccttccgatgaacagctcaagtctggcactgctagcgtggtgtgcctcctgaataacttctacccaagagaagcaaaagtccagtggaaggtggataacgccctccagagcggaaacagtcaagagtccgtaacagaacaggactcaaaagactctacctattccctttctagcacactgaccctatctaaggctgattatgagaagcacaaagtgtatgcttgtgaggttacgcaccagggactttcaagtcccgtgacaaaaagctttaatagaggggagtgc

SEQ ID NO: 15321 - DNA, 714 bp, Artificial Sequence
  Description of Artificial Sequence: Synthetic coding sequence
atggctgtgatggcaccgaggactctggtccttctgctgtccggagctctcgccctgactcagacttgggccgatatacagatgacacagagcccatcctccctctcagcatcagtgggggaccgagtaaccatcacttgccgagctagtcaggatgttaatacagctgtggcctggtatcagcagaaaccagggaaggcgcctaagcttctcatatattcggcgtcctttctgtactctggagtgccatccaggttttccggctctcgatcaggaactgactttaccctaaccatttcaagccttcagcccgaggatttcgccacatattattgccagcaacattacactacaccacctaccttcgggcagggcacaaaggtcgaaattaaaaggacggtcgccgcgccatcagtgtttatcttccccccatcggatgagcagctgaagtcggggacggcctcagtggtttgtctacttaataacttctatccacgtgaggctaaagtgcagtggaaagttgacaatgctctacagagtggtaatagccaagaatctgtgaccgaacaggatagcaaagactcaacctacagcctctcttcaactctgacccttagcaaagccgactacgagaagcacaaagtttacgcatgtgaggtgacacaccaagggttgtccagccccgtaaccaagagcttcaaccgtggagagtgt

SEQ ID NO: 15322 - DNA, 714 bp, Artificial Sequence
  Description of Artificial Sequence: Synthetic coding sequence
atggctgtcatggccccgcggaccctggtccttctgctgagcggggcactcgccctgacccagacatgggccgacatacaaatgacgcagagcccatcaagcctttctgcctcagtgggcgaccgggtgacaattacatgcagggccagtcaggacgtgaatactgccgttgcttggtaccaacaaaaacccggcaaggcgcccaagcttctcatctactccgctagttttctgtatagtggcgtacccagcagattctctgggtccagaagcgggacagatttcacactgaccatctcctcactgcagccggaggactttgctacgtactattgccagcaacactatacaacaccgcccactttcgggcagggcaccaaagtcgagataaagagaacggtggccgcaccgtccgtgttcatcttcccaccgtctgacgagcaacttaaatctggcaccgcaagcgtagtctgccttcttaataacttctatccaagagaggctaaggttcagtggaaggtggataacgctcttcaaagcggaaatagtcaagaatccgttactgaacaagacagcaaagactcaacttacagcctttcttcaacgctgaccctgagcaaggctgattatgagaagcataaagtctacgcatgcgaggtgacccaccagggactgtcatcccctgtcaccaagtcattcaatcgaggagagtgc

SEQ ID NO: 15323 - DNA, 714 bp, Artificial Sequence
  Description of Artificial Sequence: Synthetic coding sequence
atggcagtcatggcccctagaacgctcgtgcttctgttgagcggtgcccttgccctcactcagacctgggccgacattcagatgacccagtcaccaagctcgctgtccgcttccgtcggtgaccgggtgacgattacttgtagagcaagccaagacgtcaataccgcagtggcatggtaccaacaaaagcctggaaaggcaccgaaactcctgatctatagcgcatccttcctgtactccggtgtgccgtcgagattttcgggatcccgctccgggactgattttacgctcaccattagctcccttcaaccagaagatttcgccacctactactgccagcagcactacactacccctcccacttttggtcaggggactaaggtcgagatcaagaggaccgttgcagcacccagcgtgttcatttttccacccagcgacgaacaattgaagagcgggactgcatctgtggtgtgccttcttaacaacttctacccacgagaagccaaggtgcagtggaaggtggataacgcgcttcagtcaggcaactcccaggaatcagtgacggagcaggattcaaaagactcgacttattccctgtcctcgactctcacgctgtcaaaggccgattacgagaagcataaggtttacgcctgtgaagtcacccatcaaggactcagctcgcccgtgactaagagctttaacagaggagagtgc

SEQ ID NO: 15324 - DNA, 714 bp, Artificial Sequence
  Description of Artificial Sequence: Synthetic coding sequence
atggccgtaatggccccacgcaccctagtcctgcttctgagcggtgctctagctctgacgcagacatgggccgacattcagatgacccagagtcctagctctctgtccgcaagtgtgggcgatcgggttacgatcacttgtcgggcgagccaggacgtgaacaccgcggtcgcatggtaccaacagaaacccggaaaggcgccgaagctgttgatttattcagcctcattcttgtactctggggttccttcacgattcagcggctcgaggtccggcactgattttactttgaccatatcatcactccagccggaggattttgcgacctattactgtcaacagcattacaccactccccctacttttggacagggcactaaggtggaaattaagcgaacagttgccgcccctagtgttttcatattccccccttcggatgagcagctgaagtcgggaaccgctagcgtggtgtgcctcctcaacaatttctatcccagggaagcgaaggtacagtggaaagtggacaatgctctgcaatccggcaattcacaggaaagtgttacggaacaagactccaaggactccacctacagtctcagctcaacactgacactctccaaggccgattatgagaagcacaaggtgtacgcctgcgaggtcactcatcaaggtctctcgagccccgtcacgaaatccttcaacagaggggaatgc

SEQ ID NO: 15325 - DNA, 714 bp, Artificial Sequence
  Description of Artificial Sequence: Synthetic coding sequence
atggccgtgatggctccacgcacgctggtgcttctgctctccggggccttagccctgactcagacctgggcagatatccagatgacacagagtccttcctctcttagcgccagtgtgggagatcgagttactataacctgcagggcgtcacaggacgtcaacaccgccgtggcctggtaccagcagaaaccaggcaaggctcctaaactccttatatactccgccagcttcctttactccggggtgcctagccggttcagtggaagtcggtccggaactgactttaccctgactatctcttctcttcagcccgaggacttcgccacctactactgtcaacaacactataccacccctccaacatttggccagggaactaaagtggaaatcaagcggaccgtggctgcgccttccgtctttatattccctcccagcgatgagcagctcaaatccggaaccgcttctgtggtgtgcctcttgaacaacttctatcctagagaagccaaggtccagtggaaggtcgataacgctctgcagtccggcaactcccaggaatccgtgaccgagcaggatagtaaagacagcacatatagcctgagctctactctcacgctgtcaaaggcagactatgagaagcataaggtgtacgcgtgcgaagtgactcaccaggggctttcgtcgcccgtgactaagagcttcaatagaggggaatgc

SEQ ID NO: 15326 - DNA, 714 bp, Artificial Sequence
  Description of Artificial Sequence: Synthetic coding sequence
atggccgtgatggcaccacggactctggtgctgcttctgtccggtgccttggcccttactcaaacctgggcagatattcagatgactcagtcaccctccagcctgtccgcctccgtgggcgaccgtgtcactattacctgtagggcatcgcaagatgtgaacaccgcagtcgcttggtatcagcaaaagccaggcaaggcacctaagctgctcatttactcagcatctttcctctacagcggtgtccccagcagattttccggatcaaggtcaggcactgattttaccctcaccatatcatcgctgcaaccagaagattttgctacgtactattgccagcagcattacacgaccccaccaacttttggtcaagggactaaagtggagatcaaaagaactgtggccgccccttcagtattcatttttcctccgtctgatgaacagctcaaatcagggacggcctctgtggtgtgccttcttaacaacttttaccctagggaggctaaggtgcaatggaaagtcgataatgcgcttcagagcggtaattcccaggaatcggttacggagcaagattccaaggactcaacttactcgctttcgtccacgctgacgctgtcgaaggccgactacgaaaagcataaggtgtacgcatgtgaagtgactcaccaaggtctttcgtcacctgtgaccaaatccttcaaccggggcgaatgt

SEQ ID NO: 15327 - DNA, 714 bp, Artificial Sequence
  Description of Artificial Sequence: Synthetic coding sequence
atggcagtcatggcaccccgaactctggtccttctcctcagtggagctctggcattaactcagacatgggcagacatccagatgacgcagtccccatccagtttgtccgcaagtgtaggcgatagagtaacgataacctgcagagcttcacaagacgtcaatacagccgtcgcctggtaccagcaaaaaccaggaaaggccccaaagctcctgatttactctgcgagttttctttattccggagtcccgagtcggttttccggctcgagatcaggcactgattttactctgaccataagcagcttgcagcctgaggacttcgctacctactattgtcagcagcactatacaaccccgccgacatttggacaggggaccaaggtcgagatcaagcgcactgtggcagccccatcagtctttatcttcccccctagtgacgaacagctgaagagtggcacagccagcgtggtgtgtcttctgaataacttttatcccagggaagctaaagtgcagtggaaagtagacaacgccctgcagagtggcaattcccaggaaagcgtaacagagcaagactcaaaagatagcacttactctcttagcagcacgcttacactttctaaggccgattacgagaaacacaaagtctatgcatgcgaagttacccaccagggccttagcagccccgtcaccaagtccttcaaccgaggggaatgt

SEQ ID NO: 15328 - DNA, 714 bp, Artificial Sequence
  Description of Artificial Sequence: Synthetic coding sequence
atggcagttatggcaccaagaacactcgtattattattaagtggagcattagctttaacacaaacatgggcagatattcaaatgacacaatcaccatcatcattatcagcatctgttggagatagagtcacaattacctgtagagctagtcaagatgtcaataccgcagttgcttggtatcaacagaaaccaggaaaagctccaaaattgctaatttatagtgcttcatttctttatagtggtgttccatcaagattttcaggatcacgaagtggaacagattttactttaacaatttcaagtttacaaccagaagatttcgcaacttattattgtcagcaacattatactacaccaccaaccttcggacaaggtactaaagttgaaattaaaagaactgttgcagcaccttcagtttttatattcccaccatcagatgaacaacttaagagtggaactgcatctgttgtttgcttacttaataatttttatccacgtgaagctaaagtacaatggaaagttgataatgcattacaatcaggtaattcacaagaatcagtcacagaacaagattcaaaggattcaacctatagtttatcatcaacattaacacttagtaaagctgactatgaaaaacataaagtgtatgcatgtgaagttactcatcagggattatcttctccagtaacaaaatcttttaatagaggagaatgt

SEQ ID NO: 15329 - DNA, 714 bp, Artificial Sequence
  Description of Artificial Sequence: Synthetic coding sequence
atggctgtcatggctcctcggaccttggtcctcctgctctctggtgcactggccttgacccagacatgggcggatattcaaatgacgcagagcccttcgagcctctcggcctctgtcggagaccgtgttaccattacctgccgagcctcgcaggacgttaacacagcggtggcctggtatcagcagaagccgggtaaggctcccaagctgctcatctactctgcatcgttcttgtacagcggcgtcccctccaggttttcgggctcccgctcgggtaccgattttacgcttacaatctctagcctccaacccgaggatttcgcaacttactattgccagcagcattacaccacgccgcctaccttcggtcagggcactaaagtcgagattaagcgcacagtcgctgctccgtctgtctttattttccctccctctgatgaacagttaaagtccggaactgcaagtgtggtttgtctccttaacaacttctacccgagggaggcgaaggtgcagtggaaggtcgacaatgccctccagtccggtaactcccaagagtcggtcaccgagcaagattccaaggacagcacctattctctgtcgagcaccctgaccctctcgaaggctgactacgaaaaacacaaggtttacgcttgtgaggttacgcaccaaggtctaagctcccccgtgactaagtccttcaaccgtggtgaatgt

SEQ ID NO: 15330 - DNA, 714 bp, Artificial Sequence
  Description of Artificial Sequence: Synthetic coding sequence
atggccgtcatggctcctaggactctcgttcttctcctgtctggagctctcgctctgacacagacctgggctgacatccaaatgacccagagcccgtcatcactcagcgcaagtgttggcgaccgtgtcaccattacctgtagggctagccaggacgtgaacacagctgtggcatggtaccagcagaagcctggaaaggctccaaagcttctcatatattccgcttcatttctatattcaggcgtccccagtcgcttttcaggctctagaagcggaacagactttactttgacaatcagttcactccagcccgaggatttcgccacttattattgtcagcagcattacacaacaccccccacgttcggccaggggactaaggttgagattaagcggaccgttgctgcgccatccgtctttattttcccgccctcagacgaacagttgaaatctgggactgcttccgttgtgtgcctgctgaacaatttctaccctcgggaggcaaaggttcagtggaaggtcgataacgccctgcagtcaggtaattcacaggagagtgtgacagaacaggatagtaaagacagcacctactccctcagctccaccctgacgctctcgaaggccgactatgaaaagcataaggtctacgcgtgcgaggtgactcaccaagggctgagcagtcccgtgaccaaatccttcaaccggggggaatgc

SEQ ID NO: 15331 - DNA, 714 bp, Artificial Sequence
  Description of Artificial Sequence: Synthetic coding sequence
atggcggtaatggcaccgagaacattggtactgttgctttccggggcgttagccttgacccagacatgggctgatatacaaatgactcagagcccatcgtcattgtcggctagtgttggtgatagggttacaattacgtgcagagcaagccaagatgtgaataccgctgtggcttggtatcaacaaaagccgggtaaggctccgaagttgctcatttacagtgcttcattcttatatagcggagtgccatccagattttcgggatccagatcaggtacggatttcactttaacaatcagttctttacagccagaggatttcgctacatattattgccaacagcactatactaccccaccaacttttggacagggaactaaggtcgaaattaagagaactgttgcagccccttctgtatttatcttcccaccgtcagatgaacaactcaagtctggaacggcgtccgtcgtctgcttgcttaataacttttaccctcgagaagctaaagtacaatggaaggtagacaatgcactacaatccggaaattcccaagaatcagtgaccgagcaagattccaaggattcaacatactcacttagttccactcttactctttcaaaggccgattatgaaaaacataaagtttatgcttgtgaagttacgcaccaaggtctctcatcaccggtgactaaaagttttaatcgtggagagtgt

SEQ ID NO: 15332 - DNA, 714 bp, Artificial Sequence
  Description of Artificial Sequence: Synthetic coding sequence
atggcggtcatggcaccccgcacccttgtcctgctgctttcaggggcgcttgcgctgacgcagacctgggcggatattcaaatgacgcaatcaccttccagcctgtcggcatcagtgggggaccgcgtgaccattacttgccgtgcatcgcaagacgtgaacactgctgtcgcatggtaccagcaaaagccaggaaaggcacctaagctgcttatctactcggcctccttcctgtactccggagtcccttcgcggttttccggcagtagaagcggaacggactttactctgaccattagctccctgcaacctgaagatttcgccacttactactgtcaacaacattacaccactcccccgacttttggacaaggaactaaggtggaaatcaagcggactgttgcagcaccttcggtctttatctttccaccaagcgatgaacaactgaaatcgggcaccgcttcagtggtctgtctcctgaataacttttacccaagagaggcaaaggtgcagtggaaggtggacaacgcactgcaatcgggaaactcccaagaatcggtgacggaacaggattcaaaggactccacttactcgctgtcgtccaccctgacgctgtccaaggcagactacgaaaaacataaggtgtacgcatgtgaagtgactcaccaggggttgtcgagcccagtgaccaaatcctttaatcgtggcgagtgc

SEQ ID NO: 15333 - DNA, 714 bp, Artificial Sequence
  Description of Artificial Sequence: Synthetic coding sequence
atggcagtgatggcgcctagaactctcgtgttgctgctatctggtgcattggcactcacccaaacctgggccgacattcagatgacacaatcgccctcatctttatcagcctctgtcggcgaccgtgtgacaatcacctgcagggcctcccaagatgtgaacacagccgtcgcctggtaccagcagaagccagggaaggccccgaagctcttgatctactcagcaagcttcttatacagtggagtgccctccaggtttagtggctctaggtctggaacagatttcacactgaccatctcctccttgcagcctgaagattttgcaacgtactattgccagcagcattatactacacccccaaccttcggccagggaaccaaggttgaaattaagcgcactgtcgcagctcccagcgtgttcatctttcccccgtctgatgagcagctaaagtcaggcactgccagcgttgtgtgtctgctgaacaacttctatccacgcgaggctaaggttcaatggaaagttgataatgccttgcagtctggcaattcgcaggagtctgtcacagaacaggacagtaaggatagcacatattcactcagctccaccctgactctgtccaaggcagactacgagaagcacaaagtttacgcctgcgaggtcactcatcaaggtcttagttcccctgtgaccaaatcctttaatcgcggggagtgt

SEQ ID NO: 15334 - DNA, 714 bp, Artificial Sequence
  Description of Artificial Sequence: Synthetic coding sequence
atggcagtcatggcacctcgcaccctggttctcctcctctcaggggccctcgccttgacccagacgtgggccgacatccaaatgactcaaagcccgtcctccttgtccgcatcagtgggggacagagtaactatcacctgccgggcctcccaggacgtgaacactgcagtggcgtggtaccagcagaagccgggcaaggcaccgaagctgcttatctactcagcgtcgtttctctacagcggagtgccatcccggttttccggatcccgcagcggaaccgatttcacgcttaccatctcgtccctgcagcccgaagatttcgccacctactactgtcaacagcattacacgactccacccactttcggccaaggaaccaaggtcgaaatcaaacggactgtcgccgcgccgtccgtgttcatcttcccgccttccgacgaacaactgaagtccggaactgcttcggttgtgtgtcttttgaacaatttctaccctagggaggcaaaagtgcagtggaaggtggacaatgcgttgcagtcgggtaacagccaagaatcggtcaccgagcaggattccaaggattcgacctactcacttagcagcactctcaccttgtccaaggcagactatgagaaacacaaggtgtatgcctgcgaggtgactcatcaggggctgagctccccggtgacgaaatcctttaatcggggcgaatgc

SEQ ID NO: 15335 - DNA, 714 bp, Artificial Sequence
  Description of Artificial Sequence: Synthetic coding sequence
atggcagttatggccccgaggactctggtcttactcctgtccggtgcgcttgccctgacacagacctgggcagacattcagatgactcagtctccgtcttctctctccgcctctgtgggcgacagggttaccattacatgccgtgcttcccaggatgtcaacacagcggtagcatggtatcaacagaagccaggaaaagcaccaaagcttctgatttacagcgctagttttctgtattcaggagttccatctagattttcgggtagtagatcagggaccgatttcactctgacgatttccagcctccaacctgaggactttgcgacgtactattgccagcaacattatactacccctccgacgttcggacagggcacgaaggtggaaatcaaaaggaccgtggctgcgccatcagtgttcattttcccacccagtgatgagcagctgaagagcgggaccgcctctgtggtctgtctcctgaataatttttatccccgtgaagccaaagtacagtggaaggttgacaacgccttacagagtggcaattcacaggagagcgttactgagcaagatagtaaggatagcacatactcactgtcaagtacactgactctttctaaagccgattatgagaaacataaggtttacgcatgtgaggtgactcatcaggggctaagttcaccggtgactaaatccttcaaccgcggcgagtgc

SEQ ID NO: 15336 - DNA, 714 bp, Artificial Sequence
  Description of Artificial Sequence: Synthetic coding sequence
atggcagtgatggccccgcggacccttgtcctgctgctgtcaggcgctctggcgcttacccaaacgtgggccgatatccagatgactcagtctccgtcctcactgagcgcttccgtgggggatcgggtcaccatcacctgccgcgcctcccaggacgtcaatactgcagtggcttggtaccagcaaaaacctggtaaggctccgaagctgctcatctacagcgcatcgttcctttactcgggcgtcccttcccgctttagtgggtccagatcgggtaccgacttcactttgactatttcctccctgcagcctgaggactttgccacctattactgccagcaacactacacgactccgccgacgttcgggcagggaacgaaggtcgagatcaagcgcaccgttgccgcgccgtccgtgttcatcttccccccttcagatgagcaactgaaatcgggaactgcgtcagtggtgtgcctgctgaataacttttaccctcgcgaggccaaggtgcaatggaaagtggataacgccttgcaatccgggaactcgcaggagtcggtgactgaacaggactcgaaggactctacctactccctgtcctcgaccctcactctctcaaaagcagactacgagaagcataaggtctacgcctgtgaggtcacccaccagggactgagctcacccgtgacgaagtcctttaaccgcggtgaatgc

SEQ ID NO: 15337 - DNA, 714 bp, Artificial Sequence
  Description of Artificial Sequence: Synthetic coding sequence
atggctgtgatggctccacgcacgcttgtgctactcttgtccggcgcgctcgctctaacccagacatgggccgacattcagatgacccagtcaccttcctccctgagtgccagtgttggagatcgcgtgactatcacttgtcgggcgtcccaggatgtgaacaccgccgtggcttggtaccaacagaagcccggcaaggcgcctaagttgttaatttactcagccagtttcctgtacagcggcgtgcccagtcgcttctcgggctcacgctccggtaccgactttacactgaccatcagttccctgcagccagaggacttcgccacatactattgccagcagcactataccaccccaccaactttcggacagggcacaaaggtggagattaagaggaccgtagccgcgccatccgtgttcatcttccctccatctgacgagcagttgaagagcggtacagcttccgtcgtgtgcctgttgaacaatttctacccacgtgaggcgaaggtccagtggaaggtagacaacgctctacagagcggcaattcccaagaatccgtcacggaacaggatagcaaagattccacgtacagtctgtctagtacactgacgttatcaaaagccgattatgaaaaacataaggtctacgcgtgcgaagtcacccaccaagggttgagcagcccagtgaccaaatctttcaatcgcggcgaatgt

SEQ ID NO: 15338 - DNA, 714 bp, Artificial Sequence
  Description of Artificial Sequence: Synthetic coding sequence
atggccgtcatggcgccacggacacttgtactcttgctgtctggcgctttggccctgacccaaacttgggccgatatccaaatgacccaatctccaagcagcctgagtgcaagcgtgggagatcgggtgacaatcacatgtagggctagccaggatgttaacacagctgtagcgtggtaccagcagaagcctggcaaagcgcctaaactgctcatctacagcgcaagctttctctatagcggcgtgccctctaggttcagtggatcacggtctggaactgacttcacattgaccatctcttctttacagcctgaggattttgctacttattactgccagcaacattacactaccccccctaccttcggacagggaaccaaggtggagatcaaacggactgttgccgcgcctagtgtctttatattcccaccttcagatgaacagctgaaatccggaactgcatcagtagtgtgtctgctgaataacttctacccacgtgaggctaaggtccagtggaaagttgacaatgcgctgcaatccgggaacagtcaggagtctgtgacagaacaagattccaaggattccacttacagtttgtcttcaacccttacactgtctaaagccgactacgaaaaacataaagtctatgcatgcgaagtgacacatcaaggactgagcagtccagtgaccaaatccttcaaccgaggcgagtgc

SEQ ID NO: 15339 - DNA, 714 bp, Artificial Sequence
  Description of Artificial Sequence: Synthetic coding sequence
atggcagtgatggccccccggacactggtcctgctgctgtcaggggctctggctttaacccagacatgggcagatattcaaatgacacagtctccaagttcactgtcagcctctgtcggggatagggttaccataacctgtagggctagtcaggacgtgaacactgcagtcgcatggtatcagcaaaagcccggcaaagctcctaagttactcatatacagcgcatcttttctgtacagcggggtgccaagtagattcagcggatccagatctggtaccgatttcaccctgactatcagcagcctgcaacctgaagacttcgcaacctattactgtcaacaacactacaccacaccaccaacttttggccagggcaccaaggtcgagattaaaagaaccgtcgctgcacctagcgtgttcatttttccccctagcgacgagcagttaaaaagtggcacagcttctgtggtgtgcctcctgaataacttctatccaagagaggccaaggttcaatggaaggttgacaatgccctacaaagcggtaacagccaggagtctgttactgaacaggacagtaaggactccacctacagcctgtcttctacattgaccctaagcaaagctgattacgagaaacataaggtgtatgcttgtgaggttacccaccagggcctgagttcccctgtcaccaagtccttcaacaggggagagtgc

SEQ ID NO: 15340 - DNA, 714 bp, Artificial Sequence
  Description of Artificial Sequence: Synthetic coding sequence
atggctgtaatggcccccaggaccctagtcctgctcctgagtggcgcgctggccttaacgcagacctgggctgatattcaaatgacgcaatccccttcttccttgtcagcgagcgtcggcgaccgcgttactattacatgtcgcgcatctcaggatgtgaacactgctgtggcatggtaccagcagaaaccgggcaaagcacccaagctcctcatctattcagcatcctttttatactctggggtgccttcccgcttcagcgggagtcggtctgggaccgattttacgctgacaataagcagtctgcagccagaagacttcgccacctattactgtcagcaacactatacaacccctccaacatttggccaaggcacgaaggtggagatcaagaggaccgtggctgctccgtctgtgttcatcttccccccttcagacgaacaactcaaatccgggaccgcctctgtggtgtgcctgctgaacaatttctacccaagagaggctaaggtacagtggaaagtcgataacgctctgcagagtggaaactcgcaggagagcgtgaccgagcaggactctaaggacagtacttattccctgtcttccaccttgacccttagcaaggcggattatgagaaacacaaggtgtacgcgtgcgaggtgactcaccagggtctgagctcccccgtcaccaagtctttcaacagaggcgagtgc

SEQ ID NO: 15341 - DNA, 714 bp, Artificial Sequence
  Description of Artificial Sequence: Synthetic coding sequence
atggccgtcatggcgcctaggaccctggtgctgctgctttcgggagctcttgcacttacgcagacttgggcagacatccaaatgactcagtcaccatccagcctttccgcatctgtgggagatcgtgtgactattacgtgccgcgcgagccaggatgtgaataccgccgttgcatggtaccaacaaaaacccgggaaggccccaaagctgctgatttactcagcatcttttttgtactcgggtgtgccctcgcgattttcgggttcaagatcggggaccgatttcacgctgaccatctcctcccttcagccagaggactttgcgacttattactgccagcagcattacactacccctccaactttcggacaaggaactaaagtggaaatcaagcgcactgtggccgctccttccgtgtttatctttccaccttcggatgagcaacttaagagcggtaccgcatccgtggtgtgtctcctgaataacttttacccaagagaagccaaggtacaatggaaagtggataacgcccttcagagcggtaactcgcaagaatcagtgaccgaacaggatagcaaggactccacttactcgctttcctccacccttactctttcgaaggcggattacgaaaagcataaggtttacgcatgtgaagtcactcatcaaggtttgtcatccccagtcaccaagtcgttcaataggggcgaatgc

SEQ ID NO: 15342 - DNA, 714 bp, Artificial Sequence
  Description of Artificial Sequence: Synthetic coding sequence
atggcggttatggccccaagaacgttagtactattactgtccggagcactggctctgacacagacatgggcagacattcaaatgacacaaagcccttcatccctgtcagcatcagtgggagacagagttacaatcacctgtcgtgcaagccaagacgtcaacacagcagtggcttggtatcagcaaaagccaggaaaagctcccaaacttttgatctactcggcttcatttctttattctggagtgccgtcaagatttagcgggtcgcgctctggcacggacttcacactcactattagctctctgcagccagaggactttgcaacttactactgtcagcaacattatacgaccccgccaacattcggccagggtacaaaggtggaaattaaacggacggttgctgcaccttcagtgttcatctttccgccttcggatgaacaacttaaatccggaaccgctagcgtcgtgtgtcttcttaataatttttacccacgtgaggctaaagttcaatggaaagtggataatgcattgcaatccggcaacagccaagagtctgttacagaacaggatagtaaagactccacatactcattatcgagcactctcactctgagtaaggcggattacgagaaacataaagtttatgcgtgcgaagtgacacaccaggggttatcttcaccggtgacaaaatctttcaatcggggagagtgc

SEQ ID NO: 15343 - DNA, 714 bp, Artificial Sequence
  Description of Artificial Sequence: Synthetic coding sequence
atggctgtaatggctcctcggacactggtgctccttttgtccggggctctcgctctgacacagacgtgggctgatattcagatgactcagagcccttcctcattaagtgcatccgtcggagacagggtaaccataacctgtcgggcctcacaggacgtcaatacagcagttgcatggtaccagcagaagccgggtaaagctcccaaactactgatctattccgcctctttcctctactctggcgtgccctctcggttttctggctcgcggagcgggaccgacttcactctgaccataagttcattgcagccggaggattttgccacatactactgtcagcaacactatacaacgccgcctacctttggccagggtactaaggttgagatcaagagaacggtggcggccccttccgtgtttatcttcccaccttctgatgagcagctaaagtcaggcactgcttcagtcgtctgcttgctcaacaacttttacccacgtgaggccaaggtgcagtggaaggttgacaacgccctgcaatccgggaatagtcaggagtctgtcacagagcaagattcaaaggattccacatactccctctctagcacactcactctgtccaaagccgactatgagaagcacaaggtctatgcctgcgaagtcactcatcagggactttccagtcctgtgacaaagagcttcaataggggagagtgc

SEQ ID NO: 15344 - DNA, 714 bp, Artificial Sequence
  Description of Artificial Sequence: Synthetic coding sequence
atggccgttatggcaccccgcacactcgtgctgctgctttctggggcgcttgccctgacacagacgtgggcagatattcagatgacacagtcaccttcctcactttcagctagtgtgggagatcgagtcactattacatgtcgggcgtctcaggatgtcaacacagcggtggcctggtatcagcagaaacccgggaaagccccaaagctgttaatctattcagcttcctttctgtattccggggtcccttccaggttctctgggagtcggtccggaacagatttcacactgacaatctcctcattacagcctgaagattttgcaacttattattgtcagcagcattatacaacacctcctactttcgggcaggggactaaggtggaaataaaaaggactgttgccgctccatcagtgtttattttccctccaagtgatgaacagctcaaaagtggaactgcttcggtagtttgcctcctcaataacttttatcccagagaagctaaggtgcagtggaaggtcgacaacgcacttcagtccggaaattcacaggaatctgtgactgaacaggattcaaaagattccacttattcgctctcatctacactcacattatccaaggctgactatgaaaaacacaaggtgtatgcttgcgaagtgacacatcaggggttaagttctcctgtaacaaaatcattcaacaggggggagtgc

SEQ ID NO: 15345 - DNA, 714 bp, Artificial Sequence
  Description of Artificial Sequence: Synthetic coding sequence
atggccgtaatggcccctaggacacttgtgctgcttctgtctggcgcgctcgccctgacccagacttgggcggacattcaaatgacccagtccccctccagtttgtccgctagcgttggtgaccgagtaactatcacctgccgggcttctcaggacgtaaacactgcagtggcttggtaccaacaaaaacctggaaaggctcctaagcttcttatttactcagcttcctttctttactccggggtcccgagcaggttctctgggtctagaagcggtaccgacttcacactgaccatatctagcctgcagcccgaggacttcgcaacatattattgccagcagcattacacaacgccccctaccttcggccagggcaccaaagtggagattaagcgcaccgttgctgcgcctagcgtcttcatctttccaccgagtgacgagcagctcaaatccggcaccgcaagcgtggtttgccttctgaataatttctatcctcgcgaggccaaggtccagtggaaagtggacaacgccctgcagtcagggaatagtcaagaatccgtgacggaacaagactctaaggattctacttatagcctttctagcacactcactctctcaaaggcagattacgagaagcacaaggtgtatgcatgcgaagtaacccaccaggggttgtcttccccagtgaccaaatccttcaacagaggcgagtgc

SEQ ID NO: 15346 - DNA, 714 bp, Artificial Sequence
  Description of Artificial Sequence: Synthetic coding sequence
atggcggtcatggcacctagaaccctcgtgctgcttctgtcgggcgctcttgcgttgacccaaacctgggctgatattcaaatgacccaaagccctagctcccttagcgccagcgtcggagatagggtgactattacctgtcgcgcgtcccaggatgttaacaccgcagtggcatggtatcaacaaaagcctgggaaggcaccgaagctcctgatatactccgcatcgttcctctactctggtgtcccaagcaggttttcgggtagcagatccggaaccgattttactttgaccatctcgagccttcaacccgaagattttgcaacctattactgtcaacaacactacaccacgccacctacttttgggcagggtaccaaagtggaaatcaagagaactgtggccgcgccaagcgtgttcatctttcccccctccgacgaacagcttaagtcaggaactgcgtcggtggtgtgccttctgaacaacttctacccccgggaagcaaaggtgcagtggaaggttgacaatgcactgcagtccgggaactcccaagaatccgtgactgaacaagattcgaaggattccacttactcgctgtcgtcaactcttaccttgtctaaggccgattacgagaagcataaggtgtacgcatgcgaggttacccaccaggggctttcctccccggtgactaagagctttaacagaggagaatgc

SEQ ID NO: 15347 - DNA, 714 bp, Artificial Sequence
  Description of Artificial Sequence: Synthetic coding sequence
atggctgtgatggcccctagaaccctggtgctgctgctatctggggcgctcgcgctaacacagacgtgggccgacattcagatgacgcagagtccgtctagcctgtctgcgagtgtgggggaccgggttactatcacctgtagagccagccaggatgtgaataccgctgtggcttggtaccagcagaagccaggaaaagccccaaagctgctgatctacagtgcgtcatttctctactcaggcgtaccctcacggttcagcggcagccgttccggtacagattttaccttaactatttcttctctccaacctgaggacttcgcaacttattattgtcagcagcattatacaacccccccgacctttgggcaggggactaaggtcgagataaagcgcactgtggcggctccctcagtcttcatctttcccccttccgatgaacagctgaaatccggcacagctagtgttgtctgtttgttaaataacttttatccaagggaagcaaaggtccagtggaaagtggacaatgccctccagtctggcaatagccaggaaagcgtcacggagcaggatagcaaagactccacttactccctcagtagtactcttacactcagcaaggctgactacgagaaacacaaagtgtatgcctgtgaggtgacccaccagggtctcagttcgccagtcaccaaaagttttaatcgaggcgaatgt

SEQ ID NO: 15348 - DNA, 714 bp, Artificial Sequence
  Description of Artificial Sequence: Synthetic coding sequence
atggctgtgatggctccacgcacactggtactgcttctgagtggcgcactggccttgactcagacctgggccgacattcaaatgactcagagccctagctcactctccgcatctgtcggggaccgggtcacgatcacttgcagggcctctcaggacgtgaacacggcggtggcctggtatcagcagaaacccggaaaggcccctaaacttttgatttactctgctagcttcctgtattccggcgtgccgagtcgattctccggatcacggagcggcaccgacttcacactgaccatttcttcactgcagcctgaggatttcgctacttactattgtcagcagcactatacgacaccaccgaccttcggccagggaactaaagtggagattaaacgcaccgtggccgcccccagtgtgttcatattccccccgtccgacgagcagctaaagtcaggtactgcttctgttgtctgtttgctgaataacttttacccccgagaggcaaaagttcagtggaaggttgataacgctctgcagagtgggaacagtcaggagagtgtgaccgagcaggatagtaaggacagcacatacagcctctctagtacactcacccttagtaaagcagattacgaaaaacacaaggtgtatgcttgcgaagtcactcatcaaggcttgtcctctccagtgacaaaatcatttaacaggggcgagtgt

SEQ ID NO: 15349 - DNA, 714 bp, Artificial Sequence
  Description of Artificial Sequence: Synthetic coding sequence
atggccgtgatggcaccccgaaccctcgtgctacttttgtccggcgccctagctctaactcaaacatgggccgatatccagatgacccagtctccttctagcctgtctgcttcagtcggagatcgggtgacaatcacatgccgggctagccaggatgtgaatactgccgtggcttggtaccaacagaagccaggcaaggcacctaaattgctgatctattctgcgtcctttctctactccggggtcccttcacggttttccggctcccgcagtggcaccgatttcacgctaaccatcagtagtctgcagcctgaggactttgccacctactattgccagcagcactacacgaccccacctaccttcggccagggtactaaagtggagatcaagaggaccgtcgcagcccctagcgtgtttatctttcccccctcggatgagcagctgaagagcgggacagcctccgtggtctgtctcctgaacaacttctacccacgagaggccaaggttcagtggaaggtcgacaatgctctccaatccggcaattctcaggagagcgttaccgagcaggacagcaaggacagcacgtacagtctatcaagcactctcaccctgtcaaaggcagactacgagaaacataaggtttatgcttgcgaagttacacatcagggactgagcagcccggtgacaaagtctttcaacagaggcgagtgc

SEQ ID NO: 15350 - DNA, 714 bp, Artificial Sequence
  Description of Artificial Sequence: Synthetic coding sequence
atggctgttatggccccgaggaccctggtactactccttagtggcgcgctcgctcttacacagacctgggcggacattcaaatgacacaatctccgagtagcctgtcagcgtcggtcggtgatagagtgacgattacttgcagagcaagtcaagatgttaataccgcggtcgcatggtaccagcagaaacctgggaaggctccaaagctactgatctatagcgccagtttcctctacagcggtgtgcctagcaggttctccggaagtaggtcaggaacagatttcacactgaccattagcagcttgcaaccggaagacttcgcgacctattactgtcaacaacactataccactccacctaccttcggacaaggcacaaaggtggaaattaaacgaacggtcgcggctccctctgtcttcattttccctccaagcgatgaacaactcaaaagcggaactgcttcagtcgtgtgcctgctgaacaacttctatccacgggaagccaaagtgcagtggaaagtggataatgctctgcagtccggcaactctcaggaatcagtgacggagcaggattccaaggactccacctatagcctcagcagcactcttaccttgagcaaagcagactatgaaaaacacaaagtatacgcctgcgaggtcacccaccagggacttagtagccccgttactaagtctttcaacagaggggagtgc

SEQ ID NO: 15351 - DNA, 714 bp, Artificial Sequence
  Description of Artificial Sequence: Synthetic coding sequence
atggcggtgatggctccgcggactctggttctgctgctgtcaggcgcgctggcccttactcaaacttgggctgatatccagatgactcaatcgccgtcaagcctgagcgcatcggtcggagatcgcgtcaccatcacttgccgggcatcccaggacgtgaataccgctgtggcgtggtatcagcagaagccgggaaaggccccaaagctgttgatctactccgcctcgttcctttactccggcgtgcctagccgctttagcggaagccggtccggaactgattttactttgaccatcagttcgttgcaaccggaagatttcgccacctactactgtcagcaacactacactactccgccgacttttggccagggcacgaaggtggaaatcaaacggactgtggccgcacccagcgtgtttatcttcccaccgtcagacgaacagcttaagtcagggaccgcgtccgtggtctgcttgctgaacaatttctaccctagagaggccaaggtgcagtggaaggtggacaacgccctgcaaagcgggaactcacaggaatccgtgaccgaacaggattcgaaggattcgacgtactcattgagctccactctgactctgtcgaaagcggactacgagaagcacaaggtgtacgcctgcgaagtcactcatcaaggcctgagctcaccggtgaccaaatcattcaataggggggagtgc

SEQ ID NO: 15352 - DNA, 714 bp, Artificial Sequence
  Description of Artificial Sequence: Synthetic coding sequence
atggcagtgatggcacccagaaccttggtgctgctgttgtcaggcgcccttgccttgactcaaacctgggccgatatccagatgacacagtctccctcttctctctcagctagtgtgggagatagagtgacaatcacttgcagggcatcccaggatgtgaatactgcagtagcatggtatcaacagaagcccggcaaggctcctaagctgctgatctactccgcaagtttcctgtactccggcgtgccatctaggttcagtggatcaaggagtggcacagattttacccttaccatttcctcactgcagcctgaggacttcgctacttactattgccagcagcactacaccactcccccaacattcggccagggaactaaggtcgaaatcaagcgtactgtggccgcccccagtgtgttcattttcccaccttctgatgagcaactcaagtccggcaccgccagtgtagtctgcctgctgaacaacttctatccaagagaagccaaagttcaatggaaggtggataatgctctgcagtctggcaactcacaggagtcagttactgaacaggacagtaaagactccacttattccttgtcatcaaccctgacactgtccaaggcagactacgaaaaacacaaggtgtacgcttgcgaggtcacacatcagggcttgagttcccccgtgactaagtccttcaacagaggtgagtgc

SEQ ID NO: 15353 - DNA, 714 bp, Artificial Sequence
  Description of Artificial Sequence: Synthetic coding sequence
atggctgtgatggcacctcggactctggttttgctcctgtccggagctctcgcgctgacacagacatgggccgacatccagatgactcagtctccctctagtctgagcgcctccgtcggcgatagggtgactatcacctgtcgagcctcacaagacgtgaacaccgccgtcgcctggtatcagcagaagcctggcaaagcccctaaattgcttatctactcagcctcattcctgtactccggcgtgccctcgcggttcagcggtagcagatcagggacggacttcactttgacaatctcttccctgcagcccgaggacttcgccacgtattattgtcagcagcattacacaactccccctacattcggccaaggcactaaggtggagatcaagcgcacagtcgcggccccttcagttttcatatttcctcccagtgatgaacagttgaagagtggtaccgcctctgtcgtgtgtctgctgaataatttctatcccagagaggccaaggttcagtggaaagtggataacgcactgcaatcagggaactcgcaggagtctgtgactgaacaagactcaaaggattcaacgtatagcctgtcctccactttgacactatcaaaggcagactacgaaaagcataaggtttatgcctgcgaagtcacacatcaggggttaagtagccccgtgacaaaatcctttaataggggggaatgt

SEQ ID NO: 15354 - DNA, 714 bp, Artificial Sequence
  Description of Artificial Sequence: Synthetic coding sequence
atggccgtgatggccccacgcacgttggtgttgctcctgagcggagccctcgccctgacccaaacgtgggccgacatccagatgactcagagcccgtcctcgctgtccgcctccgtcggtgaccgcgtgaccattacgtgtcgagcatcccaagatgtgaacactgctgtggcatggtaccagcagaaaccgggaaaggctccgaagctcctgatctacagcgcctcatttctgtactcaggagtcccatcgaggttctcgggctcgcggtcaggaactgactttaccctgactatctcgtccctccaaccggaagatttcgcaacctactactgccagcagcactacactacgccacctacctttggacaaggcaccaaggtggagatcaagcggaccgtggccgcaccatcggtgttcatctttccgccgagcgatgagcagttgaaaagcggaaccgcatcagtcgtctgcttgctgaacaatttctacccgagagaggctaaggtccaatggaaagtcgacaacgcgttgcaatccggcaatagccaggagtcggtgaccgagcaagactcaaaggactccacctactcgctgagcagcaccctgacgctctccaaggcagactacgaaaaacacaaggtctacgcctgtgaggtgactcatcaagggctgtcctctccagttactaagtcattcaatagaggcgagtgt

SEQ ID NO: 15355 - DNA, 714 bp, Artificial Sequence
  Description of Artificial Sequence: Synthetic coding sequence
atggccgtgatggcacctcgcaccctggtgctcctgctcagcggagccctcgcgctgactcaaacctgggcagatattcaaatgacgcagtcccccagctctctctctgctagcgtcggtgaccgcgtgaccattacttgtcgggccagccaggatgtcaataccgcagtggcatggtaccaacagaaacccgggaaggcaccaaagctgctcatctactcagcgtcctttttgtactccggtgtgcctagccgttttagcggttcccgctctggaaccgacttcacccttaccatttcatcccttcaacctgaagattttgcaacctactactgtcagcaacactacactactcctccaacttttgggcagggcactaaggtcgagatcaagcggaccgtcgcagcgccgtcagtgttcatttttcccccaagcgatgaacaacttaagagcggcactgcaagcgtggtctgccttctgaacaacttctaccctcgggaagccaaggtgcaatggaaagtggacaatgctctccagtccgggaactcccaggagtcggtgactgagcaagattcgaaggacagcacgtattcgctttcctccacgctcactctctcgaaagcggattacgaaaagcacaaggtgtacgcttgtgaagtgacccaccaagggctgtcctccccagtcaccaagtcatttaacagaggagagtgt

SEQ ID NO: 15356 - DNA, 714 bp, Artificial Sequence
  Description of Artificial Sequence: Synthetic coding sequence
atggcagtgatggcccccagaacgttggtgctgctgctctctggggcactggccctgacccaaacttgggcagatatacaaatgactcaatccccttcgtcactgtcggcgtcggtaggggaccgtgtgactattacctgtcgagcttctcaggacgtgaatactgcggtcgcatggtaccaacagaaaccaggtaaggctccaaagctgctcatttactccgcctcttttctttacagcggagtcccctcccgttttagcggatctcgcagcggaaccgactttactctcaccatctcgtcgctccaaccagaggatttcgcgacctactactgtcagcaacattacacgactcctcctacttttggacagggaaccaaggtggaaatcaaacgtaccgttgcggccccgagcgtgttcatctttccaccctcagatgaacagctgaaatcaggcactgcgtcggtcgtgtgcctgcttaacaatttctacccaagagaggcaaaggtgcaatggaaagtggacaacgcacttcaatcgggcaattcgcaggaaagcgtgaccgaacaagattccaaggattcaacttactcgctttcctcaacccttaccctttcgaaggccgactatgagaaacacaaggtgtacgcatgcgaggtgacccatcaaggtctttcttcacctgtcaccaagtcgttcaaccgaggtgagtgt

SEQ ID NO: 15357 - DNA, 714 bp, Artificial Sequence
  Description of Artificial Sequence: Synthetic coding sequence
atggcagtgatggcaccccggacattagtcctcctgctatctggagcattagccctcacacagacatgggccgatatccagatgacacagtcaccctcatctttgtcagcatctgtcggagatagggtcactataacatgcagagcatctcaggatgtaaatacagctgttgcctggtatcagcagaaacccgggaaagcacccaaactgctgatctacagtgccagttttctatacagtggggttccatcacgattttcgggatcgcgatccggaacagatttcacactcacaatttcctctttacaaccagaggactttgctacatattattgccagcagcactatactactcctccaacgttcggacagggaacaaaagttgaaataaaaaggacagtggcagcaccctccgtgtttatctttccaccttccgatgagcagctgaaatctggaactgcatccgttgtttgtctcctgaacaatttctatccaagggaagcaaaagtgcagtggaaagtagacaatgccctccaatcaggaaatagtcaggaaagtgtcacagaacaggattcaaaagactccacttactctctgtccagtactcttactctgtcaaaagccgattatgaaaaacacaaggtttatgcctgcgaagtgacacatcagggactgtcttcaccagtcacgaaatccttcaatcggggagaatgt

SEQ ID NO: 15358 - DNA, 714 bp, Artificial Sequence
  Description of Artificial Sequence: Synthetic coding sequence
atggctgtcatggccccgcgcaccctggtccttctcctgagtggggcgcttgctctcactcagacctgggccgacatccaaatgacccaatctccatcctccctctcggcatcggtgggtgaccgcgtcactatcacctgccgggcttcccaagacgtgaacactgccgtggcctggtaccaacaaaaaccaggcaaagccccgaaattgctcatttactcggcgagcttcctgtacagcggagtgccatcccggttctcaggaagccgcagcggaaccgatttcactctgaccatttcatcgttgcagccggaggacttcgccacctactattgtcagcagcattacactaccccgccgactttcggacagggaacgaaagtggagatcaagcgcaccgtcgcagccccgtcggtgttcatcttccctccgtccgatgaacagctgaagtcaggcactgcgtcagtcgtgtgcctgctgaacaacttctacccgcgggaagcgaaggttcaatggaaagtcgacaacgcgctgcagtcgggtaactcacaggaatcagtgactgaacaagactctaaggactcaacctacagcctctcgtccaccctgactctgagcaaggccgattacgaaaaacataaggtgtacgcctgcgaagtcacgcatcagggactgtcgtcgccggtgaccaaatccttcaaccggggcgaatgt

SEQ ID NO: 15359 - DNA, 714 bp, Artificial Sequence
  Description of Artificial Sequence: Synthetic coding sequence
atggccgtgatggctccgcgcaccctcgtcctgttgctgtcgggagcactggcattgacccagacctgggccgacatccagatgacccagtcgccgtcgagcctgtcggcatccgtcggcgaccgcgtgactatcacctgccgcgcctcccaagatgtgaataccgctgtcgcgtggtaccaacaaaagccggggaaagcaccaaagctcctgatttactccgcgtccttcctctatagcggcgtgccgtcgcggttctctggatcccgctctggcactgatttcactctgactatcagctcactgcagccagaggacttcgccacctactactgtcaacagcactacactacgccgccgaccttcggacagggtaccaaggtggaaatcaagcgcacggtcgccgccccctcggtgtttatcttcccaccttccgatgaacagctcaaatccggcaccgcatcagtcgtctgtctgctgaacaatttctacccgagggaagctaaagtgcagtggaaagtggacaacgcactgcaatcgggaaactcacaagaatcggtgaccgagcaagactccaaggacagcacctactcgctttcatcgacccttaccctgtcgaaggcggattacgagaaacataaggtgtacgcttgtgaagtcacgcatcagggcctcagctcgccggttaccaaatcctttaaccggggagagtgc

SEQ ID NO: 15360 - DNA, 714 bp, Artificial Sequence
  Description of Artificial Sequence: Synthetic coding sequence
atggcagttatggcaccccgtactttggttttactcttgtccggtgctcttgctttaacgcagacctgggctgatattcaaatgacccagtcgccgagctctctgtcagcctctgtgggcgacagggtcactattacctgcagagcatctcaggacgtaaacactgcagtcgcttggtaccagcagaaaccaggcaaagcgccaaagctgttgatttactccgcttcattcctctattcgggtgttccatctaggttttctggttctaggtcaggcaccgatttcacactcacaatctctagtctccaaccagaagattttgcaacgtattactgccaacagcattacacaacacccccgactttcggtcagggaacaaaggttgaaattaagcgtactgttgcagcaccttccgtatttatttttcctccatcagatgagcaacttaaatcgggtactgcttccgttgtgtgcttgctgaacaatttctatccgcgtgaagccaaagttcagtggaaagtggataacgcactacaatcaggtaacagtcaagaatctgttactgagcaagattctaaggattctacgtactctctctcatctactcttacgttgtctaaggctgattacgaaaagcataaagtttacgcgtgcgaggtaactcatcaggggttgtcaagtcctgtcaccaaaagttttaatcgtggtgagtgc

SEQ ID NO: 15361 - DNA, 714 bp, Artificial Sequence
  Description of Artificial Sequence: Synthetic coding sequence
atggcagtcatggcgcctcggactctcgtgctgctgctctccggcgctctcgctcttacgcaaacctgggcggatatccagatgacccaatccccaagcagcctctcagccagcgtcggagacagggtgacgatcacctgccgtgcgtcccaggacgtgaacactgcggtcgcctggtaccaacagaagccggggaaggccccaaagctgctcatttacagcgcgtcatttttgtactcgggagtgcctagcaggttctccggaagcagatccggcacggatttcaccctgactatctcatcgctccaacctgaagatttcgccacctactactgccagcagcactatactactccgccgactttcggtcagggaaccaaagtcgagatcaagcgcaccgtggcggcgcctagcgtctttatctttcccccctcggatgaacagctcaaatcgggcactgcttcagtcgtgtgcctcctgaataacttttacccaagggaggccaaggtccagtggaaagtggacaacgcccttcaatccggtaatagccaggagtccgtgaccgagcaggacagcaaggacagcacttactcgctcagctccaccctgaccctctcaaaggccgattacgaaaaacataaggtttacgcctgcgaagtgactcatcagggactttcatccccggtgactaagtcgttcaatcgcggagaatgt

SEQ ID NO: 15362 - DNA, 714 bp, Artificial Sequence
  Description of Artificial Sequence: Synthetic coding sequence
atggccgtgatggccccccgaactctagtactccttctgtccggcgccttggccctcacccagacctgggcggatattcaaatgacacagagcccgtcttcactctccgcatcagtgggcgatcgagtcacgatcacctgccgggcctcccaagacgtgaacacggcggtggcatggtaccagcagaagcctggcaaagcaccaaaacttttgatatattccgcatcctttctgtacagcggcgttcccagcaggtttagtggttctagaagcggaaccgatttcacacttaccatctcctcactgcaacctgaggattttgccacctactactgtcaacaacattacaccacccctccgacattcgggcagggtacgaaagttgagatcaagcgaacagtagccgcaccatccgtcttcattttccccccttcggacgagcaattgaaaagcggtacagccagcgtagtgtgcctgttgaataacttctatcccagggaagcgaaggttcagtggaaggtggataacgcactgcaatctggtaattcccaggaatccgtgactgagcaggacagtaaggattccacttactcgctgagcagcacactgacattatcaaaagccgattatgagaaacacaaagtatatgcgtgcgaagtgactcatcaaggattgtcctctcccgtcactaagtcctttaatcggggtgagtgc

SEQ ID NO: 15363 - DNA, 714 bp, Artificial Sequence
  Description of Artificial Sequence: Synthetic coding sequence
atggcggtgatggcgcccagaactctcgtgctgttgctttccggagcccttgctctcactcaaacctgggcagacatccagatgacccagtctccctcatcgttgtctgcctctgtcggagacagggtcactatcacttgtcgggcatcccaggacgtgaacactgccgtggcatggtaccaacagaagccaggaaaggccccaaaacttctcatttactccgcgtcctttttgtactcgggtgtgccgagccgcttcagcggttcgcggagcgggacggatttcaccctgactatctcatcgctgcaaccagaagatttcgccacttactactgccagcagcactacacgaccccgccgaccttcggccaaggaacgaaggtggagatcaagcgcactgtggcagccccatcggtgttcatctttccgccgtcggacgaacagcttaagtccggaactgcttcagtcgtttgccttctgaataacttctatccgcgtgaggccaaggttcagtggaaggtcgataacgctttgcagagcggtaattcgcaggagtcggtcaccgaacaagatagtaaagactcaacctacagcctgagctcaaccctgactcttagtaaggcggactacgaaaaacacaaggtctacgcgtgcgaagtgacccatcaaggcctctcttcccctgtgaccaaaagttttaaccggggcgagtgc

SEQ ID NO: 15364 - DNA, 714 bp, Artificial Sequence
  Description of Artificial Sequence: Synthetic coding sequence
atggcagtcatggcgcctcggactctggtgctgctcctgtctggagcgcttgcccttacccagacgtgggccgacattcagatgacccagtccccgtcatccttgtcggcatccgtgggagatagagtgaccatcacctgtcgcgcatcgcaggatgtcaataccgccgtggcctggtaccaacagaagccgggcaaggccccaaagctgctgatctactcagcgtccttcctctacagcggggtgccttcgcgcttttcgggcagccgatcgggaactgacttcacgctgaccatcagctctctccaaccagaagatttcgcaacttattactgccaacaacactacactactccgccgacctttggacagggtaccaaggtcgagatcaagaggaccgttgctgccccctcagtgtttatcttcccgcccagtgatgaacaactcaaatccggcacggcttcggtcgtttgcctgctgaataacttctacccacgggaggccaaagtgcagtggaaggtcgacaacgctctccagtcaggaaactcacaggagtcggtgactgaacaggactcgaaggacagcacctactcactgagctcgactctgactttgtccaaggccgactacgaaaaacacaaagtgtacgcgtgcgaagtgactcatcaaggactctcctccccggtgaccaagagcttcaaccgcggggagtgc

SEQ ID NO: 15365 - DNA, 714 bp, Artificial Sequence
  Description of Artificial Sequence: Synthetic coding sequence
atggctgttatggccccccggactctcgtactcctcttgagtggcgcactcgctcttactcagacttgggctgacatccagatgacacaaagcccatcttccctcagtgcctcagttggagatcgagtaaccattacctgtcgcgcgtcgcaggacgtcaacactgcggtcgcctggtaccaacagaagcctggcaaagctccgaagctactcatttactctgcgtccttcctctactcaggggttccgtcacgctttagcggctccagatctggcaccgattttactctcacaatcagttctctccagcctgaagacttcgctacgtactactgccagcagcactacaccacgcctccaacgttcggacaggggaccaaggtcgagatcaagcggaccgtggctgcaccctcagttttcatattccctcccagcgatgagcagcttaagagcggtacggcttccgtagtttgtcttctaaataatttttatccacgggaagccaaggtacagtggaaagtcgacaacgcacttcaatcaggcaactctcaagaatctgtaaccgaacaggattccaaagacagcacctacagtctctcttctaccctgacgctgagtaaagcagactacgaaaaacacaaggtgtacgcctgcgaggtgacccaccagggactgtcctcccccgttacaaagtcattcaataggggcgagtgc

SEQ ID NO: 15366 - DNA, 714 bp, Artificial Sequence; identical to SEQ ID NO: 15316
  Description of Artificial Sequence: Synthetic coding sequence

SEQ ID NO: 15367 - DNA, 714 bp, Artificial Sequence
  Description of Artificial Sequence: Synthetic coding sequence
atggccgtgatggcacctcgaaccctggtgctgctcctgtccggtgccctcgccttgactcaaacctgggcagatatccagatgacccaatccccatccagcttgagcgcatccgtgggggacagagtgaccattacgtgcagggcgtcccaagatgttaacactgcagtggcctggtaccagcaaaaaccaggaaaggcacccaagctgctcatttacagcgcatcatttctttactctggggtcccaagcagattttccggtagcagaagcggcacggactttacgctcaccatctcgagcctgcagcccgaagattttgcaacttattactgtcagcagcactacaccacccctccaaccttcggacagggaaccaaagtggaaatcaaaagaacggtggcagcaccctcagtgttcatcttcccgccttcggacgaacaacttaagtcgggtaccgcatcagtggtctgcttgcttaacaacttctacccgagagaggcaaaggtgcaatggaaggtcgacaacgctctgcagtccggaaattcccaagagtcggtgacggagcaggacagcaaggatagcacctactccctgtcatccactcttactctgtcaaaagcggattatgaaaagcataaggtctatgcttgtgaggtgacccatcaaggacttagctctcctgtgactaagtcgtttaaccggggcgaatgt

SEQ ID NO: 15368 - DNA, 714 bp, Artificial Sequence
  Description of Artificial Sequence: Synthetic coding sequence
atggccgtcatggccccgagaacccttgtcttgctcttgtcgggagcgcttgcgctgacccaaacttgggcagacatccaaatgactcagtcaccaagctcgctgtcagcatctgtgggagatcgcgtgactatcacctgccgcgccagccaggacgtgaacaccgcagtcgcatggtaccaacaaaaaccaggaaaagccccgaagttgctgatctactccgcatctttcctgtactcgggcgttccatcccggttttcgggatctcgaagcggtactgacttcactctcaccatctcgtcgctgcagccggaggacttcgccacctactactgtcaacagcactacactactccccccacctttggacagggaaccaaagtggagatcaagaggacggtggcggcgccttcagttttcatcttccccccgagcgatgaacaactgaagtctggcacggcttcagtcgtgtgcctcctcaacaatttctatcctcgcgaggccaaggtgcagtggaaggtcgataatgccctccagtctggtaactcgcaggagtccgtcaccgagcaggactcaaaggactcgacttactcgctctcctccactctgactctgagcaaggccgactacgagaagcacaaggtgtacgcgtgtgaggtaactcatcagggtttgtcgagcccggtgactaagtcgtttaacagaggcgaatgc

SEQ ID NO: 15369 - DNA, 714 bp, Artificial Sequence
  Description of Artificial Sequence: Synthetic coding sequence
atggccgtcatggcacctagaacccttgtgctgctcttgtctggagccctcgcccttacgcagacctgggcggacatacagatgacccaatcaccttcatcgctgtccgcatcggtgggggaccgtgtcaccatcacctgtcgcgcaagccaggatgtgaatactgcagtggcttggtaccagcagaagccgggtaaggcaccgaaactcttgatatactccgcatcctttctttactcgggcgtgccttcccggttttcgggttcccggtcggggaccgactttaccctgaccatatcttcgctgcaaccggaagatttcgcaacttactactgtcaacaacattacactactccccctaccttcggtcaaggaaccaaggtggagattaagcgaaccgtggcagcaccatccgtctttatcttcccaccatccgatgaacaactcaagtcaggcactgcaagcgtggtgtgtctcctgaacaacttttaccccagggaagccaaggttcaatggaaggttgataacgcccttcagtcgggcaattcccaagagagcgtgaccgaacaagactcaaaggattccacctacagcctcagcagcactctgaccctctcaaaggcggattatgagaaacacaaagtgtacgcttgcgaagtcacccatcaaggcctgtcgtcccccgtcactaagtcgtttaacagaggagaatgc

SEQ ID NO: 15370 - DNA, 714 bp, Artificial Sequence
  Description of Artificial Sequence: Synthetic coding sequence
atggcagtcatggctccgcgtactctcgttctgttgctcagtggtgccctggccctgactcagacgtgggctgacatacagatgacacagtcaccaagttctcttagcgcgtccgtaggcgaccgagtgacaatcacgtgcagagctagccaggatgtaaacacagccgtggcctggtaccagcaaaagcccggcaaggcacccaagctgttaatatactctgccagttttctgtactccggagtgccatctcgcttcagcggctcccggtctggcaccgactttaccctcaccatcagcagccttcagccagaggacttcgccacttactactgtcagcagcactacactactccccctaccttcggtcagggcactaaggtggagattaagagaactgttgcagcaccttcagtgtttattttccccccatctgacgaacaactgaagtccgggacagcttcggtcgtgtgtctgctgaacaatttttacccgcgggaagcaaaagtgcagtggaaggtcgacaatgccctgcaatctggaaacagccaggagtcagtcaccgagcaagatagtaaggactcaacctacagcctgagcagcaccttgacgctgtcaaaggctgattatgagaaacacaaggtttacgcctgtgaggtcacacatcagggattgtcgagtccggtcactaagtcgttcaacaggggagagtgc

SEQ ID NO: 15371 - DNA, 714 bp, Artificial Sequence
  Description of Artificial Sequence: Synthetic coding sequence
atggcagtgatggctccccggacgctcgtcctgctgcttagtggagccctcgccctgacacaaacctgggccgatattcagatgacccagtccccttctagcttgagcgcctccgtgggcgatagggtcaccattacctgtcgcgcctcgcaggacgtgaatacagcagtggcttggtatcagcagaaacctggaaaagctcccaagttactgatctattctgcctctttcctgtactctggcgtgccgtcccggtttagtggttcccgcagcgggacagactttactctgacgattagttccctgcagccagaagacttcgctacgtattattgtcagcagcattacaccacgccacctacttttggtcaagggaccaaggttgaaatcaagcggactgtggcagctcctagcgtttttatttttcccccctctgacgagcaacttaaatctgggacagcttctgtggtttgtctactgaacaatttttacccacgggaggctaaagtgcagtggaaggtggacaatgcactgcaatccggcaactcccaggagtccgtcactgagcaggactctaaggactctacctatagcctatcctctaccctgactctctccaaggcggattacgaaaaacataaggtgtatgcatgcgaggtgacccatcaaggactgtccagccccgtgaccaagtcctttaaccgcggggaatgt

SEQ ID NO: 15372 - DNA, 714 bp, Artificial Sequence
  Description of Artificial Sequence: Synthetic coding sequence
atggccgtcatggcccctagaactctcgtcctgttgctttccggcgccctggccctgacgcaaacttgggctgacatccagatgacccagtcgccgagctcgttgagcgcaagcgtcggcgaccgcgtcacgatcacttgccgggcctcacaagacgtgaacactgccgtcgcatggtaccagcagaagccgggaaaggcgcctaaactgctgatttacagtgctagctttctgtactcaggtgttccatcgaggttctcaggatcccggagcggcacggacttcaccctgaccatctcatcactgcagccggaagacttcgcaacctactactgtcaacaacactacaccactccgccgacctttggccagggaacgaaggtcgaaattaagcgtaccgtggcggccccgagcgtgttcattttcccgccatcagacgaacagctgaagtccggaactgcatccgtggtgtgcctgctcaataacttttaccctagggaggctaaagtccaatggaaggtggataatgcgttgcagtcggggaactcgcaagagtccgtcactgagcaagatagcaaagacagcacctactcgctgtcatcgactctcactctgtcaaaagcggattacgagaagcacaaagtgtatgcctgcgaggtcactcaccagggactgtccagcccggtgaccaagtcgttcaatcgcggagagtgc

SEQ ID NO: 15373 - DNA, 714 bp, Artificial Sequence
  Description of Artificial Sequence: Synthetic coding sequence
atggcggtgatggcgcctcgcacgctcgttctcctgttgtcgggagccctcgcacttactcaaacctgggccgatatccaaatgacccagagcccatcgtccctgtccgcatcggtcggagacagagtcaccattacctgtagggcatcccaagacgtgaacacggcagtggcatggtaccagcagaagccaggcaaggcacccaagctccttatctacagcgcatcttttctttactcgggtgtgccctccaggttctccggcagccgatccgggacggatttcaccctgaccatttcgtcactgcaacctgaagattttgcgacttactactgccaacaacactacactactccacctacctttggacaaggaactaaggtggaaatcaaaagaaccgtcgcagcaccttcggtgttcatcttccccccatcagacgaacaattgaaaagcgggaccgcctcagtggtctgccttctgaacaatttctacccaagggaggcgaaagtgcaatggaaggtggataacgcacttcaatcgggcaacagccaagaatccgtgactgagcaagattcgaaggactccacttactcactctcttccacgctgactctgtcgaaggccgattacgagaagcataaagtctacgcatgtgaagtgactcaccagggactttcgtcgccagtcaccaagtcgttcaatcgcggtgaatgt

SEQ ID NO: 15374 - DNA, 714 bp, Artificial Sequence
  Description of Artificial Sequence: Synthetic coding sequence
atggcagtcatggccccacggactctcgtactgctactgagcggcgctctagccctgacacagacgtgggcggacattcagatgacgcaatcccctagcagtctttccgcctcagtgggagaccgggtgactattacatgcagagcttcccaggacgttaacacggcagtggcttggtaccagcagaagccaggcaaggctcctaaactgttgatttactctgcctccttcctctactcaggcgtcccctccagattcagtggttcgagatccggaaccgactttactctgaccatatcctccctccagcctgaagatttcgccacctactactgccaacagcactacacaacacctccgacttttggtcaggggacaaaggtggagataaagaggacggtagctgccccaagcgtgttcatctttccaccatctgatgaacaactgaaaagcggcaccgcttcagtggtctgtctgctcaataacttttatcctagggaagccaaagtgcaatggaaggttgataacgccctacagagcggtaactcccaggagtccgtcacggaacaggattctaaggattctacatactccttatctagcacgctgacattgtcgaaggcagattacgaaaaacataaggtctacgcgtgcgaagttacccaccaggggctgtcgagccccgtgacgaagtccttcaacagaggcgagtgt

SEQ ID NO: 15375 - DNA, 714 bp, Artificial Sequence
  Description of Artificial Sequence: Synthetic coding sequence
atggctgtcatggccccgcgcacactggttctgttgctctcaggtgcgctcgctctgacccagacatgggccgacattcagatgacccagagccccagctctttatcagcaagcgtgggcgaccgtgtaaccattacatgccgggccagccaggatgtcaataccgccgttgcgtggtaccagcagaagccaggcaaagccccaaagcttctcatatacagtgcaagcttcctctactccggtgtcccgtcacgatttagtggaagccgcagcggcactgattttactctgacaattagttccttgcagcccgaggattttgctacttactactgccagcagcattatacaaccccaccaacattcgggcaaggtactaaggttgaaatcaagcggacggtggccgccccctcagtgttcatctttcctccatccgatgagcagctaaagagcggcactgcctcggtggtgtgccttctgaataacttctacccacgggaggccaaggtgcagtggaaagttgataacgccttgcagagtggcaatagccaggagtcagtgacagaacaggacagcaaggactccacatactccctctcaagtactcttactctcagcaaggccgattatgaaaagcataaggtgtacgcatgcgaggtcacccatcaaggtctaagttcccccgtgaccaaatccttcaacagaggagaatgc

SEQ ID NO: 15376 - DNA, 714 bp, Artificial Sequence
  Description of Artificial Sequence: Synthetic coding sequence
atggccgtgatggctccgaggactctggtgctcctgctgtcaggggccctggcgctgactcagacttgggccgatatccaaatgacccaaagcccaagctccctgtccgcgtcagtgggggacagggtgacgattacctgccgggcttcacaagacgtgaacaccgcggtggcctggtaccagcagaaacccggtaaggcgccaaagctgcttatctacagcgcctcgttcctgtactccggcgtgccaagccgcttttcgggaagccggtcgggtaccgacttcaccctgactatcagcagcctgcagcccgaggactttgctacctactactgtcaacaacactacaccaccccgcctacgttcggacagggaacgaaggtggaaatcaagcggaccgtcgcagcaccgtctgtgttcatcttcccgccatcggatgaacaactgaaatccgggactgcttcagtggtctgcctgttgaacaacttctacccgcgagaagctaaggtccaatggaaggtggacaatgcgctccagtcgggcaactcgcaggaatcagtgacggaacaggacagcaaagactcaacttactcacttagctccaccctgaccctctccaaggcggactacgagaagcataaggtctacgcgtgcgaggtgactcaccagggccttagctcccctgtgactaagtcgttcaaccggggtgaatgc

SEQ ID NO: 15377 - DNA, 714 bp, Artificial Sequence
  Description of Artificial Sequence: Synthetic coding sequence
atggcagtgatggcaccccggaccctcgtgctgcttctgtcgggcgcactggccctcacccagacttgggcagatattcaaatgacccagagcccgtcgtccctttcagcatcagtcggggaccgggtgacgatcacctgccgggctagccaagacgtcaacaccgccgtggcctggtaccaacagaaaccagggaaggcacctaagctgctgatatactcagcgagctttctgtactctggagtgccatcacgtttttctggctcgcgcagcgggactgatttcaccctcactatttccagcctgcaacccgaggatttcgcgacctactactgccaacaacattacaccactccccctacttttggtcaaggaactaaagtggaaatcaagagaacggtggcagcaccgtcggtattcatttttcccccttccgatgaacagctgaagtccggaaccgcgtcggtggtctgtctgctcaataacttctatccacgggaggcaaaggtccagtggaaggtggacaacgcactgcagagtggaaatagccaggaatcagtcactgaacaagattcaaaggattcgacttattcgctgtcctcgactctgaccctgagcaaggcagattacgagaagcataaggtctacgcctgtgaagttacccatcaagggttgagctcacctgtgactaagtcgtttaacaggggagagtgc

SEQ ID NO: 15378 - DNA, 714 bp, Artificial Sequence
  Description of Artificial Sequence: Synthetic coding sequence
atggccgtcatggcaccaagaacgctggtgcttctgctgagcggtgctctcgctctgacccagacctgggcagatattcaaatgacccaatcgccgtcctccctttccgctagcgtaggtgaccgtgttaccattacctgtagagcgtcgcaggatgtcaacacggcggtggcctggtaccaacagaaacctgggaaggcacccaaactgctgatatactcggcgtcttttctgtactccggcgtgccctcaagattcagcggatcgcgatctggaaccgacttcaccttgacgatatcctcactgcagcccgaagattttgcaacttactattgtcaacaacattatacgactccacctacttttgggcaaggaaccaaggtggagattaagcggactgtggctgcaccttctgtgttcatattccctccttcagacgaacaactgaagtcaggcaccgcaagcgtggtctgccttctgaataacttttacccaagagaagcgaaggtccagtggaaggtcgacaacgccctccaaagcggaaattcgcaggagtcagttactgagcaggattcaaaggattcgacttactccctgtcctccactcttactctgtcgaaggcagattacgaaaaacacaaggtctatgcctgcgaagtgacccatcagggactctcgtcccccgtgaccaagtcgtttaaccgtggggaatgc

SEQ ID NO: 15379 - DNA, 714 bp, Artificial Sequence
  Description of Artificial Sequence: Synthetic coding sequence
atggccgtgatggcgccgagaacgttggttctgctgcttagcggtgccctcgcattgacgcagacctgggccgacatccaaatgacacaatctccttcctcactcagcgcctccgtcggtgaccgagtcactatcacttgtcgagcaagtcaggacgtcaataccgcagtcgcttggtaccaacaaaaacctggaaaagctcccaagctcttgatctattctgcctccttcttatattccggagtaccctccaggttcagcgggagccggagcggcaccgacttcaccttaacgattagttcactccaacctgaagacttcgccacctactattgccaacagcattacaccacgccacccacgtttggccagggtacaaaggttgaaataaaacggaccgtcgcagcaccgtcggttttcatttttcctccttctgatgaacagttgaagtccggcaccgcgtcagtcgtgtgcctactaaacaacttctacccacgggaagctaaagtccaatggaaggtggataacgcacttcagagtggcaactctcaggaatccgtcacagagcaggactctaaagacagcacctattctctatctagtactcttacgctgtctaaagccgactatgaaaagcacaaggtatatgcctgcgaggttacacatcaaggcttatcaagtcccgtaacgaaatccttcaaccgtggggaatgc

SEQ ID NO: 15380 - DNA, 714 bp, Artificial Sequence
  Description of Artificial Sequence: Synthetic coding sequence
atggctgttatggcaccacgtacgctcgtgctgctactgagtggagccctggctctgacacaaacttgggctgatatccagatgacacaatcgcccagttcgctaagtgcctcagtgggggatcgtgtcactatcacttgccgagcgagtcaagacgtgaatacagcggttgcctggtaccagcaaaagcccggcaaggccccgaagctgttgatctatagcgcgagcttcctatactccggtgtcccatcacgcttcagtggatcccgttctggtactgatttcacacttaccatttcctctctgcagccggaagatttcgccacttactattgtcagcagcattataccacccctccgacgttcggccagggaaccaaggtcgagattaaaagaacggtcgctgccccgtcggtattcatttttccgccgagtgacgagcaattgaagagcggcacagccagtgtggtgtgcttgctgaacaatttctacccgcgtgaggcaaaggtgcagtggaaagtcgataatgcgttgcagagtggaaactcccaggagtcagtcacagagcaggacagcaaagactctacgtactcactgtcgtccacacttacgctgtctaaggccgattacgagaaacataaggtttacgcatgcgaggttacccaccagggcttatcgagccccgtgacgaagagcttcaaccgaggcgagtgc

SEQ ID NO: 15381 - DNA, 714 bp, Artificial Sequence
  Description of Artificial Sequence: Synthetic coding sequence
atggcagtgatggcacctagaactcttgttctgcttctgtccggtgcacttgcactgacccagacttgggcggatattcaaatgacccagagcccttcctcgctctcggcttccgtgggtgaccgggtcaccattacttgtcgcgcgtcccaggatgtgaacactgcagtggcctggtaccaacagaaaccaggaaaggcaccaaaactgctgatctactcggcatcattcctgtacagcggggtccctagcagattttcgggctctcggagcggaaccgactttaccctgaccatctcgtcgttgcaacctgaggactttgcaacttactactgccagcagcactatacgactcccccaacctttggacagggtaccaaggtggagattaagaggactgtggcagcaccctcagtgtttatcttcccaccatcggacgagcagctcaagagtgggactgcatcggtggtgtgcctgctgaacaacttctacccacgtgaggcgaaggtccagtggaaggtggacaacgcactgcaatccggaaactcccaggaaagcgtgaccgaacaagatagcaaagatagcacgtactcgctgagcagcaccctgaccctgagcaaagcagactacgaaaaacataaggtctacgcatgtgaagtcacccatcagggtctgtcctcacctgtgaccaaatcattcaatcgcggcgagtgt

SEQ ID NO: 15382 - DNA, 714 bp, Artificial Sequence
  Description of Artificial Sequence: Synthetic coding sequence
atggcagtcatggcacctcggaccttggtgctcttgctgtcaggagcactcgcccttacccagacctgggcagatatccagatgactcaatctccgtcttccctgagcgcctctgtgggtgacagggtcacaatcacctgccgcgcctctcaggacgtgaacaccgcagtggcctggtatcagcagaaacccggaaaggcgccgaaactgttgatttattccgcaagctttctttatagcggtgtgccgtctcggttctctggctccagatccgggacagacttcacactcacaatatcgtctctacaacctgaggacttcgccacttattactgtcagcaacactatactacaccccccaccttcggacagggaaccaaagtcgagatcaagcgcacagtggctgcccccagcgtattcatctttcctccaagcgacgagcaactgaagtctgggaccgcaagcgtggtctgcctcttgaataacttctatcctcgggaagccaaggtgcagtggaaagtcgataatgctctccagtccgggaatagccaagagagtgtcacagagcaggattctaaggactcgacctattctctgagcagcactcttaccctgagtaaagccgactatgaaaagcacaaggtgtacgcctgcgaagtgacccaccagggactttcatcccccgtcaccaagagcttcaacaggggtgagtgt

SEQ ID NO: 15383 - DNA, 714 bp, Artificial Sequence
  Description of Artificial Sequence: Synthetic coding sequence
atggcggtgatggccccgcgcactctggtgctgctgctctccggcgcactggccctcactcagacctgggcggatatccagatgactcagtcccccagtagcttgtccgcaagcgtcggtgatcgagtgactatcacgtgccgggcttcgcaagacgtgaacaccgccgtggcttggtaccaacagaagccgggaaaagcaccgaagctgctgatctactctgctagcttcttgtattccggagtgccatcgcgcttcagcggatcccgctcggggactgactttaccttgaccatctcatcactgcaacccgaagatttcgccacctactactgccaacaacactacactactccgccgaccttcgggcagggcacgaaggtcgagatcaaaaggactgtcgccgccccgtcagttttcattttccctccgtcagacgagcagcttaagagcggaaccgcctccgtggtgtgcctgctgaacaatttctaccctcgcgaagccaaagtccaatggaaggtggacaatgctcttcaatcaggcaattcccaagaatctgtcactgagcaagatagcaaggattccacgtacagcctctccagcactctgactctctcgaaagcggactacgagaagcacaaagtgtacgcatgcgaagtgacgcatcaggggcttagctcaccggtcaccaagtcctttaatcggggagaatgc

SEQ ID NO: 15384 - DNA, 714 bp, Artificial Sequence
  Description of Artificial Sequence: Synthetic coding sequence
atggcagtcatggcaccaaggactcttgtgcttcttctcagcggtgcgcttgcccttacccaaacttgggccgatattcaaatgacccaatcaccaagcagcctgtcggccagcgtgggagatagagtgaccatcacctgccgggcctcccaggatgtgaacaccgccgtcgcatggtaccagcaaaagcctggtaaggcaccgaaacttctgatctacagcgcatcatttctgtattccggagtgccgtcaaggttttccggatcacggtctggaactgactttacccttaccatctcgtcgctgcaaccagaggattttgcaacttactactgtcaacagcattacactactccccccacctttgggcagggtaccaaagtggaaatcaaacggacggtggctgcgccttcggttttcatcttccccccttcggatgagcagcttaaatcaggtaccgcatcagtggtctgccttttgaataacttctacccaagagaggcaaaggtgcagtggaaggtcgataatgcactgcaatccggaaactcgcaggagagcgtgaccgaacaagattccaaggacagcacgtactccctgagctcgaccctgacgctgtccaaagcggactacgaaaagcataaggtctacgcatgcgaagtcactcatcaaggcctgtcgtctccagtgaccaagtcgttcaaccgaggagagtgt

SEQ ID NO: 15385 - DNA, 714 bp, Artificial Sequence
  Description of Artificial Sequence: Synthetic coding sequence
atggccgtgatggcccctcggacattggtgcttctcctgagtggtgcgctggcgctcacacaaacttgggccgatattcagatgactcagagtccatcctcattgagcgctagcgtcggggacagagtcacaattacatgccgggcatcacaggatgtaaatacagccgtcgcatggtaccagcagaagccaggaaaagccccaaaactgctgatttacagcgcctctttcctgtacagcggggtaccttcccgattttccggctcaaggagtgggaccgattttaccctgacaataagctctttgcaacctgaggacttcgcaacatactattgccagcagcactacactactcctccgaccttcggtcagggcactaaggtggagatcaagcggacagttgctgcccccagcgtcttcatatttcctccctccgatgaacagctcaaaagcgggacagccagtgtggtgtgcctcttgaataatttctacccccgggaggctaaagtacagtggaaagtcgacaatgccttgcagtctggcaactctcaggaaagcgtcactgagcaggattctaaagactccacgtactcgctaagctcaacactgaccttgagcaaggcagattacgagaagcacaaggtgtatgcgtgtgaagtcacacatcagggcctcagctcccctgtgaccaagtctttcaatcgcggggagtgt

SEQ ID NO: 15386 - DNA, 714 bp, Artificial Sequence
  Description of Artificial Sequence: Synthetic coding sequence
atggctgtcatggcaccgagaacacttgtgctcctgttgtcgggcgcgctggcacttacacaaacctgggcagacattcaaatgactcaaagcccatctagcctgagcgcaagtgttggagacagggtcactataacatgcagagcgagtcaagatgtgaacactgccgtggcgtggtaccagcagaaacccgggaaagcacccaaactgctgatctacagcgcctcatttctgtactccggggtcccttctcgtttcagcggatcaaggtccggtacagactttacactgaccatctcttcactgcaacccgaggacttcgccacatattactgccagcagcactatacaacgccccccacatttgggcagggaaccaaagtcgagatcaagcgcaccgtcgccgctccttccgtttttatttttccacctagtgatgagcagctgaagagtggcacagcctcagttgtgtgcttgcttaacaacttctaccctcgtgaggccaaggtccaatggaaagtggacaacgcactgcaaagcggaaacagccaagagagcgtcacagaacaggacagtaaggattctacttactccctgagtagcaccttaaccttatctaaagcggattatgagaagcacaaagtctacgcatgcgaggtaacacaccaaggattatcatcgccagtgacaaagtcctttaatagaggggagtgc

SEQ ID NO: 15387 - DNA, 714 bp, Artificial Sequence
  Description of Artificial Sequence: Synthetic coding sequence
atggctgtaatggctccaagaacccttgtgcttctgctgtccggagccttggccctgactcaaacctgggctgacatccagatgacgcagtcaccatcttccctctctgctagcgtcggcgatagggtgaccatcacctgcagggcttctcaggacgtgaataccgctgttgcatggtaccagcaaaagcctggcaaggcaccaaagctgctgatctactccgcttcatttttgtactccggagtccctagtcgcttctcaggaagtagatctggtactgatttcacccttactatcagcagtctgcagcctgaggattttgcgacctactattgccagcagcactacacaactccacccacctttggccaaggaacaaaagtcgagatcaagagaacggtcgcagcaccaagcgtcttcattttcccacccagcgacgagcagttgaagagtggaaccgcctcagtagtttgtctgctcaacaatttctacccaagagaagccaaagttcagtggaaggtcgacaacgcgctgcaatccggcaactctcaggaatctgtgactgagcaggactccaaggattcaacctactctctcagctctactttgaccctcagcaaggctgactatgaaaagcataaggtctacgcctgcgaggtgacgcatcagggactgtcttcacccgtgaccaagagcttcaacaggggagagtgc

SEQ ID NO: 15388 - DNA, 714 bp, Artificial Sequence
  Description of Artificial Sequence: Synthetic coding sequence
atggcggtgatggccccacggacgctggtgctgctgctttcaggtgcgctcgccctcacccagacctgggcagacatccaaatgacccagtcgccgagctctctgagcgcgagcgtcggagatcgcgtgaccatcacttgtcgagcctcgcaagacgtgaatactgctgtggcttggtaccaacagaagcccggcaaagcaccaaagctgctgatctacagcgcctcattcctgtactctggagtgccaagcagattctcgggatcccgctcaggcactgactttaccctgaccatcagctccctgcagccggaagatttcgccacttactactgtcagcaacattacaccaccccgcctacttttggacaaggtaccaaagtcgagatcaagcgcactgtggcggcaccatcggtgtttatcttcccgccgtccgacgaacagctcaagtcagggactgccagcgttgtgtgtctgctcaacaatttctatccgcgggaagctaaggtccaatggaaggtcgataacgccctgcagtcgggtaattcacaggagagcgtcactgagcaggactccaaggactcaacgtactccctgtcaagcactctcaccctctccaaagccgactacgagaagcacaaggtctacgcttgcgaagtgacccaccagggcctgtcgagcccagtgacgaaatcattcaatcggggcgaatgc

SEQ ID NO: 15389 - DNA, 714 bp, Artificial Sequence
  Description of Artificial Sequence: Synthetic coding sequence
atggctgtcatggccccacggactcttgtgctgctcctgtcaggtgcattggccctgacccaaacgtgggctgacatccaaatgacccaatccccctcgagtctttcggcctccgtgggagatagagtcaccatcacctgccgcgcgtcgcaggatgtgaatactgcggtcgcatggtaccaacagaagcctggaaaggccccgaagctgcttatctactccgcgtcctttctctactcgggagtgccgtcgagattctcggggagccgcagcggaaccgatttcactctgaccatctcttccctccagccagaagatttcgctacgtattactgccagcaacattacactactcctccaactttcggacaggggactaaggtggaaatcaaaaggactgtcgctgcgccatccgtgttcatcttcccgccgtccgacgagcaactcaagtcgggtaccgcctcagtggtgtgcctgctgaacaacttttatcctcgcgaggccaaagtgcagtggaaagtggataacgcgctgcagtcggggaactcgcaagaatccgtgaccgagcaagatagcaaggactcgacttattcactgtcctcgactctcactctgagcaaagccgactatgagaaacacaaggtgtacgcatgcgaggttacccaccagggattgtcctcgccagtcaccaaatcgttcaaccggggcgaatgt

SEQ ID NO: 15390 - DNA, 714 bp, Artificial Sequence
  Description of Artificial Sequence: Synthetic coding sequence
atggccgtgatggctccacgcaccctcgttctgctccttagcggagccctggctctgacccagacatgggccgatatccagatgacacagagtccttcatctctctcagcctctgtcggtgatagagtgactattacctgcagagcctcacaggacgtgaataccgccgtcgcctggtaccagcagaaacctggaaaggcccccaagcttctcatctactccgcaagttttctgtattcaggcgtgccctcacggtttagtgggtctaggagcgggaccgatttcacactgactatcagttcactgcaaccagaggactttgccacatattactgccagcagcattacacgacaccccccacattcggacaggggaccaaagttgaaatcaagaggacagtggcggccccatctgtgttcatctttccacctagcgatgaacagttgaagtcagggacagcctctgtagtttgtctcttgaacaatttctaccccagagaggccaaggtccagtggaaggtcgacaacgctttgcagtccgggaacagccaggaatccgtgacggaacaggacagtaaagatagcacctacagcctctcatctacactgacgctgtccaaagccgattacgaaaagcacaaggtttatgcatgcgaagttactcaccagggactttcttctccagtgaccaagtcttttaatcggggcgagtgt

SEQ ID NO: 15391 - DNA, 714 bp, Artificial Sequence
  Description of Artificial Sequence: Synthetic coding sequence
atggccgtcatggcccctcgaactctggtgctactgttgtcgggagctttggccctgacccagacatgggccgacattcagatgacgcagtctccttcctccctctccgcctccgtcggcgaccgggtgaccatcacctgccgagcctctcaggatgtgaacaccgctgtagcctggtatcagcagaagcctgggaaggctccaaagctgctcatttacagtgcttcatttctatattctggcgttccttcgcgcttttcaggttcacgcagcgggactgacttcaccctcacaattagcagtctgcagcctgaagattttgcaacctattattgtcagcagcattacacaactccacctactttcggacaaggcacgaaggtcgagattaagaggaccgtggcagcgccttctgtctttatattccccccgtcagacgaacaactcaaaagcggcaccgccagcgtcgtgtgcctgctcaacaatttctatccacgcgaggcaaaggtgcaatggaaggtggacaacgccctgcagagtggaaactctcaggaatctgtcaccgagcaggactccaaggattctacctatagcctttcaagcacacttacattgtctaaggcagattacgagaagcataaagtttacgcatgcgaagtcacccaccaggggctgagcagccccgtgaccaagtcttttaacaggggcgagtgt

SEQ ID NO: 15392 - DNA, 711 bp, Artificial Sequence
  Description of Artificial Sequence: Synthetic coding sequence
atggcggtcatggccccgcggactctggtgctgctgctcagcggtgcacttgcactcacccaaacctgggcacagatcgtgctgagccaatcgcctgctattttgtccgcatctccaggggaaaaggttactatgacttgtagggcatcctcctcagtgtcgtacatccattggtttcagcagaagcccgggtcgtcaccaaagccctggatctacgcaacttcaaacctggcatcaggtgtgccagtgagattcagcggatccggctctggcacgtcctactcacttacgatttccagggtcgaagcggaagatgccgcaacctactactgccagcagtggacttccaacccgcccacctttggtggcggtactaaactcgagattaagcgcaccgtggcggcaccttcagtgttcatttttcccccaagcgacgaacagcttaagagtggcactgcatcggtcgtgtgtctgcttaacaacttttaccctcgggaggcaaaggtccagtggaaggtcgataacgcactccaatcaggaaattcccaagagagcgtcaccgaacaagatagcaaagattcgacgtattccctgagctcgacccttacgctttccaaagcagattatgaaaagcataaggtgtacgcatgtgaagttactcatcaaggactttcctcaccggtgactaagtcgttcaatcgcggagagtgt

SEQ ID NO: 15393 - DNA, 711 bp, Artificial Sequence
  Description of Artificial Sequence: Synthetic coding sequence
atggcagtcatggcgccgcggacactcgttcttttactttctggagctctcgcccttacacagacgtgggcacagattgtcctgtctcagtctccggcaatcctgtccgcttctccaggagaaaaagttacaatgacatgcagggcgagttcatccgtgtcttatatacattggtttcagcagaagccgggttcttctccaaaaccttggatttatgccacaagtaatcttgcgtctggagtccctgtgcggtttagcggctctggatccggcacatcatactcattgacaatttcgagggtagaggcagaggatgcagccacgtactactgccaacagtggacctccaatccgcctacgttcgggggcggtaccaaactggaaatcaaaagaacagtggcggctccctcagtatttatctttccgccgagcgatgagcagttgaagtctggcacggccagtgttgtttgccttctgaataatttttatccgcgagaagcaaaagttcaatggaaagtggacaacgctttacaatctggaaactcccaggaaagtgttactgaacaagactccaaagactccacctattcattgtcaagcacgttgacgttgtcaaaagccgattatgagaagcataaagtatatgcgtgtgaagtaactcatcaaggactgagctctccggttacaaaatcttttaatagaggcgagtgt

SEQ ID NO: 15394 - DNA, 711 bp, Artificial Sequence
  Description of Artificial Sequence: Synthetic coding sequence
atggcagtgatggcgccacgcacattggtgttgcttcttagtggtgctttagctcttacccaaacttgggctcaaattgtgctttctcaaagccctgctattctctccgcctcacccggcgaaaaagttacaatgacttgccgagcatctagctccgtcagctatattcattggtttcaacaaaaaccgggttcttctccaaagccatggatttacgctacatcaaatcttgcttcgggagtcccagttcgcttcagtggttccggatctggaacatcttattccttgaccatttcacgagttgaggcggaagatgcggccacgtactattgccagcaatggacttctaatccaccaactttcggcggaggaactaagttggaaattaaaagaacagttgccgccccatctgtgtttatttttccgccatcagatgaacaacttaaatctggaacggcttctgtggtttgccttcttaacaatttttacccgagggaggcaaaagttcagtggaaggttgataatgctctgcagtcaggaaattcgcaagaatccgtgaccgaacaagatagcaaagattctacgtattctctgtctagtactctcacacttagtaaagctgactacgaaaagcataaggtttacgcttgcgaggtgactcaccagggcttgtcaagccctgtaacgaagagttttaaccgtggtgaatgt

SEQ ID NO: 15395 - DNA, 711 bp, Artificial Sequence
  Description of Artificial Sequence: Synthetic coding sequence
atggccgtcatggctcccagaacgcttgtcctgctgctttccggagcccttgcgctgacccaaacctgggctcaaatcgtgttgtcccagtccccagccatactgagcgcatcacccggagaaaaagtcaccatgacctgtcgtgcatcttcatctgtctcctacattcactggtttcagcaaaagcctggttccagccctaagccatggatttacgctacttccaatctcgcatccggcgtgcctgtccgcttctcaggtagcggctccggaacctcatactccctgaccattagccgagtggaagctgaagatgccgcaacgtactactgtcaacagtggacctcaaatcccccgacttttggtggcggcactaagctggagattaagcggaccgtggcagccccctcggtgtttatcttccccccttctgacgaacagctcaagtcaggaactgcgtcggtggtctgcctcttgaacaacttttacccccgggaggctaaggtgcagtggaaagtggacaacgcactccaatcaggaaacagccaagaatcggtcacggagcaagattcgaaagacagcacctacagcctgtcctccactctgacccttagcaaggccgactacgaaaagcacaaggtctacgcgtgtgaagtcactcatcagggcctcagctcgcctgtgaccaaatcctttaaccgcggagagtgc

SEQ ID NO: 15396 - DNA, 711 bp, Artificial Sequence
  Description of Artificial Sequence: Synthetic coding sequence
atggcagtgatggccccccgcactcttgtcctattactatcaggcgcccttgcactgacgcagacttgggcgcaaatcgttttgtcacaatcaccagccattctcagcgcctctcctggagaaaaagttactatgacgtgccgggcctcgagttccgtctcctatattcactggttccagcagaagcccggctcctcccctaagccctggatttatgccacaagcaacctggcctccggagtccccgtccgttttagcggtagcggttctggtacctcttattcccttacgatttcccgcgttgaggctgaagatgcagcgacatactattgccagcagtggaccagcaatcccccaaccttcggcgggggtaccaaactcgaaataaagcgaacagtggctgccccctcagtttttatatttcctccaagcgatgagcagcttaaatcaggtaccgcgtctgttgtgtgtctactcaataacttctatcccagggaggctaaagtgcaatggaaggtggataacgctctacagtccggaaatagtcaggagtccgtgacggaacaggattcgaaggattccacctatagcctttcctccaccttaaccctttccaaggccgattatgaaaaacataaggtgtatgcatgcgaggtgactcatcaagggcttagtagtccggtcactaagtcgttcaaccgaggcgagtgc

SEQ ID NO: 15397 - DNA, 711 bp, Artificial Sequence
  Description of Artificial Sequence: Synthetic coding sequence
atggctgtgatggcccctagaactctggtgttgctcctgtccggagcccttgctctcactcagacttgggctcaaatcgtgctgagccagtcaccagccatcctctccgcgagcccgggagagaaggtgactatgacctgcagggcgagctcgtcggtgtcatacatccactggtttcaacagaaaccaggctcatccccaaagccttggatctacgcgacgtcaaacctggcctcaggagttccggtccgctttagcggatcgggcagcggaacttcttactccctcacgatctcgagagtggaagcagaagatgccgccacctactactgccagcagtggacctcaaatccaccgactttcggagggggaactaagctcgagatcaagagaactgttgctgcaccgtcggtattcatcttccctccgtcagatgaacagcttaagtcgggaaccgcctcagtcgtctgtctcctgaacaacttctacccgagggaagcgaaggtgcagtggaaggtggataacgcgttgcagtcagggaatagtcaagaatccgtcaccgagcaagactcaaaggattcaacttatagcctctcatccacccttaccctgagcaaggccgactatgagaaacacaaagtgtacgcgtgtgaggtgacccatcagggcctgtcctcaccggtgaccaagtcgttcaaccgcggggaatgt

SEQ ID NO: 15398 - DNA, 711 bp, Artificial Sequence
  Description of Artificial Sequence: Synthetic coding sequence
atggccgtaatggccccgaggacactggtgcttctcctgagcggcgcactggcccttacacagacatgggctcagatagtgttgtcgcagtccccagccattttgtccgcctcccccggggaaaaggttaccatgacatgtagggctagctcaagcgtgtcctacatccattggtttcagcagaaacctggaagctccccaaagccctggatttatgccaccagcaatcttgccagtggagtgcctgtgaggttcagcggcagcgggtccggcacgagctacagcttaaccatttctagggtcgaggctgaagatgcggcaacatactattgtcagcaatggacctcaaatcctcctactttcggaggcggaactaaactagagattaaaagaacagtcgccgcaccctcagtgttcattttcccacctagcgatgagcagttgaaatccgggactgcaagcgtagtgtgtcttctgaacaatttttatccccgtgaggctaaagtacagtggaaagtggataatgccctgcagtcaggtaatagccaggagagcgtgaccgagcaagattctaaggattctacatactcactgtcttctaccctcaccctcagtaaagcagactatgagaagcacaaggtgtacgcgtgcgaagttacgcatcagggcctttcaagtccggtaactaagtcctttaatagaggcgagtgc

SEQ ID NO: 15399 - DNA, 711 bp, Artificial Sequence
  Description of Artificial Sequence: Synthetic coding sequence
atggcagtaatggcaccaagaacacttgttttgcttttatcaggagctttagcattaacacaaacatgggcacaaattgttttgtctcaatcaccagctattctttctgcatcacctggtgaaaaagttactatgacatgtagagctagttctagtgtaagttatattcattggttccaacaaaaacctggatcttctccaaaaccttggatttatgcaacaagtaatttggcatcaggtgtacctgtaagatttagtggttcaggttctggaacaagttattcattaactatttcaagagttgaagcagaggatgcagcaacatattattgtcaacaatggacttcaaatccaccaacctttggaggaggaactaaattagaaattaaaagaactgttgcagcaccaagtgtttttattttcccaccatcagatgaacaacttaaatcaggaactgcttcagtagtttgtcttttaaataacttttatccaagagaagcaaaagtccaatggaaggtagacaatgctttacaaagtggaaatagtcaagagtcagttactgaacaagatagcaaagatagtacatactcacttagttctaccctaactttatctaaagctgattatgaaaaacataaggtatatgcatgtgaagttactcatcaaggacttagtagtccagttactaaaagtttcaatcgaggagaatgc

SEQ ID NO: 15400 - DNA, 711 bp, Artificial Sequence
  Description of Artificial Sequence: Synthetic coding sequence
atggcggtgatggctcctaggactttggtactgctgttgagtggagctttagccctcacacagacctgggcgcaaatcgtactgagtcaatcaccagcgatactgtcggcatccccgggagagaaggtgacaatgacgtgtcgggccagctcttctgtgtcctacatacattggtttcagcaaaagcctggttcctcgccgaaaccatggatctatgccacttcaaacctggcaagcggagttccggtgaggttctccgggtctggctcagggacgtcgtactctctcacaatcagccgcgtcgaggctgaggatgccgccacctactattgtcagcagtggacctcgaacccgccaactttcgggggaggcactaagctggagatcaagcgcactgtggccgccccctcggtgtttatcttcccacccagcgatgagcagttaaaatccggtaccgcttctgtcgtgtgtctgctgaataatttctacccgcgcgaagcaaaggtgcagtggaaggtggataatgctttgcaatccggcaactcccaggaatccgtcaccgaacaggacagtaaggatagtacatactctctgtcatctacgctcacactgtccaaggccgattacgagaagcacaaggtatatgcgtgtgaggtcacccaccagggtctgagctccccagtgacaaagtccttcaatcgaggagaatgt

SEQ ID NO: 15401 - DNA, 711 bp, Artificial Sequence
  Description of Artificial Sequence: Synthetic coding sequence
atggccgtcatggcaccgcgcacgctggtcctcctgttaagcggagctctcgcgctcactcagacatgggcacaaattgtgctgtctcagagccccgctatcctgtctgcgtccccaggcgagaaggtgactatgacttgccgcgctagctctagcgtgagctacatacattggttccagcagaagccgggctcctcaccgaagccgtggatctacgcaaccagcaacctcgctagcggtgttcctgttcggttcagcgggagcgggtctggcacatcatattcattgactatctcccgggtggaagccgaggacgcagcaacttattactgccagcagtggacgagcaatccaccaactttcggcgggggtaccaaactggaaatcaagagaactgtggccgctcctagtgtgttcatcttcccccccagcgatgagcagctcaaatcaggtaccgctagcgtggtgtgtctcctgaataacttctatccgcgggaagcgaaagtgcaatggaaggtcgataacgccctgcagagtgggaattcacaggaaagcgtgacggaacaggattccaaggattctacctatagtctctcctctacactgacactgagcaaggcagactacgagaaacacaaggtatatgcttgcgaggtcacacatcagggtctctcgtcccccgtgactaagtcatttaatagaggggagtgc

SEQ ID NO: 15402 - DNA, 711 bp, Artificial Sequence
  Description of Artificial Sequence: Synthetic coding sequence
atggccgtgatggccccaagaactcttgtgctgcttctgtccggagcactggcgttaacacagacttgggcacagatagtgctgtcacaatcccctgccatcctcagcgccagccccggcgagaaggtgacaatgacgtgtagagcaagctcgagcgtatcctatatccattggttccagcagaagccaggctctagtcccaaaccttggatctacgcaacctccaatctcgcttctggtgtgcctgttaggttctcgggctctggttcagggacctcgtatagtcttacgatctcccgcgttgaagctgaagatgcggctacttattactgtcagcagtggacatcaaacccccccaccttcgggggagggacaaaactcgaaatcaagcgaaccgtggccgcaccatcggtgttcatcttcccaccatccgatgagcagttgaaaagcggaacagccagcgtggtctgccttctgaacaatttctatcccagggaggctaaggtccagtggaaagtggacaacgccctgcagtccggaaatagccaggagtccgtgacagagcaggactcgaaggactccacctactccttaagttctacactaacactttccaaagcggattacgaaaagcacaaagtgtatgcttgtgaagttacacatcagggcctctcatcccctgtgactaaaagctttaacaggggcgagtgc

SEQ ID NO: 15403 - DNA, 711 bp, Artificial Sequence
  Description of Artificial Sequence: Synthetic coding sequence
atggctgtgatggctccgcggacgcttgttttgctgctcagcggagcactggctctgacccagacctgggcgcagattgtcctctctcagtccccggcgatactttcagcctctccaggagagaaggtaacaatgacatgtcgggcaagttccagcgtttcatatatccattggtttcagcagaagccaggtagttcacccaaaccctggatatacgcaacatccaacttggctagtggggtcccggttaggttttccggttctggatccggaacaagctattcactgacaatctccagagtcgaagctgaggatgcagcaacatactattgtcagcagtggacaagcaacccacccactttcggtggtggtactaaactcgagattaaacgtacagtcgcagctccaagcgtcttcatttttcctcctagcgatgaacagctcaaatcaggcacggcctccgttgtgtgcctcttgaacaacttttaccctcgcgaagccaaggtccagtggaaggtggacaacgctctacagagcggaaacagtcaggagtcagtcaccgagcaggattccaaggatagtacatactctttatctagtacactgacccttagcaaagctgactacgagaagcataaagtctatgcctgcgaggtaacacaccaagggcttagctcccctgtgacgaagtccttcaaccggggagagtgt

SEQ ID NO: 15404 - DNA, 711 bp, Artificial Sequence
  Description of Artificial Sequence: Synthetic coding sequence
atggccgtcatggcacctcgcactctcgtgctgctgcttagcggagcactggccctcactcagacctgggcgcagattgtgctctcccagtctcctgcgatcctctcagcctcgccaggtgaaaaggtcacgatgacctgcagagcctcctcctcggtgtcctacatccattggttccagcaaaagccgggatcctcgccaaaaccgtggatctatgcaactagcaacctcgcatcaggcgtgcccgtgcgcttctcgggcagcgggagcggaacgtcgtactcactgaccatctctcgcgtggaagcggaagatgcggctacctactactgccaacagtggacctccaacccaccgactttcggagggggaacgaagttggagattaagagaaccgtggcggcaccatccgtgttcattttcccgccaagcgacgaacagctcaagtcgggcactgcctcggtggtctgcctgcttaacaatttctaccctcgggaagcgaaggtgcagtggaaagtggacaacgccctccagtcggggaacagccaggagagtgtgactgaacaggacagcaaggactcgacttactccttgagcagcactctgactctctcaaaggccgactacgagaagcacaaggtgtacgcctgcgaggtgactcaccagggactgagcagcccggtcacgaagtcgttcaatcgcggagagtgc

SEQ ID NO: 15405 - DNA, 711 bp, Artificial Sequence
  Description of Artificial Sequence: Synthetic coding sequence
atggcagtgatggcccctagaacgctggtgctccttttgagcggtgcacttgctcttacccagacttgggcgcagatcgtcttgtcacagtcgccagcaattctgtcggcatcacctggagaaaaggtgacgatgacttgtcgggcttcgtcgtcggtatcctacatacattggttccagcagaaacctgggtcgtcgcctaagccatggatttacgcaacctccaaccttgcaagcggagtgcccgtgcggttttccggatccgggtccggcacctcctactccctcaccatttcacgcgtggaggcggaagatgcagccacgtactactgtcaacagtggacctcgaatccgcctacctttggtggaggaactaagctcgagattaaacgcaccgttgcagcgccttcggtgttcatatttccaccctccgatgaacagctcaagtccggcactgcatctgtggtgtgccttcttaacaacttttacccaagggaggccaaggtccagtggaaggtggataatgcgttgcagtctggtaatagccaagagtccgtgactgagcaggattccaaggactcgacctattcgctgtcgtccacgcttacccttagtaaagctgattacgaaaaacacaaggtgtacgcatgtgaagtcactcatcaggggctctcctcacctgtgactaaatcattcaaccgaggcgaatgc

SEQ ID NO: 15406 - DNA, 711 bp, Artificial Sequence
  Description of Artificial Sequence: Synthetic coding sequence
atggccgtcatggccccccgcacgctggtattgctgctgtcaggagcactggcccttacacaaacctgggcccaaattgtcctctctcagtctccagcaattctgtcagcttctcccggcgagaaggtgactatgacctgccgggcctctagcagcgtatcctacatacactggtttcagcagaaaccgggcagtagtcctaagccatggatctacgcgaccagcaacctggcttctggagtgcccgtgagattttctggctctgggtcaggcacctcatattctctgaccataagccgggtagaggcggaggacgccgctacctactactgtcagcagtggacaagcaacccgcccaccttcgggggagggaccaaactagaaataaagcgcacagtggctgcaccaagtgtcttcatctttccgccatcggatgagcagctcaagagtggaacagccagcgtggtgtgtctgcttaacaacttttatccaagggaagcaaaagttcaatggaaagtggataatgccctgcaaagcggcaatagccaggagagcgtgacagaacaggatagtaaagatagcacttatagtctctcctcaaccctgactttgtctaaggctgattatgagaagcataaggtttatgcttgcgaggtcacccatcagggcctgagctcccctgtcacaaagtcattcaaccgaggggagtgt

SEQ ID NO: 15407 - DNA, 711 bp, Artificial Sequence
  Description of Artificial Sequence: Synthetic coding sequence
atggctgtgatggccccacggaccttggttctcctcctgtccggagcactcgcactgacccaaacctgggcgcagatcgtgctgtcacagagccctgctatcctgtctgcgtcgcctggtgagaaagtcaccatgacttgtcgggcctcatcctcggtgagctacattcactggttccagcagaagcctggatcgtcaccaaagccgtggatatatgcaacctcgaatctggcgtccggcgtcccagtgcgtttctctggatcaggatcaggaaccagctactccctcaccatctcgcgcgtcgaagccgaagatgccgcaacttactattgtcaacagtggacttcgaaccccccgacttttggcggaggtacgaaactggagatcaagcgcacggtggcagcgccctcagtgttcatctttccgccttcggacgagcagctcaagtcgggtactgcctccgtggtgtgcctcctgaacaacttctacccgagagaagctaaggtgcaatggaaggtcgataacgccctgcagtcggggaattcccaagaatctgtgactgaacaagactccaaggactcaacgtactcgctgtcgagcacgcttaccttgtccaaagccgattacgaaaagcacaaagtctacgcgtgcgaggtgacccatcagggactgtcgagcccagttactaagtctttcaaccgaggggagtgc

SEQ ID NO: 15408 - DNA, 711 bp, Artificial Sequence
  Description of Artificial Sequence: Synthetic coding sequence
atggcagtgatggcaccgcgcaccctggtgctcctgctgtccggcgccctcgcactgacccaaacctgggcgcagatcgtgttgtcccagtccccagccatcctttcagcttcccccggggaaaaggttaccatgacgtgcagggcctcatcctcagtcagctatatccattggttccagcaaaagccgggttcctcgccgaagccttggatctacgcaacttcgaacctggcctcgggggtgccggtgcggtttagcggctcgggatccgggacctcatactcgctcactatcagccgggtggaggcggaggatgccgcaacttactactgccagcagtggacttccaaccctccaacctttggtggcggaactaagctggaaatcaagaggaccgtcgccgccccatccgtgtttatcttcccgccatcggatgagcagctgaagtccggaactgcctcggtggtctgcctgctcaataacttctacccgagagaggctaaggtgcaatggaaggtggacaacgcgctgcagtcgggaaactcacaggagtcggtgaccgaacaggattcaaaggacagcacctactccctgagctcgaccttgactctcagcaaggccgactacgaaaagcacaaggtctacgcgtgcgaagtcacccatcaaggactgtcaagcccggtgaccaaatccttcaatcggggagagtgc

SEQ ID NO: 15409 - DNA, 711 bp, Artificial Sequence
  Description of Artificial Sequence: Synthetic coding sequence
atggcagtcatggccccccgtactttggttctgctactgagcggagccctcgcactcacccaaacgtgggcacagattgttttatcacaatcaccggctatcctctcagcctctccaggcgagaaggtgacgatgacctgccgcgcatcgagttccgtgagctacatccattggttccagcagaaacccggttcctcgcctaaaccgtggatctacgccacttcgaacctggcctcaggcgtccctgtcaggttcagcggttccgggagcgggacctcttatagtcttaccattagcagggtggaggccgaagatgccgcaacatattactgccagcagtggacgagtaacccgcctacattcggggggggcacgaagctggagattaaacggacagtagctgcaccgtccgtcttcatttttccgcccagtgatgaacaattgaagtctggcaccgcatccgtcgtatgcttgctcaataatttctatccccgggaggcaaaggtacagtggaaggtcgacaatgctctgcaatctgggaactctcaggaatccgtgactgaacaggattccaaagattctacgtatagcttgtctagcacactcactctatctaaggctgattacgaaaaacacaaggtatacgcctgcgaggtgactcatcagggattgtctagtccagtgactaagtcgttcaacagaggagagtgc

SEQ ID NO: 15410 - DNA, 711 bp, Artificial Sequence
  Description of Artificial Sequence: Synthetic coding sequence
atggcagtgatggcaccgcgtactcttgtgctcctgctgtcgggtgcgcttgcgctgacccagacttgggcacaaattgtgctgagccagtcccccgccatcctctccgcttccccaggcgagaaagtgacgatgacttgtcgggcttcgtcatcagtgtcatatatccactggttccagcagaagccaggaagctctcctaagccctggatctacgcaaccagcaacctggccagcggggtccctgtgcgcttctccgggtcgggatccggaacctcgtacagcttgactatcagcagagtcgaggcggaagatgccgcgacttactactgtcagcagtggacttccaatccgccgactttcggagggggaactaaactggagatcaaaaggactgtggcagcgccgtcagtgtttatcttccccccttccgacgagcagctgaaatcaggcaccgccagcgtcgtgtgcctcctgaacaacttctacccgcgcgaggccaaagtgcagtggaaggtggacaatgcgctgcagagcggaaatagccaggagagcgttaccgaacaggactcgaaagattccacctactcgctttcctccactctgaccctgtcgaaggccgactacgagaagcataaggtgtacgcatgcgaggtgacgcatcaaggactgtcctcgcccgtgactaagagcttcaatcgcggagaatgc

SEQ ID NO: 15411 - DNA, 711 bp, Artificial Sequence
  Description of Artificial Sequence: Synthetic coding sequence
atggccgtcatggcaccaaggacgctggttttactgctcagcggggcactggccctcacgcagacctgggctcagattgttctgtcacagagccctgctatcctgagcgccagccccggagagaaggtaaccatgacctgcagagctagcagtagcgtgagctatatccactggttccaacagaaaccagggagctcgcctaagccatggatctacgccacaagcaatcttgctagtggcgtgccagtgcgtttttccggcagcggctctggaaccagctactccctgacgattagtagggttgaggctgaagacgcagcgacctattattgccagcaatggaccagcaacccacctacattcgggggcggaacgaagcttgaaattaaacgtaccgtcgctgccccatcagtgttcatttttcccccttcggatgagcaactcaagagcggaaccgcaagcgtcgtgtgcttgctgaacaacttttatcctcgcgaagcaaaggtccagtggaaggttgacaacgccctgcagtctggaaattcccaggagagtgtgaccgagcaagactccaaagatagcacatacagtctgtcatctacactgactctgtctaaagcggactatgagaaacataaggtgtatgcctgtgaggtgacacaccagggactgagtagcccagtcaccaaaagcttcaatagaggagaatgt

SEQ ID NO: 15412 - DNA, 711 bp, Artificial Sequence
  Description of Artificial Sequence: Synthetic coding sequence
atggcggtgatggcacctagaaccctagtactgctgctgagtggggctctcgcgctgacccagacctgggcccagatagtcctgagtcagtcaccagctatcctcagcgcttctcctggagaaaaagttaccatgacctgccgcgcatccagcagcgtgagttacattcattggtttcagcagaaacccggcagttcccctaaaccctggatctacgccacctccaatctggcaagcggggtgccagtgagattcagtggaagcggatcaggtacatcctatagcctgacgatttctcgcgtcgaggccgaggatgctgccacctattactgccagcaatggacgagcaaccctcccacattcggcggtgggaccaagctggagataaagcgcaccgtagccgctccgtccgtgttcatcttccctcctagcgatgagcagcttaaatctgggaccgcttcggtggtgtgcctcttaaacaatttttatccacgggaggctaaagtgcagtggaaagtggataatgcccttcagtccggaaattcccaggaaagcgtcaccgagcaagattccaaagacagtacctatagcctgagctcaacgctgaccctctcaaaagcagattatgagaaacacaaggtgtacgcttgcgaggtgacccaccagggattgtctagtccagtgacaaagtcatttaataggggcgagtgt

SEQ ID NO: 15413 - DNA, 711 bp, Artificial Sequence
  Description of Artificial Sequence: Synthetic coding sequence
atggccgtgatggcaccccggactctggtgctgctcctgagcggagctctggccctgactcagacttgggcacagatcgtgctcagccagtcccctgccattctgtccgcgtcgccaggggaaaaggtgacgatgacttgccgggcctcgtcgagtgtctcatacatccactggttccagcagaagcctggatcatccccaaagccgtggatctatgccaccagcaatcttgcttcaggtgtgccggtgagatttagcggctcgggttcaggcacctcatactccctgactatctcacgggtggaggccgaggacgctgctacttactactgccaacagtggacctcgaacccgccaactttcggaggaggaacgaaactcgagattaagcgcactgtggcggcgccgtccgtgttcatctttccaccgtcagacgagcagctgaaatcgggcactgcctccgtcgtttgtctcctcaacaacttctacccacgggaagctaaggtgcagtggaaggtcgacaacgcccttcaatcgggaaactcacaagaatccgtcacggagcaggatagcaaagatagcacttactctctgagctccactctgacgctgtcgaaggccgattacgagaagcacaaggtctacgcgtgcgaggtgactcaccaggggctcagctcgccggtgaccaagtcctttaatcgcggcgaatgc

SEQ ID NO: 15414 - DNA, 711 bp, Artificial Sequence
  Description of Artificial Sequence: Synthetic coding sequence
atggccgtcatggccccacggaccctcgtgctgctgctgtcgggagctctcgctctcacccagacctgggctcagatcgtgctgtcgcagagcccagcaatcttgagcgctagcccgggcgaaaaagtgactatgacctgccgggcgagcagctcggtttcttacatccactggttccaacagaaaccgggatcctcgccgaagccatggatctacgcaacttccaacctcgcctcgggggtgcccgttcggttctctggcagcggatccggaacctcctactcgctcactatctcgagggtggaagcagaggacgctgctacttactactgtcaacagtggacgtcgaatccacctaccttcggagggggcactaaacttgaaatcaaacggactgtcgcagcaccctccgttttcatttttccgccttcggacgagcagctgaagagtggaactgcttcggtcgtgtgtctgttgaataacttttatccacgcgaggctaaggtgcagtggaaggtggataatgccttgcagtccggaaacagccaagaatcggtgactgagcaggactccaaggactcgacgtacagcttgtcatcgaccctgactctgtcgaaagcggactacgagaagcacaaagtctacgcctgcgaagtcactcatcaaggtctgagctcccctgtgactaagtctttcaaccgcggagaatgc

SEQ ID NO: 15415 - DNA, 711 bp, Artificial Sequence
  Description of Artificial Sequence: Synthetic coding sequence
atggccgtgatggctccgcgtacacttgtgctcctgttgagtggagctcttgcacttactcaaacatgggcccaaattgttctttctcagtcgcctgctatcttgagtgcctcccctggcgagaaggttactatgacttgtagagcatcctcatctgttagttatattcattggttccaacaaaaaccgggatcttcacctaagccgtggatttatgctacttcaaatcttgcctcgggagttcccgtgcgttttagtggtagcgggtcaggtacctcttactctctgacgatctctagggttgaggcagaagacgccgccacctactactgtcaacaatggacttccaatccgccgacttttggagggggaacgaagttggagattaagcgtacagttgcagcacctagtgtctttatttttcctccatcagatgaacaactcaagtcagggacagcctctgtggtttgcctcctcaataacttttacccacgggaggcgaaggttcaatggaaagttgataatgcactccaaagtggcaattctcaagagagtgtgacagagcaagatagcaaggattcgacctatagtctttccagcacattgacactctctaaagccgactatgagaaacataaagtatacgcttgcgaagtcacacaccagggtcttagttcccctgtaaccaagtctttcaacagaggtgaatgc

SEQ ID NO: 15416 - DNA, 711 bp, Artificial Sequence
  Description of Artificial Sequence: Synthetic coding sequence
atggccgtgatggcgcctagaaccctggtgctgttgctgtccggtgcccttgcgctgacccagacctgggcacaaatcgtgctctcgcagtcccccgcaattttgtcagcgtcacctggggagaaggtgaccatgacgtgtcgagcatcttcatcagtgagctacattcattggttccaacagaagcctggctcttcaccaaagccgtggatttacgccacttccaatctcgcttcgggagtgccagtgagattttcaggatcaggtagcggtacctcgtactcacttactatttcaagggtggaagcagaggacgcagccacctactattgtcaacaatggacttccaatcctccaaccttcggaggaggaactaagttggagattaaacgcaccgtcgcagcccctagcgtgtttatctttccaccttcggatgagcagctcaagagcggtaccgcctccgtagtgtgcctgctgaataacttctacccacgggaggcgaaggtgcaatggaaggtggataacgcactgcaatcaggcaactcccaagaatccgtcacggaacaggatagcaaggactcgacttacagcctgtcctccacgctgaccctctccaaagcagattacgagaaacataaagtgtacgcttgtgaagtgacccaccaagggctctcgtcgcccgtgacgaaatctttcaataggggagagtgc

SEQ ID NO: 15417 - DNA, 711 bp, Artificial Sequence
  Description of Artificial Sequence: Synthetic coding sequence
atggctgtgatggctccacgcacgctggtgctgctgctgtcgggtgctttggccttgacgcagacgtgggcacaaatcgtgctgtcccagagccctgcgatcctgtcagcatcgccgggcgagaaggtaaccatgacgtgccgtgcttctagctccgtcagctatatacattggttccaacagaagcccggttcgtccccgaaaccgtggatttatgccacctcgaacctagcctcaggagtgcccgtcagattctctggatccggttccggaacgtcgtattccctgactatctcacgggtggaggcagaggacgccgcaacatactactgccaacagtggacgagtaatcctcccacgtttgggggcggcaccaagctggagatcaagcgtactgtagcagcaccgagtgtgtttatatttccacccagcgatgagcagttgaaatccggtaccgcgtccgtggtgtgcttgctgaacaacttctaccccagggaggcgaaggtgcagtggaaggtagacaatgccctacagtcaggcaacagccaagaatccgtgacggagcaggattcaaaggactcaacctacagtttatcgtccaccctcaccctcagcaaagccgattatgagaagcataaggtttatgcatgcgaagtgacccaccagggactgtcatcccctgtgacgaagtcatttaaccgtggtgagtgt

SEQ ID NO: 15418 - DNA, 711 bp, Artificial Sequence
  Description of Artificial Sequence: Synthetic coding sequence
atggcggtgatggcgcctaggacacttgtcttgttgctatccggggctcttgcactaactcagacgtgggcacagatcgtgctttcacagtcacctgctatcctgagtgcttccccaggagagaaagtcacaatgacctgccgcgcatcttctagcgtatcctacattcattggtttcagcagaaaccagggtcctctcctaaaccttggatttatgcaacaagcaatctcgcgtccggagtgccagtcagattctccggttccggttccggtactagctactctttgacgatcagcagagtggaagcggaggatgcggccacctactattgccaacaatggacctccaatcctccaacattcggtggcggaaccaaactggagatcaaacggacagtcgccgctccatcggtatttatcttcccgcccagcgatgagcagttgaagagcggaaccgccagtgtggtgtgtctgctgaataacttttaccccagagaggctaaggtgcagtggaaagttgacaatgcgcttcagtctgggaactcccaggaatcagtgacagaacaggacagcaaggattccacatattcactctctagtaccctgacactgtcgaaggctgactacgagaagcacaaggtgtatgcatgtgaagttacgcatcagggactctccagtcctgtgacaaagtcattcaaccgtggggagtgt

SEQ ID NO: 15419 - DNA, 711 bp, Artificial Sequence
  Description of Artificial Sequence: Synthetic coding sequence
atggctgtgatggcgccccgcacattggttctcctgctgtccggggctttggctctcacccagacgtgggcacaaatcgtgcttagccagtcacctgctatcctgtccgcctcacccggggaaaaagtgacaatgacttgccgggcatcatcatccgtctcttacatacactggttccagcagaaacccggatctagcccaaagccctggatctacgcgactagtaacttagcttctggagtgccagtccggttctccggcagcggatcagggacttcttatagtctgaccatatcaagagtcgaagccgaggatgccgcaacctactattgtcaacagtggacctctaacccacccacgtttggaggcggtactaagctggaaattaagaggactgtagccgccccgtctgtcttcatctttcccccatcagatgagcagctcaagagtggcactgctagtgtagtatgtctgctcaataacttctacccccgagaggctaaggttcaatggaaagttgataacgcccttcagtccggtaactcacaggaaagcgtcaccgagcaggattcgaaagattccacctattctttaagctctactctcaccctctctaaagccgattatgagaagcataaagtatacgcatgtgaagtcacccaccaaggactgtcatcacccgttacaaagtcttttaaccggggtgagtgc

SEQ ID NO: 15420 - DNA, 711 bp, Artificial Sequence
  Description of Artificial Sequence: Synthetic coding sequence
atggcggtaatggcgccgcgtacgctagtactattattatcgggtgcgctagcgctaacgcaaacgtgggcgcaaatagttttatcgcaatcgccggcgatattatcggcgtcgccgggtgaaaaagtaacgatgacgtgtcgtgcgtcgtcgtcggtatcgtatatacattggtttcaacaaaaaccgggttcgtcgccgaaaccgtggatatatgcgacgtcgaatttagcgtcgggtgttccggtacgtttttcgggttcgggttcgggtacgtcgtattcgttaacgatatcgcgagtagaagcggaagatgcggcgacgtattattgtcaacaatggacgtcgaatccgccgacgtttggtggtggtacgaaactagaaataaaacgtacggtagcggcgccgtcggtatttatatttccgccgtcggatgaacaattaaaatcgggtacggcgtcggttgtttgtttattaaataatttttatccgcgtgaagcgaaagtacaatggaaagttgataatgcgttacaatcgggtaattcgcaagaatcggtaacggaacaagattcgaaagattcgacgtattcgttatcgtcgacgctaacgctatcgaaagcggattatgaaaaacataaagtatatgcgtgtgaagtaacgcatcaaggtttatcgtcgccggttacgaaatcgtttaatcgaggtgaatgt

SEQ ID NO: 15421 - DNA, 711 bp, Artificial Sequence
  Description of Artificial Sequence: Synthetic coding sequence
atggccgttatggcaccccgcaccttggtgttgctgctgagcggagcgctcgccctgacgcagacctgggcacaaatcgtgctttcgcaatcgcccgcaattctttctgcaagtcccggtgaaaaggtgactatgacttgtcgggcatcatcgagcgtatcctacatacattggttccagcagaagccgggaagctcacccaaaccatggatttacgcaacttccaatctggctagcggcgttcctgtccgtttctcaggttcaggatcgggcaccagttattcactcaccattagccgtgtggaagcagaggatgccgctacctactactgtcagcaatggacgagcaacccacctacgtttggaggcggaactaaacttgagatcaagagaacggtggccgcaccgtcggtctttatctttccaccttcggacgaacaacttaaatcaggtactgcatcggttgtgtgtctcctgaacaacttttaccctcgagaggctaaagtccaatggaaggtcgataacgcactccagtccggtaacagccaagaatcagtgaccgaacaagattccaaggactctacctactctctttccagcaccctgaccctgagtaaggccgattacgagaagcataaggtgtacgcgtgcgaagtcactcaccagggactgtcgagcccagtcaccaagagcttcaatagaggggaatgc

SEQ ID NO: 15422 - DNA, 711 bp, Artificial Sequence
  Description of Artificial Sequence: Synthetic coding sequence
atggccgtgatggctcctaggactctggtgctcctgttgtcaggtgctcttgcgctgacccaaacttgggcacagattgtcctgtcgcaatcacctgccatactttccgcctccccgggggagaaggtcaccatgacctgtcgcgccagctcgtctgtgtcgtacatccattggttccaacagaaaccagggagcagccccaagccctggatttacgcaacctcaaatttggcttcaggcgtccccgtcaggttttctggatctggttcaggaacctcctactccctcactatatcgcgggtggaagcagaagatgcagcaacttactactgccagcaatggacctcaaatccacctacttttggtggaggaactaaacttgagattaagcggactgtcgctgctccatcagtgttcatctttcctcccagcgatgaacaacttaagtcgggtaccgccagcgtggtgtgtcttttgaacaacttttaccctcgtgaagcaaaggtgcagtggaaagtggataatgcactccagagcggaaactcgcaagaaagcgtcactgaacaagacagcaaagatagcacgtattcgctctcatcaacgcttaccctttccaaggcggactacgagaagcataaggtttacgcatgcgaggttacccatcagggactgtcgtccccagtgactaagtctttcaacagaggcgaatgt

SEQ ID NO: 15423 - DNA, 711 bp, Artificial Sequence
  Description of Artificial Sequence: Synthetic coding sequence
atggctgttatggcgccgcggacgttggtcctgttactgagtggggctctggcactaacacagacatgggcccagatagtcctgtctcagtctccggccatcctatccgcctctccaggcgagaaagtgacaatgacatgtcgcgcctcgagttccgtctcttatattcactggtttcaacagaaaccgggaagttctcctaaaccctggatatatgcaacttcaaacttagcaagtggagtccccgtgaggtttagtggctctggcagtggaactagctactccttgacaattagtcgcgttgaggcagaagatgccgctacttactattgccagcagtggacctcgaatcctcctacatttggtggaggtactaagctcgaaattaaacggacagtggcggccccaagcgtgttcatcttcccacccagcgacgaacaactgaagagcggcaccgcatccgtagtctgtttactgaacaatttttacccaagagaagctaaggtgcagtggaaggtagacaatgctttgcagagtggaaacagtcaggagtccgtgaccgagcaagacagcaaggattcaacttattctctcagcagcactttgaccctttctaaagcggattacgagaagcacaaggtgtacgcgtgtgaagtgacgcaccagggtctttcaagcccagttacaaaaagctttaacaggggcgagtgt

SEQ ID NO: 15424 - DNA, 711 bp, Artificial Sequence
  Description of Artificial Sequence: Synthetic coding sequence
atggctgttatggctccgcgcactcttgtccttctactctccggtgcattggctcttacccaaacttgggcccagatcgtgctgtctcaaagccccgctatcctgagcgctagccccggcgaaaaggtgaccatgacctgccgtgcttccagctcggtgtcatacatccattggttccagcagaaaccagggtcgagccctaagccatggatttacgcaacctccaacctggcgtccggtgtcccagtccgttttagcggctcgggctcaggaacctcctacagcttgaccataagccgggtcgaagcggaagatgcagccacctactactgccagcagtggacctctaaccccccgacctttggcggaggaacgaagctggaaattaagagaaccgtagcggcgccatctgtgtttatcttccctccctcagatgagcagctgaagtcaggtacagcctccgtcgtctgtctcctgaacaacttctaccccagggaggcgaaggtgcagtggaaggtcgacaacgccctgcaaagcggaaacagccaggaatcagtcactgaacaggactccaaggattctacctattccctctctagcacacttaccttgtcgaaggccgattatgagaagcacaaggtttacgcctgcgaggttactcatcaaggcctgtctagcccggtcaccaagtcctttaatcgcggcgagtgc

SEQ ID NO: 15425 - DNA, 711 bp, Artificial Sequence
  Description of Artificial Sequence: Synthetic coding sequence
atggcagtgatggccccacgcactctggtgctcctccttagtggggctctggcacttacccagacttgggcacaaatcgtgctctcgcagtcgccagcgattctctccgcttcacccggagagaaagtgaccatgacctgtcgtgcatcatcgagcgtctcatacatccattggtttcagcaaaaaccgggtagctccccaaagccatggatttatgccacttcaaatctggcatccggtgtgcctgtgagatttagcggatcaggttccggcacctcatactcacttactatttcgagagtcgaggcagaagatgcagcaacttactactgtcagcaatggacctcaaatcctcccacgtttggaggaggtaccaagctggaaatcaagcgaaccgtggcagccccctccgtgttcatctttcctccaagcgacgaacagcttaagtcagggaccgcctcagtcgtgtgtcttttgaacaacttttaccctcgagaggccaaagtgcagtggaaggtggataacgcactgcaatcgggcaattcgcaggagtcggtgacggagcaggattcaaaagattccacctattcccttagctccacgctgaccctttccaaggcagattacgaaaaacataaggtgtacgcctgcgaagtgacccaccagggtctgtccagccccgtcactaagagttttaacagaggtgagtgt

SEQ ID NO: 15426 - DNA, 711 bp, Artificial Sequence
  Description of Artificial Sequence: Synthetic coding sequence
atggcagttatggcccccagaaccctggtgcttctgctctccggagcactggctcttactcaaacttgggcgcagatcgtgcttagccaatccccagctatcctgtccgcttcgcctggggaaaaagtgaccatgacctgtcgcgcaagctcatccgtgtcgtacattcattggttccagcaaaagcctggaagctcaccaaaaccatggatttacgctacctccaatcttgcctccggagtgcccgtgagatttagcggttcgggctcgggaacctcctactccttgactataagcagggtcgaagcagaggacgcggcaacgtactactgtcaacagtggacttccaaccctcccacgtttgggggcggaaccaagctggaaatcaagagaacggtggcagcaccttcggtgttcattttcccaccgtcagatgaacagcttaaatcaggaactgcctccgtggtgtgtctcctgaataacttctacccacgtgaagcgaaggtgcaatggaaggtggataacgcccttcagtcgggcaactcgcaggaatccgtgaccgaacaggattccaaggatagcacctactccctttcctcaacgcttacgctttcgaaggcggactacgaaaagcacaaagtgtatgcatgtgaagtcactcaccagggcctctcgtcgcctgtcaccaagtcgtttaacaggggtgagtgt

SEQ ID NO: 15427 - DNA, 711 bp, Artificial Sequence
  Description of Artificial Sequence: Synthetic coding sequence
atggccgtgatggcccctcgcactttggtccttctcctctccggagcgctggccctgacccagacttgggctcagatcgtcctttcccagtcaccggcaattcttagcgcctcgccgggtgaaaaggtgaccatgacctgtcgcgcgtcctcgagcgtctcatacatccactggttccagcagaaaccgggatcctcgccaaagccttggatctacgctacgtccaatctggcctcaggagtcccggtgaggttttccggctcgggttcgggcacttcctactcactgactatcagcagagttgaagctgaagatgctgcaacctactactgtcagcaatggacttcaaatccgcctactttcggaggaggtactaaactggagatcaagcgcactgtggccgccccgtcggtgttcatcttcccgcctagcgatgaacaactgaaatcgggaaccgcctcagtggtctgcctgcttaacaacttctatccgagggaagcgaaagtccagtggaaagtggataatgcgctccagagcggcaacagccaagagtccgtgaccgaacaggattctaaagattcgacttattccctgagctccactctgactctgagcaaggccgactacgagaagcataaggtgtacgcatgcgaggtcacccaccaaggactcagttccccagttactaagtcgttcaatcggggcgagtgc

SEQ ID NO: 15428 - DNA, 711 bp, Artificial Sequence
  Description of Artificial Sequence: Synthetic coding sequence
atggctgtgatggcacccagaacattggtgcttctgctatccggggctctcgcccttacccaaacttgggcccaaatagtattatcccagagccccgcaatactgagtgccagcccaggggagaaagtgactatgacctgcagagcttcctcatccgtgtcgtatattcactggttccagcagaaaccgggatcaagccccaagccgtggatctatgccacttcaaacctggctagcggcgtccccgttagattctccggtagcggatccggcacgagctatagcctgacaatttcaagagtcgaggcagaggacgcggctacctactattgccagcagtggacctcgaaccctcccaccttcggcggcgggaccaaactagaaattaagcgaaccgtggccgcaccttcagtgtttatctttccgcccagtgatgagcagctgaagtccggtacagctagtgtagtttgtttgttgaataatttctacccgcgagaagctaaagtccagtggaaagtggacaacgctctgcagtccggcaattcccaggaaagcgtgacagaacaagattccaaagattctacatacagcttgagttcgactcttacactctccaaagctgattacgagaagcataaggtctacgcctgcgaagttacacaccaggggctcagttcccctgtcaccaagtcttttaatcggggcgaatgt

SEQ ID NO: 15429 - DNA, 711 bp, Artificial Sequence
  Description of Artificial Sequence: Synthetic coding sequence
atggccgtgatggccccacgcacgctggtgttgctgctgtccggagccctggcacttacgcaaacctgggcacagatcgtgctctcgcagtcaccggcgattctctcggccagccccggagaaaaggtaaccatgacttgtagagcgtcgtcaagcgtgagctacatccactggttccaacagaagcctggtagctcgcctaagccctggatatacgctacctcgaacctggcgtcgggtgtcccagtgaggttctcgggctcaggatccggcaccagctattccctcactatttcccgggtggaagctgaggacgccgccacctactactgccaacagtggacctcaaatccgccgactttcggcggtggaactaagctggagatcaagaggactgtcgcagccccgtcggtgttcatctttccgccttccgacgaacagctgaagtcgggaaccgcgtcggtggtctgtcttttgaacaacttctatccgcgcgaggcaaaggtgcaatggaaagtcgataacgctctgcaatcgggaaactcccaggagtcggtgaccgaacaggattccaaagactcaacctactccctctcctccaccttgaccctctccaaggccgactacgagaaacataaggtgtatgcatgtgaagtcactcatcaggggttgtcgtctccggtcaccaagagctttaacagaggcgaatgt

SEQ ID NO: 15430 - DNA, 711 bp, Artificial Sequence
  Description of Artificial Sequence: Synthetic coding sequence
atggcagtgatggcgcctcgtacgcttgtcctcctcctgtctggcgccctggctctgactcaaacctgggcccagatcgtgctgagccagtccccggccatcttgtcggccagccccggagagaaagtcacaatgacatgcagggcgtcctccagtgtgtcctatatccactggttccagcagaagcccggatccagccccaaaccatggatttatgccacctctaatctggcttccggcgttccagtgcgcttcagtggtagtgggtccggaacatcttatagtcttactatcagtcgcgtcgaagccgaagatgcagcgacatattactgccaacaatggacttcaaatccccctacctttggcggaggcaccaaactcgaaataaagcgtacagtcgccgcgccctccgtgttcatttttcctccgtccgatgagcaactgaagtccggaacggcttccgtcgtttgtctgctaaacaatttctatcctcgcgaagcaaaggtccaatggaaggtcgataatgccctccagtccgggaattcacaggaatcggttactgagcaagacagcaaagacagtacatatagcctgtcctcgaccttaacgctctcgaaggctgattatgaaaagcataaagtgtacgcgtgtgaagtaacccatcagggactgtcttctccagttacaaagagttttaatcgcggtgagtgc

SEQ ID NO: 15431 - DNA, 711 bp, Artificial Sequence
  Description of Artificial Sequence: Synthetic coding sequence
atggctgtcatggcacctcggacccttgtcctcctcctttcgggagccctggcgctgactcaaacttgggcccagatagtactgtctcagagcccagctatcctctccgcgtcgcccggcgaaaaagtgaccatgacttgtcgcgcctcatcctccgtgtcatacattcactggtttcagcagaagccaggatcgagcccgaagccttggatctacgcaacttctaatctcgccagcggcgtacccgttagattctcgggctccggaagtggaaccagctattcgctgaccatcagcagggtcgaagccgaggacgccgcgacctactactgccagcagtggacttcaaaccctccgacgtttggagggggtaccaagctcgaaatcaagcggaccgtggcggccccgagtgtgttcatcttcccaccgagtgacgaacagttgaagtcggggacggcatccgtcgtctgcctgcttaacaacttctaccctcgcgaagcgaaggtccaatggaaagtggacaatgcactgcaatccggaaattcacaggagtccgtcaccgaacaggattctaaggattcaacttactcattgtcaagcacgctgacgctgtccaaggctgactacgagaagcacaaagtgtacgcgtgcgaggtgacccatcaagggctgtcctcgcccgtgactaaatcattcaaccggggtgagtgt

SEQ ID NO: 15432 - DNA, 711 bp, Artificial Sequence
  Description of Artificial Sequence: Synthetic coding sequence
atggccgtaatggcacctagaaccctggtgctgctcctctctggtgcgctggcactgacccagacctgggcccagatcgtactctctcaatcaccggctattctgtccgcgtctcccggcgagaaggtaactatgacctgcagagcttcctcctccgtatcctatattcactggtttcagcagaagccagggtcctcaccaaagccttggatttatgcaactagcaaccttgcctctggagtgccggtccggttttccggcagcggtagcggaacttcctacagcctcacaatttcacgcgtggaagctgaggatgctgccacatactactgccaacagtggacctctaatccccccacttttggaggtggaacaaaactggaaattaagcggacggtcgcagccccaagcgtttttatctttccccccagcgacgaacagttgaagtctgggactgcatccgtggtatgccttctcaataacttctacccccgagaggccaaagtccagtggaaggtggacaacgccctgcagtctgggaattcacaagaaagtgtgactgagcaggactctaaagattcaacatatagcctcagttctactctcacactcagtaaagcagattatgagaagcacaaggtctacgcgtgcgaggttacgcaccagggactgagctccccggtgacaaagtctttcaaccggggcgaatgt

SEQ ID NO: 15433 - DNA, 711 bp, Artificial Sequence
  Description of Artificial Sequence: Synthetic coding sequence
atggccgtcatggcccccaggactctggtgttgttgcttagtggcgcccttgccctgacccaaacctgggctcagatcgttctgagccaatccccagccatactgtctgcttcccccggcgagaaggtcactatgacctgccgtgcatctagctcagtctcctacattcactggttccagcagaaacccggctcttctcctaagccttggatttacgcaacatccaatctcgccagtggagtgccagttagatttagtggctctggatccggtacttcttactctttgaccatatcacgcgtggaggctgaggatgccgctacttattattgccagcagtggacaagtaatcctcccacattcggcggtggaaccaaacttgagattaagagaacagttgccgccccatcagtgttcatttttccaccctctgatgaacagctgaaatctggtaccgccagcgtcgtatgtctgctgaacaacttttaccccagagaagctaaggttcagtggaaagtagataatgcactgcaaagtggcaactcccaggaatccgtgacagagcaggattcaaaggactccacatatagtctttcaagtactttgaccctgagcaaagctgattacgagaagcacaaagtttacgcctgcgaggtgactcaccagggcctttcatcccccgtcaccaaatctttcaataggggcgagtgt

SEQ ID NO: 15434 - DNA, 711 bp, Artificial Sequence
  Description of Artificial Sequence: Synthetic coding sequence
atggccgttatggcccctcgcactctggtgttgttgctgtcaggcgctctagccctgacccagacctgggcccagatcgtgctgagccagagtcctgccatcctgagcgcctctcctggcgagaaggtgactatgacatgtcgggctagttcgtctgttagttatattcattggtttcagcaaaagccggggagttcacccaagccatggatatacgcaacttccaacttagcctcgggcgtgcctgtgcgcttcagtggctccggaagcggtacttcatacagcctcactatatccagggtggaggccgaggacgctgctacatattattgtcagcaatggacctctaacccccctaccttcggcgggggcaccaaacttgagatcaaacgaaccgtcgcagcaccttccgtgtttatatttccccccagtgatgagcagttaaagtcagggactgcctctgtagtgtgtctgctcaacaatttctaccctcgcgaagccaaagtgcagtggaaggtagataatgctctgcagagcgggaacagtcaggaaagcgtgacagaacaggattcaaaggacagtacctactcgttgtcctcgacccttaccctgtcaaaagccgattatgagaagcacaaggtgtacgcatgtgaggtgacacatcagggtctttcttcgcccgtaacaaaaagtttcaaccggggggagtgc

SEQ ID NO: 15435 - DNA, 711 bp, Artificial Sequence
  Description of Artificial Sequence: Synthetic coding sequence
atggcagtgatggcccctaggacactggtgctgctactgtcgggggcactggctctgactcagacttgggcgcagatagtgctgtcacagtcgccagccatactctccgcctctcctggagagaaggtcacaatgacatgtcgcgcctcctcatcagtatcctacatccactggtttcaacagaaaccagggagttcgccgaagccatggatttatgctacctcaaacctggcatccggagtgcccgtacgcttttctgggtctggatctggaacgagctacagcttgaccatatctcgcgtggaggctgaggacgctgccacctattattgccagcagtggacatcaaatccacccacattcggtggaggcaccaagttagaaattaagcggacagtggcagccccatcagtattcatatttccgccctctgacgagcagctaaagagcggtaccgcttctgtagtttgtctgctcaacaatttttacccgagggaagccaaggtgcagtggaaggtggataacgctttgcaaagcggaaactcccaggagagcgtgaccgaacaggacagcaaagatagtacatacagcttatctagtacccttaccctatctaaggcagattacgagaaacataaggtttatgcgtgcgaggttacccaccaaggcttgagcagccctgtcactaagtcttttaaccgcggggaatgc

SEQ ID NO: 15436 - DNA, 711 bp, Artificial Sequence; identical to SEQ ID NO: 15419
  Description of Artificial Sequence: Synthetic coding sequence

SEQ ID NO: 15437 - DNA, 711 bp, Artificial Sequence
  Description of Artificial Sequence: Synthetic coding sequence
atggccgttatggcaccacgtaccttggttctgcttctgagcggagccttggcactcacgcaaacctgggcacaaatagtgctttcacaatcccctgccattctctccgcatcaccaggtgagaaagtgaccatgacctgccgggcaagcagctccgtgtcctacattcattggttccagcagaagccaggatcatcaccaaaaccttggatctacgcaactagcaacctggcatcgggtgtcccagtgagattctcgggatccggaagcggtacttcctactcgcttaccatttcgagagtggaggcagaagatgccgcaacttactactgccaacaatggacctctaaccctcctacgtttggtggtggtaccaaacttgagatcaaaaggactgtggcagcaccttcggtgttcatttttccacccagcgatgagcagctcaagagcggtaccgcgagcgtcgtgtgtctgctgaataacttctaccctagggaagccaaggtgcagtggaaggtggacaacgctctgcaatccgggaattcacaagaatcagtgaccgaacaggactcgaaggatagcacctactcgctctcatcgacgctgactctttcgaaggcagactacgaaaaacataaggtgtacgcgtgcgaagtcacccatcaaggtctttccagcccagtgacgaagtcgtttaacagaggggaatgc

SEQ ID NO: 15438 - DNA, 711 bp, Artificial Sequence
  Description of Artificial Sequence: Synthetic coding sequence
atggcagtcatggcacctcgaacgctggtcttattactgtcaggtgccctggccttaactcaaacttgggcgcagatcgtgctgtctcagagccccgccatactaagcgcctcaccaggggaaaaggtgactatgacatgtagggctagttcatcggtttcctacattcactggtttcagcagaagcccggatctagtcccaaaccctggatctatgccacctccaatctagccagcggggtgcccgtcaggttctccggcagtggatctggaacgtcttacagcctaacaatctcccgagtggaagctgaagacgccgcgacgtattactgccagcagtggaccagcaatcccccaactttcgggggtggcaccaagctggaaatcaagagaacagtagctgctccctcagtatttatcttccctccctcagacgagcagctgaagtcaggcactgcttctgtcgtgtgtctcctcaataatttctaccccagagaggccaaagtgcagtggaaggtggataacgctctccagtctggcaatagccaggaatccgtcactgaacaagactccaaagattctacctattctctctcttccactctgactctgtctaaagccgactacgaaaaacataaagtgtatgcttgtgaagtcacacatcaaggcctctctagccccgtgaccaagtcctttaataggggggaatgt

SEQ ID NO: 15439 - DNA, 711 bp, Artificial Sequence
  Description of Artificial Sequence: Synthetic coding sequence
atggcagtgatggccccacggacactagtgcttctattaagcggtgcattagcactgactcagacctgggcacagatagtgctatcccagagcccagccatcctgtctgcgagccccggtgaaaaggttaccatgacttgcagggccagttccagcgtgagttacattcactggtttcagcagaagccaggaagttcgcccaaaccctggatttatgccactagtaatttggcttcgggtgttccagtcagattttctggctccggaagcgggactagctactccctgaccatctcccgagtcgaggctgaggacgcagccacttattattgtcaacagtggacttctaatcctccaacatttgggggcggtaccaaactggagataaaaagaacggtcgccgcccctagtgtcttcattttcccaccatcagatgagcagctcaagagcggaacggctagcgtggtttgcctgctcaataacttctaccctagggaggcaaaagttcagtggaaagtggacaacgcgctccagtccggcaacagtcaggaatcagttaccgaacaggactccaaggacagcacctacagtctgtcgtcaactctgacattgagcaaggccgattatgaaaagcacaaagtctacgcctgcgaggtgacccatcagggcctcagttctcccgtaactaaaagctttaatagaggcgagtgt

SEQ ID NO: 15440 - DNA, 711 bp, Artificial Sequence
  Description of Artificial Sequence: Synthetic coding sequence
atggctgtcatggccccaagaacccttgtgctcctgctgtctggagcattggccctgacccagacttgggcccagattgtcctgtcccaatcgccggcaatcttgtccgcatcccccggcgagaaggtcaccatgacttgccgcgcttcgtcctccgtttcctacatccactggttccagcagaagccgggatcatcaccaaaaccgtggatctatgccactagcaatctcgcgtccggcgtgccagtgcggtttagcggatcaggatcagggacgtcttacagcttgacgatctctcgcgtggaggctgaagatgcagcgacctactactgccaacaatggacttccaatccaccgactttcggaggtggaactaagctcgaaatcaaacgaactgtggccgctccaagcgtgttcatattccctccgtcagacgagcagctgaaatcggggaccgcgtccgtggtttgtcttttgaataacttttacccccgggaggcgaaggtccagtggaaggttgacaacgcacttcagtccggaaacagccaagagtcagtgacggaacaggattcgaaagattcaacctactctctctcgtcgaccctcactctgtcgaaggccgactacgaaaaacataaggtgtacgcgtgcgaagtgacccaccaaggcctctcctcgccagtcactaagtccttcaaccgcggtgaatgc

SEQ ID NO: 15441 - DNA, 711 bp, Artificial Sequence
  Description of Artificial Sequence: Synthetic coding sequence
atggccgtgatggctccccgaaccctggtgttattgttaagtggagctctcgcactgacacaaacctgggcacagattgtgctgtcacaatcacccgccattctgtccgcatcgcctggggaaaaggtcaccatgacatgcagagccagtagtagcgtaagttatatacattggtttcagcagaaacctggaagctcccctaagccgtggatctacgcgacgagcaacttggcctcaggggtccccgtgcgcttttccgggagcggcagcggtactagttacagtctcacaatctccagggtcgaagccgaagacgccgctacttattattgccagcaatggacttccaacccgcctacatttggcgggggaaccaaactggagattaaacggactgtggcagcaccatctgtttttatcttccccccttctgatgagcagctcaaatcgggaactgcctctgtggtctgtttgctcaacaacttttatccaagggaagccaaagtgcagtggaaagtggataacgccctacaaagcggtaattcacaggagagcgtgacagaacaggattccaaagactctacctatagcctgtccagcaccctgactctaagcaaagcagattatgagaagcacaaagtctacgcctgtgaagtgacccaccaaggactgtccagtccggtcaccaaaagcttcaatcgcggcgagtgc

SEQ ID NO: 15442 - DNA, 711 bp, Artificial Sequence
  Description of Artificial Sequence: Synthetic coding sequence
atggcagtgatggctccgaggaccctcgtgttgctgctctcgggcgctctcgctttgacgcaaacgtgggcccagattgttctgagccaaagccccgcgatcttgtctgcaagcccgggcgaaaaggtcactatgacctgccgcgcatcctcctcagtctcctacatccattggttccaacaaaaacccggctcctcaccaaagccttggatctacgccacctccaacctggccagcggtgtgccagtgagattctccggttcagggtcgggtacttcctactcactgaccatctcccgggtcgaggctgaggatgcagccacctactactgccagcagtggacgtcaaaccctccaacttttggcggtggaacgaagctggagatcaaaaggaccgtggctgccccatcggtgtttatctttccaccgtcagatgaacagctcaaatcgggcaccgcctcggtagtgtgccttctcaataacttctacccgcgcgaggccaaggtgcagtggaaagtggacaatgccctgcagagcggaaacagtcaagaatccgtcactgaacaggacagtaaggacagcacttacagtctttcctctaccctgactttgagcaaggcggattatgagaagcacaaggtgtacgcgtgcgaagtcactcaccagggactgtcatcacccgtgactaagtcgttcaatcggggggaatgt

SEQ ID NO: 15443 - DNA, 711 bp, Artificial Sequence
  Description of Artificial Sequence: Synthetic coding sequence
atggccgtgatggctcctaggaccctcgtgctcttgctgtcaggcgctttggccctgactcagacctgggcccagatcgtgttaagtcaatctcccgccattctgtctgcctctcctggtgagaaggtcacgatgacctgcagagccagtagtagcgtgtcctacattcactggtttcagcagaagccggggtcgagcccgaagccatggatttatgctacgtccaacctagctagtggggttccagtgcggttcagcgggtctgggtccgggaccagctactctttgacgatcagccgagtggaagctgaagatgccgcaacatactattgccagcagtggacatcaaatccaccaaccttcggaggcggcactaaactggagataaaaagaactgtcgctgcgccatcagttttcatcttcccaccttctgatgagcagctgaaaagcgggaccgcttccgtcgtgtgtttgcttaataacttctatccacgggaggccaaagtgcagtggaaggtggacaacgccctccaaagcggcaatagtcaggaatctgtcacagaacaagacagcaaagattctacgtacagtctgtcatctacgctgacactcagcaaagctgactacgaaaagcacaaagtgtacgcttgcgaggtcacacaccagggactgtcttcaccagtcacaaagagcttcaataggggggaatgt

SEQ ID NO: 15444 - DNA, 711 bp, Artificial Sequence
  Description of Artificial Sequence: Synthetic coding sequence
atggcggtgatggcgcctcggaccctcgtgctgctcttgtcgggcgccctggcgttgactcagacttgggcgcagatcgtgttgtcccaaagccccgctatcctgtcggcctcgcctggagaaaaggtcactatgacctgcagagcaagctcatcagtgtcctacatccactggttccagcaaaaaccgggaagctcccctaagccatggatttacgcaacctcgaacctcgcctcaggcgtgccagtccggttttcgggatcgggcagcggcacgtcctactccttgactatttctcgcgtggaggctgaggacgccgccacgtactactgccagcaatggacgagcaatccgccgactttcggagggggaaccaaactggaaatcaagcgcaccgtggccgccccgtcggtgttcatattcccaccgtccgatgagcaactgaagtcagggaccgcttcggtggtgtgtctgttgaacaacttttacccgcgggaagctaaggtgcagtggaaggtggataacgccctccaaagcggtaactcacaggaaagcgtgactgaacaggatagcaaagactcaacctactcgctgtcgtcgaccctcacgctctccaaggccgactacgagaagcacaaggtgtacgcatgcgaagtgacgcatcaaggcctcagttcacctgtgactaagtcgttcaacagaggtgagtgt

SEQ ID NO: 15445 - DNA, 711 bp, Artificial Sequence
  Description of Artificial Sequence: Synthetic coding sequence
atggccgtcatggcccctagaacactcgtgctacttctgtccggcgctctagccctaactcagacctgggcccagatcgtgctgtcacagtcaccggcaatactgtccgcctcacccggcgagaaggtgaccatgacttgtagagccagcagcagcgtcagctatatccactggtttcagcagaagcccggaagctcacccaagccctggatctacgccacatcaaatctggcttcgggtgtccccgtcaggttctccgggtcggggtctggcacttcctattcccttaccatctctcgtgttgaggctgaggacgcagctacatactattgtcaacagtggacctccaaccctccaacatttggcgggggtaccaaacttgaaatcaagcgcactgtcgccgctccgtcggtgttcatctttccaccctctgatgagcagctaaaaagtggtactgcatctgtggtatgcctgctgaacaacttctacccacgtgaagccaaggttcagtggaaagtggacaacgcgcttcagagcggcaactcccaggagtctgtaacagagcaggacagcaaagacagcacctattcactgtctagcaccctgaccctgtccaaagccgactacgagaagcataaggtatacgcctgcgaggtcacccatcaggggttaagcagcccagtgaccaagtcttttaaccgaggtgagtgc

SEQ ID NO: 15446 - DNA, 711 bp, Artificial Sequence
  Description of Artificial Sequence: Synthetic coding sequence
atggccgtgatggctcccaggaccctcgtgttgcttttatcaggcgccctggcactgacacaaacatgggcccagattgtgctgtcgcagtcacctgccatactgtctgcatcgccaggcgaaaaagtgaccatgacctgcagagcctcctccagcgtgtcgtatatccactggttccagcagaagccagggtcgagtccaaagccttggatttacgctacaagtaatttggctagcggggtgcccgtacggttcagcggttcggggtcaggaactagctactctctgaccatctcccgggtggaggccgaggacgccgcaacctattactgtcagcagtggacgtccaatcctccaacctttggcggcggtaccaaattagaaataaagcgtacggtcgcggccccttccgtttttattttcccgccatcggatgaacagctcaaaagcggaaccgcctccgtcgtctgtctgctgaataacttctatcctcgagaagccaaagtacagtggaaagttgacaatgccctccaatcaggcaacagccaggaaagtgtgacggaacaagacagcaaagacagcacgtatagtttgagcagtacacttacgctctccaaagcagactatgagaaacataaggtctatgcatgcgaagtgacccaccagggtctgtccagccccgtcaccaagtccttcaaccgcggggaatgc

SEQ ID NO: 15447 - DNA, 711 bp, Artificial Sequence
  Description of Artificial Sequence: Synthetic coding sequence
atggcggttatggcccctcgtacgctcgtgctgctgctttcgggggcccttgcccttacccaaacttgggcccagattgtgctttcgcaaagccccgccattttgtccgccagcccaggagaaaaggttaccatgacttgtcgggcatcttcaagcgtgtcgtacatccattggtttcagcaaaagccaggatcatcacctaagccttggatctacgcaactagcaatcttgcatcgggcgtacccgtgcgattcagcggctcaggatccggtacgtcgtacagcctgacgatctccagagtggaagccgaagatgcagcgacttattactgccagcaatggacttcgaaccctccaacgttcggcggtggaactaaactcgagattaagcgaaccgtggcagcaccttccgtgttcatatttccgccaagtgatgagcagttgaaatcaggaaccgcatccgtggtgtgccttcttaacaatttctacccaagagaagcgaaggtgcaatggaaagtcgacaacgcgctccagtccggtaattcacaagagtcggtcactgaacaagattctaaagacagcacctactctttgtcatcaaccctcactctgagcaaagcggactacgagaagcacaaggtgtacgcgtgtgaagtgacccatcagggactctcatcgccggtgactaagtcatttaacagaggtgaatgt

SEQ ID NO: 15448 - DNA, 711 bp, Artificial Sequence
  Description of Artificial Sequence: Synthetic coding sequence
atggccgtgatggccccccgtactcttgtgttgctgcttagcggagctctcgccttgacgcaaacttgggcgcaaattgtattgtcgcaatcgcctgccatcctttccgcctcacccggagaaaaagtgaccatgacttgcagggcgtcctcgagcgtttcctacatccattggttccagcagaagcctggcagctccccaaagccgtggatctacgcaacttcaaatctggcttccggggtgccagtgcggttttcaggctccggatcgggaacgtcatactcccttactatctcgagagtggaagcagaagatgccgctacctactactgccaacagtggacgtcgaacccacccactttcggtggcggtaccaagctcgagatcaaacggaccgtcgccgctccgtcggtattcatctttccgccgtcggatgaacagctgaagagcggaaccgcatcggtggtgtgcctgctgaataacttctacccgcgcgaagccaaagtgcagtggaaggtggataacgcgctgcaatcgggaaacagccaagaatcggtgacggagcaggactcaaaggactctacttactcgctgtcgtccaccctgactctctccaaggccgactacgagaagcacaaggtttatgcatgcgaggtcacccaccagggactgagctcgccggtgactaaatccttcaatcggggcgagtgt

SEQ ID NO: 15449 - DNA, 711 bp, Artificial Sequence
  Description of Artificial Sequence: Synthetic coding sequence
atggctgtcatggcaccacggacacttgtgctactgctttcaggagcactggccctcacacagacttgggcccagattgtgctctcccagtctcccgccatcctatccgcttcccccggggaaaaagtgacaatgacgtgcagagcctcctcttctgttagttacatacactggttccagcagaaacctggatcttcccccaaaccttggatttatgctacatccaacctcgctagtggagtgccagtgcggttcagtggatccggatccggaacatcctacagtttaacaataagtcgagtggaggcagaagatgctgccacatattattgtcagcagtggacgtctaacccacccacatttgggggagggactaagctagaaattaaaagaacagtggctgcaccatccgtgtttatatttccaccttccgatgaacagcttaagtccggaacggcttccgtcgtgtgtctacttaacaatttctatccacgcgaagctaaagtccagtggaaggttgataacgccttgcagtctggaaactcccaggaatctgtgactgaacaggattcaaaagatagtacttatagtctatcctcgacacttactctgtccaaagcggattacgaaaaacataaggtatatgcttgcgaagtgactcatcagggactctctagtcccgtcacaaagtcttttaacagaggggagtgc

SEQ ID NO: 15450 - DNA, 711 bp, Artificial Sequence
  Description of Artificial Sequence: Synthetic coding sequence
atggctgttatggcaccacgaacgctggtactgctgttgtccggcgctctggctctgactcagacttgggcacaaatcgtgctttcacagtctcccgccatactttccgcctctccaggggagaaggtcacaatgacgtgccgggcctcttctagtgtaagctacatacattggtttcagcagaaaccaggatcctccccaaagccatggatttacgctacgtccaatctggcaagtggagttcctgtgaggtttagcggatctggtagcggaaccagctattcccttactatatctcgggtcgaagcagaagatgcggctacctattattgtcaacagtggacatccaaccctccgaccttcggcggggggactaagctggagatcaaacggaccgtggctgcgccctctgtattcatcttcccaccttctgacgaacagctcaaaagcggaacagcatctgtggtatgtcttctcaataatttttacccgcgggaagccaaggtgcaatggaaagtggataatgcccttcagtcagggaatagtcaagagtccgtaacagaacaggattccaaggacagtacgtactcactgtcatctactcttacgctcagcaaggctgattatgagaagcataaggtatatgcctgtgaagtgacccaccaggggctctcaagtcctgtgactaaatctttcaacagaggagaatgc

SEQ ID NO: 15451 - DNA, 711 bp, Artificial Sequence
  Description of Artificial Sequence: Synthetic coding sequence
atggccgttatggctccaagaacacttgtgttactgctgtctggggccctggctctgacacagacctgggctcagatcgttctgagccagtctcccgctattctctcagcttcacctggggagaaagttaccatgacatgtcgcgcttcttcttccgtcagttacatccactggttccaacagaagcctggaagctctcccaaaccctggatctacgccacctccaatctggctagtggggttccagtaagattttccggctccgggagcgggacaagctacagtttaaccattagtagggtggaagccgaagacgctgccacctactactgtcagcaatggaccagcaacccgcccaccttcgggggaggtaccaagctggaaattaagcgcactgtggcagcaccttcagtgttcatcttcccacctagtgacgagcagctgaaatctgggaccgcctccgtggtgtgtttgctgaataacttttatccaagggaagcaaaggtccagtggaaagtagacaacgcccttcagtctgggaattcacaagagagcgtgactgaacaagattctaaggactccacttactctctgtccagtaccctgaccttatcaaaggctgattatgaaaaacacaaggtatatgcatgcgaagttactcatcagggcctctctagtcctgtcactaaaagcttcaaccgcggcgagtgc

SEQ ID NO: 15452 - DNA, 711 bp, Artificial Sequence
  Description of Artificial Sequence: Synthetic coding sequence
atggccgttatggcccctcgcaccttggtcctgctgctgagcggcgcgctggccctcacccaaacctgggcacaaatagtactgagtcagagtccagctatcctgtctgcaagcccaggagagaaggtgacaatgacctgccgagcatcctctagtgtttcatatatccactggtttcagcagaagcctggctcctcacctaaaccttggatatatgcaacatctaatcttgctagtggcgtgcctgtcagattctctggctctggatctggcacatcctactctctgactatcagccgggtggaagctgaggacgcagcaacctactattgccagcagtggacttcaaatcctccgacttttgggggaggaaccaaactcgagatcaagcggactgtcgcggctccttccgttttcattttcccccccagcgacgagcagttgaagtcaggaacagcatccgtggtctgcttgctgaacaacttctacccgagagaggctaaagtgcagtggaaagtggacaacgcattgcaatctggcaacagccaagagtccgtgacagagcaggactctaaggatagcacctacagtctctcctctacacttactttgagtaaggctgactatgaaaaacataaagtttacgcttgtgaggtcacccatcagggactgtcaagtccagttacgaagagttttaatcggggagaatgc

SEQ ID NO: 15453 - DNA, 711 bp, Artificial Sequence
  Description of Artificial Sequence: Synthetic coding sequence
atggccgtgatggccccaagaacacttgtgctgctgttgagcggggctctagcactgacccagacatgggcccagatcgtcctgtctcagagcccagccattttgagcgcttcccccggggagaaggtaactatgacctgcagagcgagctcttccgtgtcttatattcattggttccagcagaagcccggcagctcaccaaagccttggatttacgctacgtccaatctcgcttctggagttcctgttaggttctcaggcagtgggtcaggaacatcctacagcttgacaatctctagagtggaggctgaggacgctgccacctactactgccaacagtggacatcaaatccacctactttcgggggggggacaaaactggagattaaaagaaccgtggccgctccttcggttttcatcttccccccatccgacgagcagttgaagtctggaacagctagcgtggtctgcctcctcaacaatttttatcctcgagaggccaaagtacagtggaaagtagataatgctctgcagtccgggaacagccaggagtctgttactgaacaggactccaaagattctacgtattccctgagtagtacacttacattgtctaaggcagattacgagaaacataaagtgtatgcatgcgaggtaactcatcaaggcctctcatcccctgtgaccaagtccttcaacaggggagaatgc

SEQ ID NO: 15454 - DNA, 711 bp, Artificial Sequence
  Description of Artificial Sequence: Synthetic coding sequence
atggcagtcatggctcctcgtactctagtactgctgctctccggagcccttgccctaacacagacctgggcccaaatcgtgctgtcccagtcacccgctatactctcagccagccccggggagaaagtgacaatgacttgcagagctagcagctctgtcagttacattcattggtttcagcagaagcctggatcgtcccccaagccgtggatctatgccacttccaatcttgcctccggcgtgcccgtccgcttctcagggtcgggatctggcacaagctattcactgaccatcagtagggttgaggcagaagatgctgcgacttactattgccagcagtggacgtccaatccacctaccttcgggggaggaactaaactggaaataaagcggacagtggccgcacccagcgtcttcatctttcccccctcagacgaacagctgaaatcgggtaccgcgagtgtggtgtgtctcctgaataatttctatccgcgcgaagccaaggtccagtggaaagtcgacaatgccctgcagtccggtaattcccaggaaagcgtcactgagcaggacagcaaggatagcacgtactcactcagcagtaccctgaccttgtccaaggcggattatgaaaagcacaaagtctatgcctgtgaagtgacacatcaggggctgagcagccccgttaccaagtcatttaatcgaggtgaatgc

SEQ ID NO: 15455 - DNA, 711 bp, Artificial Sequence
  Description of Artificial Sequence: Synthetic coding sequence
atggctgtcatggcacctcgcactttggtgctcctccttagcggcgcgctcgcactgactcaaacctgggcacaaatagtgctctcccaatcccctgcgatcctttcagcatcgccgggagaaaaggtgaccatgacgtgtcgggcatcgtcatccgtgtcgtacattcattggtttcagcaaaagcccggatcgtccccgaaaccatggatctacgcaacctctaacttggcaagcggtgtgcccgtcagatttagcggttccgggtcaggtacgtcctactcgcttactatctcacgagtggaggccgaggatgcagcaacttactactgtcaacagtggacttcaaatccaccaacttttggcgggggtaccaaacttgaaatcaaacgcacggtggcagcaccttcggtctttatctttcctccttcggacgaacaactgaaaagcggaaccgcaagcgtcgtgtgcctgcttaacaatttctaccctcgggaagcaaaggttcaatggaaagtggataacgcgcttcaatcgggaaatagccaggaatcggtaactgagcaagattccaaggattccacctactccctgtcgagcactctgaccctgagcaaagccgattatgaaaagcacaaggtctacgcatgtgaagtgacccatcaggggctttcgtcgccggtgaccaaatcctttaaccgcggagaatgt

SEQ ID NO: 15456 - DNA, 711 bp, Artificial Sequence
  Description of Artificial Sequence: Synthetic coding sequence
atggccgtgatggcacccaggaccctggtgctcctgttgagcggggccttggccctgactcagacttgggcacagatagtgctcagtcagagtcccgcgattctgagtgcaagcccaggcgagaaagtcacaatgacctgcagggcttcctcttcagtgtcttatattcactggttccaacagaagcccggatccagtcctaagccctggatctacgccacttctaacctggcctctggagtaccagttagatttagcggatctgggagcggtacctcatattcactcactatttcgcgggttgaagccgaagacgcagctacctattattgccagcagtggaccagcaatccacctactttcggaggcggaacgaaactggagatcaagagaacagtggcagcaccaagtgtgttcatttttcccccaagcgacgagcagctcaagtcaggaacagccagcgtcgtgtgcttgctgaacaacttctacccccgggaggctaaggtgcagtggaaagtggacaatgccctgcagagtgggaacagtcaggagtccgtcactgaacaggattccaaggattcaacgtacagcctctcctccaccctgactctgagcaaagcggactacgaaaagcataaagtctacgcctgcgaggtgacacatcagggattgagctccccagtgactaagtcctttaaccgcggcgagtgc

SEQ ID NO: 15457 - DNA, 711 bp, Artificial Sequence
  Description of Artificial Sequence: Synthetic coding sequence
atggctgttatggctccacgcaccctcgtgcttctgctgagcggtgcattggcactgacgcagacctgggctcaaatagtgcttagccagtcgccggcaattctgtcagcctcaccaggagaaaaagtgaccatgacttgtcgtgcctcctcgtcggtgtcgtacattcattggtttcagcagaagcctggctcgtcacctaaaccatggatttacgcaacttcaaacttggcaagcggcgtccctgtccggttttcgggatccggaagcggaacctcatactccctcacgatcagcagagtggaagccgaggatgcggctacctactactgccagcagtggacctccaacccaccaactttcgggggaggtactaagctcgaaatcaaaagaactgtggcagcaccttcggtgttcatttttccaccaagcgatgaacaactgaagagcgggaccgcatccgtggtctgtctgctcaacaacttttatccacgcgaggcgaaagtccaatggaaagtggataatgcacttcaatccggcaactcacaagaatccgtgaccgaacaagatagcaaggactcaacttactcgttgagctcgacgctgaccctgtcaaaggcagactacgaaaaacataaggtctacgcttgtgaagtgacgcatcagggtcttagttcgcctgtgactaagtcgtttaatcgtggtgaatgt

SEQ ID NO: 15458 - DNA, 711 bp, Artificial Sequence
  Description of Artificial Sequence: Synthetic coding sequence
atggctgtcatggcaccccggacactggtcctgcttctgagtggtgctctggctctgacacaaacatgggcacaaatagtgttgtcccaaagtcctgccattctatcagcttcgccgggagagaaagtaaccatgacctgtcgagccagcagcagcgttagctacatccactggttccagcagaaaccaggctcaagccctaaaccatggatatatgctacaagcaacttggcatcaggcgttcccgtaagattctccgggtctgggagcggaaccagttattcactgacaatcagcagggtcgaagccgaggatgccgccacttattattgccagcagtggacaagcaaccctcccacattcggcggtgggacaaagctcgagatcaagagaacagtcgcggccccttcagtttttatttttcccccatcagacgagcagttgaagagcgggactgcgtccgtggtttgtctgctaaacaacttctaccccagggaggcgaaggttcagtggaaagtggataatgccctacagagcggcaatagtcaggaatccgttacagagcaggattccaaggactcaacatattccctcagtagcacactgaccttaagcaaagcagactacgaaaaacataaagtgtacgcttgcgaagtcacccaccaaggactttcgagtcctgtcacgaagagctttaacaggggcgaatgt

SEQ ID NO: 15459 - DNA, 711 bp, Artificial Sequence
  Description of Artificial Sequence: Synthetic coding sequence
atggcagttatggcacccagaactttggtgctgctgttgtcaggcgccctggccttgacacaaacatgggctcaaatcgtactgtcccagtccccagcaatcctcagtgccagcccaggcgagaaagtcacgatgacctgtcgcgcatccagttcagtgtcttacattcattggtttcagcagaagcccggatcttcccccaagccctggatttacgccaccagcaacctggcttccggtgtacccgtgaggttttccggatccggtagcggtacaagctattccttgacgatctcccgcgtcgaggccgaagacgctgcgacatattactgccagcaatggacgtcaaatccgccgaccttcggtggaggaactaagttggagatcaagagaacagtggctgccccctctgtttttatttttccacctagcgacgaacagctcaaatccggtacagcaagcgttgtttgcctcctcaataatttctacccacgcgaggccaaggttcagtggaaggtggacaatgcactccaatcaggcaactcccaagagtcagtcactgaacaagatagcaaagatagtacttatagtctctctagtacacttacactctccaaggcggactatgaaaagcacaaggtttatgcttgtgaggttactcatcaaggtctgtcttctcccgtcacgaaatcttttaacagaggagagtgc

SEQ ID NO: 15460 - DNA, 711 bp, Artificial Sequence
  Description of Artificial Sequence: Synthetic coding sequence
atggccgtgatggctcccaggacactggtactgctgctttctggggcccttgctctcacacaaacatgggcgcagatagtgctctcacagtcaccagccatcctcagtgccagtcctggggaaaaagtcacaatgacatgtagggcctcatcttccgtgtcttatatacactggttccagcaaaaaccaggatcttccccaaaaccttggatctatgcaactagtaacctagcgtctggggttcccgtgagattctccgggagtgggtcggggacttcctactctttgactatttctcgtgtcgaggcagaggacgctgcaacatactactgtcagcagtggacaagtaacccacctacattcgggggggggactaaactcgaaatcaaaaggacagtggcggccccctccgtgttcatttttccacccagtgatgagcaattaaaatctgggacagcctctgtcgtttgtctgctcaataatttttatccccgagaggccaaagtgcagtggaaagtcgataacgccctacagtcagggaattcacaggaaagtgtaactgaacaggactcgaaagatagtacttattccttatcctcgacacttacactatctaaagcagattatgaaaagcataaggtgtacgcttgcgaggtgactcatcaggggctgtcctcccccgtgacaaaatctttcaaccggggggaatgc

SEQ ID NO: 15461 - DNA, 711 bp, Artificial Sequence
  Description of Artificial Sequence: Synthetic coding sequence
atggctgtgatggccccacgaaccctcgttttgctgctgtctggcgcattggctttaacccagacctgggcgcagatcgtcctctcacagtctccagccatcctctctgcctcacccggtgagaaagtcactatgacctgcagggcttcttccagtgtttcatacatccactggtttcagcagaagccgggcagcagcccaaaaccttggatttacgcgacttccaatcttgcctctggtgtcccggttaggttctctggatccggctctgggacctcctattcgcttactatctctagggtggaagccgaagacgctgctacgtactattgccagcagtggacatcaaacccaccaactttcggcggcggcacaaaattggagataaagaggaccgtggccgctcctagcgtgtttatcttcccaccaagcgacgaacaactgaagtccggaaccgcctccgttgtctgcttgcttaacaacttctaccccagagaagccaaggtccagtggaaagtggacaatgctctccagtccggtaacagtcaggagagcgtcactgaacaggacagcaaggattcaacatacagtttgtcttccaccctgaccctcagcaaggctgattatgaaaagcacaaagtttatgcctgtgaagtgactcaccaggggctctcttcgcccgtcacaaaatccttcaatcgaggcgagtgt

SEQ ID NO: 15462 - DNA, 711 bp, Artificial Sequence
  Description of Artificial Sequence: Synthetic coding sequence
atggctgtgatggccccgcgcactctcgttctgctgctgtccggtgcgttggccctgactcagacgtgggcacagattgtcctgtcgcagtccccggccatcctgagcgctagccctggggagaaagtgactatgacctgccgcgcgagttcgtcggtgtcctatattcactggttccagcaaaaaccgggcagctcaccgaagccgtggatctacgcgacctcaaatctggccagcggagtcccggtgagattctccggctccggcagcggaacgtcttactccctcacgatcagccgggtcgaggctgaagatgcagcaacttactactgccaacagtggaccagcaaccctcctacttttggaggaggaactaagttggaaatcaaaaggaccgtggcggcgccgtcagtgttcatattcccgcccagcgacgagcaactgaagtccggaaccgccagcgtcgtctgcctcctgaacaacttttacccgcgggaagccaaagtacagtggaaggtggacaacgctctccagtcgggcaattcgcaagaaagcgtcactgagcaagactcgaaagattccacttactcgctctcgtcgaccttgacgttgtccaaggctgattacgaaaagcataaagtttacgcgtgtgaagtgacgcaccagggactctccagcccggtgaccaagtcattcaatcggggtgaatgc

SEQ ID NO: 15463 - DNA, 711 bp, Artificial Sequence
  Description of Artificial Sequence: Synthetic coding sequence
atggctgttatggcgcctaggaccctggtgctgctgctgagcggcgcgttagcgctgactcagacgtgggcccagattgtcctgagccagtcaccggcgattctgagcgcaagccctggcgagaaagttacgatgacttgtcgtgcaagctcaagcgtctcgtatattcattggtttcagcagaagcctgggtcttcgccgaagccttggatttacgcaacaagtaatctggctagcggcgtcccggttcgcttctcaggtagtggttccggtacaagctactctctcacgatctcgcgcgtggaggctgaagatgcagcgacgtactactgccagcaatggacctccaatccgcctaccttcggtggtgggaccaagctcgaaattaagcgcacggttgcggcgccttctgtctttatctttccgccatccgatgagcagctgaaatcagggaccgcaagcgtggtttgtttgctgaataacttctatccgcgtgaagcgaaagttcaatggaaggtggataatgcgttgcagtcaggtaacagccaggaatccgttacagaacaggacagcaaagatagcacctatagcctgagcagcacgcttacgctgagcaaagccgactacgagaaacacaaagtctatgcttgtgaagtaacacaccaggggctgagctcgccggttaccaagagcttcaaccgcggcgaatgc

SEQ ID NO: 15464 - DNA, 711 bp, Artificial Sequence
  Description of Artificial Sequence: Synthetic coding sequence
atggccgtcatggcgccgaggacattggtactgttgttgagcggcgcccttgccctgacccaaacttgggcccaaattgtgctgtcacagtcccctgccatcctgtcggcgtctcccggcgagaaggttaccatgacgtgtcgggcctccagtagtgtatcttatatccattggtttcagcagaagcctggatccagtcctaagccttggatctacgcaacctctaatctagcaagcggagtacccgtgagattcagtggtagcggatcagggacgagctactctctgactatatctagggtcgaagctgaggacgcagcaacttattattgtcagcagtggacttcaaatcctcccactttcgggggcggcacaaaactcgagattaagcgcaccgtggcggctccatctgtcttcatctttccccctagcgacgaacaactcaaatctgggaccgccagcgtggtctgcctcctgaacaatttttatccccgtgaggccaaggtacagtggaaggtggacaacgcactacaatctgggaactcccaggagtcagtcaccgaacaggactccaaggatagcacctattcactgtccagtactctcactttgtccaaggctgattacgagaaacataaagtgtacgcctgcgaagttacccatcagggactgagtagtccggtcacaaagtccttcaaccgaggggagtgt

SEQ ID NO: 15465 - DNA, 711 bp, Artificial Sequence
  Description of Artificial Sequence: Synthetic coding sequence
atggctgtgatggcaccaagaacgcttgtcctcctcttgtctggcgctctcgctctgacccagacctgggcccaaatagtcctgagccagagccccgctatcctgtccgctagccctggagaaaaggttacgatgacctgtcgcgcttcctcgagcgtgtcctacattcactggtttcaacagaaaccggggtcatctcccaagccatggatatatgctacttctaacctggcctccggtgtacctgtgagatttagcgggagcgggagtggcacatcttacagtttaaccatttctagggtggaggccgaggacgccgcgacatattattgtcaacagtggacaagcaatcctcctactttcggcggggggaccaaactggagatcaagagaacagtggccgcaccgagcgtcttcatttttccacctagcgacgagcagctcaaatctggaacggcctccgtggtgtgtctgctcaacaacttctatccgcgtgaggctaaggtgcaatggaaagttgacaacgcactgcagtcgggcaattcccaagagtcagtgaccgagcaggattcaaaggactcaacatactccttatcttcgacactcacactgtcaaaggccgattacgagaaacataaagtgtacgcgtgcgaggtaactcaccagggcctgtcctcacccgtgactaagagcttcaaccgcggggaatgc

SEQ ID NO: 15466 - DNA, 711 bp, Artificial Sequence
  Description of Artificial Sequence: Synthetic coding sequence
atggccgtcatggcgccgagaactctggtcctcctcctctcaggcgccttggcacttactcagacctgggctcagattgtcctgtcacaatcgccggccatcctcagtgcttcgcccggcgagaaggtgaccatgacttgtagggcttcttcctcagtcagttatatccactggttccagcagaaaccgggctcaagccctaagccctggatctacgccacttctaacctggcctcgggtgtcccggttcgcttcagcggctctgggagcggaacttcatacagcctgaccatctctcgagtggaggcggaagacgccgcgacctactactgccagcaatggacttcgaacccgccaaccttcggaggagggacgaagctcgaaatcaagcggactgtggcggcaccctccgtgttcatcttcccacctagcgacgagcagctgaagtccggtaccgcatcggtcgtctgcctcctgaacaacttttacccacgcgaggcgaaggtgcaatggaaagtggataatgcgctccaaagcggaaattcgcaagaatcggtgaccgaacaggactccaaggattcgacgtactccctcagttccacgctcactttgagcaaggcggactacgaaaaacacaaagtttacgcatgcgaagtgacccatcagggactgtcatctccggtgaccaagtcgtttaatcggggagagtgt

SEQ ID NO: 15467 - DNA, 711 bp, Artificial Sequence
  Description of Artificial Sequence: Synthetic coding sequence
atggcggtgatggcgccgcgaactctggttctcctgttgtcgggagcactcgctctgacccaaacctgggcccaaatcgttctgtcacagtcaccggcaatcctgtccgcgtcaccaggagagaaggtcactatgacctgcagagcgtcatcctccgtctcgtacatccattggtttcaacaaaagccgggatcgtccccaaagccgtggatctatgcgacctccaatcttgcttcaggagtgccggtccggttctccggttcgggtagcggtacttcatattcactcacgatatcccgggtggaagctgaggacgcggctacttactactgtcagcagtggactagcaaccctccgaccttcggaggtggaactaaattggaaatcaagcgcacggtggcagcaccgtccgtgtttatcttcccaccatccgacgaacagctgaaatccgggaccgcctcagtggtgtgtctgctcaataacttttaccctcgggaagccaaggtccagtggaaagtggacaacgcacttcagagcggaaattctcaggaatcagttacggagcaggattccaaagacagcacctactccctgagttccactctcaccctctcgaaggccgattacgagaagcacaaggtgtacgcctgcgaggtcacccaccagggactttcgagcccagtgactaagtccttcaatagaggggaatgc

SEQ ID NO: 15468 - DNA, 711 bp, Artificial Sequence
  Description of Artificial Sequence: Synthetic coding sequence
atggcggtgatggccccccggacccttgtgttgctgttgtcaggagccctggccctcactcagacctgggcgcagatcgtcctctcgcagagcccggcgatcctctctgcgtcacctggcgagaaggtcaccatgacttgtcgcgcttcctcaagcgtgagctacatccactggttccaacaaaagccaggaagctcgccgaagccgtggatctacgcaactagtaatcttgcctcgggagtgcccgtgcgcttctccggctcaggttcgggaacctcgtactccctgactatttccagagtcgaagctgaggacgccgcaacttattactgccaacagtggacctcgaaccctccgaccttcggcgggggaactaagctggagatcaaacgaactgtggctgcaccgtccgtctttatttttcctccgtccgatgaacagctgaaaagcggaaccgcctctgtggtgtgcctgctgaacaatttctacccacgggaagccaaggtgcagtggaaggtcgacaacgcactgcagagcggaaactcccaagagagcgtcacggaacaagactcaaaagattcaacctactcgctgagctccactctcaccctgtcgaaagcggactacgagaagcacaaggtttacgcctgcgaagtgacgcatcaggggctctcgtccccagtgaccaagtcattcaataggggtgaatgc

SEQ ID NO: 15469 - DNA, 711 bp, Artificial Sequence
  Description of Artificial Sequence: Synthetic coding sequence
atggccgtgatggcgccacgtactttggtccttcttctttcgggagcacttgcgctcacccagacctgggctcagatcgtgttgtcgcaaagccctgccattttgtcagcatcccccggggagaaagtgacgatgacttgtcgcgcatcgtcgtccgtgtcttacatacattggttccagcagaaacctggttcatctcctaagccgtggatttacgcgaccagcaatctggctagcggagtgcctgtcagatttagcggttcaggttcagggacctcgtactcgctgactatctcccgggtcgaagcagaggatgctgcaacctactactgtcaacaatggaccagcaacccacccacctttggagggggtaccaagctggagattaaacgaactgtcgcagccccatccgtctttatctttcccccttcagacgaacaacttaagtcgggcactgcctcggtcgtgtgcctgctgaataacttttacccacgcgaagcaaaggtgcagtggaaagtggacaatgcgctgcaatccggcaactcacaagaatcggtcaccgaacaggactcgaaggattcgacctacagcctgtcctcgaccctgaccctctccaaggcagactacgaaaaacataaagtctacgcttgcgaggttactcatcagggcctttcgtccccagtgaccaagtcgttcaatcggggagaatgt

SEQ ID NO: 15470 - DNA, 711 bp, Artificial Sequence
  Description of Artificial Sequence: Synthetic coding sequence
atggcagtcatggccccaagaaccctggtcctactccttagcggcgctttggcattgacacaaacatgggctcaaatcgttctgtctcaatcacccgccatacttagcgcttcccctggcgagaaagtgaccatgacttgcagagccagcagctccgtcagctatatccattggttccagcagaaaccaggctcgagccccaagccgtggatttacgccacttcgaacttagcctctggtgttcccgttaggttcagcggatctggaagcggcacctcatacagtctgacaatttctagggtggaagccgaggatgccgctacctactactgccagcagtggacaagcaacccacctaccttcggcggaggcaccaagctggagattaaacgcacagttgcggccccctcagtgtttatttttccccctagtgacgagcagctgaagtctggcaccgcctccgttgtgtgcctcttgaataatttctaccctagagaagctaaggtccagtggaaagtcgacaacgccctccagtcaggcaacagccaggagagtgtgactgagcaggactcaaaggattctacatatagccttagttccacactgacactttccaaggcagactatgagaagcacaaggtgtatgcatgcgaggtcacacaccagggcttgagctcacctgttaccaagagttttaaccgaggagagtgc

SEQ ID NO: 15471 - DNA, 711 bp, Artificial Sequence
  Description of Artificial Sequence: Synthetic coding sequence
atggcagtgatggctcctaggactctcgtgctccttcttagcggggccctggcactgacccagacttgggcgcagatagtcctctcccagtccccagcaattttgtccgcgtcaccgggagaaaaggttactatgacgtgccgtgcctcatcctccgtttcgtacatacactggtttcaacagaagcctggttcgtctcctaaaccctggatttatgcgaccagcaacttggcatccggagtgcctgtgcgtttctccggctcagggtccggtacttcgtactcactgaccatttcgagagtggaggctgaagatgccgccacctattactgccaacagtggacttccaacccgccaacttttggtggcggaaccaagctcgagataaagcggacggtggcagctccatcagtctttatcttcccaccatcggatgagcagctgaaatctggaactgcatcagtcgtgtgtctcctgaataacttctaccctagagaagcaaaggtgcaatggaaagtcgacaacgcattgcaaagcggtaactcacaagaatccgttaccgagcaagattcaaaggactcaacctactcactgtcatcgactctgaccctgtccaaggcggattatgaaaaacataaagtctacgcttgcgaagtgactcaccaaggacttagctcgcctgtgactaagtcgtttaaccgcggtgaatgt

SEQ ID NO: 15472 - DNA, 711 bp, Artificial Sequence
  Description of Artificial Sequence: Synthetic coding sequence
atggcagtgatggcgcctcgtactcttgtgttgctcctctcgggcgcactcgcacttactcaaacctgggcacagatcgtcctgtcacaatcacccgccatactgagcgcatccccaggagaaaaggtcacgatgacctgtagagcgtcatcaagcgtctcatacatccactggttccagcaaaagccgggaagcagccctaagccatggatctacgccacttcaaatcttgccagcggtgtcccagtgcggttttcaggtagcggatcaggaacttcgtactcgttgacgatatcccgcgtcgaagccgaagatgcagcaacttactattgtcagcagtggacgtccaaccctcctaccttcggtggagggactaaacttgaaatcaagcggaccgtcgcagcacctagcgtgtttatctttcccccttcggatgagcagctcaaatccggtaccgcgtccgtggtgtgtctgctcaacaacttttacccgcgggaggcaaaggtccagtggaaggtggataatgccctccaatcgggaaacagccaagagtccgtgactgaacaagacagcaaggattcaacttatagcctctcgtcaaccctgacgctgtccaaagcagactacgaaaaacacaaggtttacgcatgcgaagtgacccatcaagggctgtcatcgcctgtgaccaagtcctttaaccgaggagagtgt

SEQ ID NO: 15473 - DNA, 711 bp, Artificial Sequence
  Description of Artificial Sequence: Synthetic coding sequence
atggctgtgatggccccacggactttggtgctcctcctatcaggcgcactagctctgacgcagacctgggctcagattgtgctttcccaatccccggccattttgtcggccagtccgggggaaaaggtaacaatgacgtgtcgcgcctcttcctccgtgagttatatccactggtttcagcagaaaccaggaagttcaccaaagccctggatctacgccacttctaacctagcttccggtgtaccagtgcggttttccggatccggtagtgggaccagctactcactcaccatctctcgagtcgaagcagaagatgccgccacatactattgccaacagtggacgagcaacccacctacattcggcggcggaaccaaactggagattaagaggaccgtggccgcacccagcgttttcatctttccacctagtgacgaacagttgaagtccggcacagcatccgtggtctgtcttttaaataatttttacccgcgggaggcgaaggttcagtggaaggtcgacaatgctctgcagtccggcaactctcaggaatcagtgacagagcaggactctaaagactccacctactcactcagcagcactctgaccctgagcaaagctgattatgagaaacataaggtatatgcatgtgaagttacacaccaggggctatcaagcccagtgacaaagtcttttaataggggcgagtgc

SEQ ID NO: 15474 - DNA, 711 bp, Artificial Sequence
  Description of Artificial Sequence: Synthetic coding sequence
atggcggtgatggcgccgcggaccctcgtgctccttctctcgggagcactggcactgactcagacttgggctcagatcgtcttgagccagagccccgccattctgagcgcgagcccaggggaaaaagtgactatgacctgtcgagcgtcatcctccgtctcatacatccactggttccagcagaagccgggaagcagcccgaagccatggatttacgcgactagcaacctggcgtcaggagtgcctgtgagattcagcggttcaggatccggcaccagctactcactcactatctcgagagtcgaggcagaggacgccgcgacctactactgccagcaatggacctccaaccctccgactttcggcggaggaaccaagctggaaatcaagagaaccgtcgctgccccttcggtgttcatttttccgccgtctgatgagcagctcaaaagcggaactgcgagcgtggtgtgccttttgaacaacttctacccaagggaggcgaaggtccaatggaaggtggataatgccctgcaatcgggaaactcccaggagagcgtgaccgaacaagactctaaggactcaacttactcgctcagctcaactctgacgctgtcgaaggccgactacgaaaaacacaaggtgtacgcatgtgaagtgacccaccagggtctgtcgagcccagtcaccaagtcgtttaatcgcggagaatgc

SEQ ID NO: 15475 - DNA, 711 bp, Artificial Sequence
  Description of Artificial Sequence: Synthetic coding sequence
atggcggtgatggcccctcgcaccctggtgctccttctgtcaggggctctggctctgacccagacctgggcgcaaatcgttctgtcacagtcacccgccatccttagcgccagcccaggtgaaaaggtaactatgacatgtcgagcatcatcaagtgtgtcgtacatccattggttccaacagaaacctgggtcatctcccaagccttggatttatgccacctccaatttggcctctggggtacctgtgagatttagcggctctggctcaggcacctcatattcactcacaatcagccgcgttgaggcagaagacgcggcaacctattattgccaacagtggacttctaacccccctacatttggtggaggtaccaaacttgagataaagcgcaccgtggctgcaccatccgtgtttatcttcccaccttctgacgagcaactgaagtctggcaccgcttctgtggtctgtttgctgaacaacttctacccccgtgaggctaaggtccagtggaaagtggataacgctctgcaatccggcaactctcaggagtcagtgaccgaacaagattctaaggattccacatactccctcagctcaactttgaccctctcaaaggcagattacgagaagcacaaggtatacgcctgtgaggtcacacaccaaggcctgtcttctccagtgacaaagtctttcaatagaggcgagtgt

SEQ ID NO: 15476 - DNA, 711 bp, Artificial Sequence
  Description of Artificial Sequence: Synthetic coding sequence
atggcagtcatggccccacgcaccctcgttcttctccttagcggtgccctggccttgacgcaaacttgggcacaaatagtcctttcccagtcaccggctattctcagcgcgtcgcctggagaaaaagtgaccatgacttgtcgagcctcgtcctcagtgtcctacatccattggtttcagcagaagcctggatcgtcacccaagccttggatttacgctacctctaacctggcgtcaggagttcctgtgagattttcgggttccgggtccgggacttcatactcgctgaccatttcgcgtgtggaggcagaggacgcggcaacttactactgccagcaatggactagcaacccacccacctttggcggtggcacgaaattggagattaagcggactgtggcagctcctagcgtgttcatcttcccaccttcagatgaacaactcaagagcggcaccgcctctgtcgtctgtcttttgaataacttttaccccagggaagccaaagtacagtggaaggtggataatgcactccagtcaggaaattcccaagaatcggtgactgaacaagactccaaagattcgacctatagtttgtcgtctactctgactctgtcgaaggcagattacgagaagcataaggtatacgcatgcgaagttacccaccaaggactgtcgtccccagtgaccaagtcttttaaccggggagaatgt

SEQ ID NO: 15477 - DNA, 711 bp, Artificial Sequence
  Description of Artificial Sequence: Synthetic coding sequence
atggccgtcatggcacctaggactttggtgctgttgctcagcggtgcacttgccctgacccaaacttgggcacaaatcgtgctgtcccaaagccccgcaattctctcggcatcgcccggagagaaggtgaccatgacttgtcgagcatcaagctcggtgtcttacatacattggtttcaacagaaaccaggatcatcgcccaagccgtggatctacgcgacctcaaatttggcctccggggtccccgtgaggttctcggggtcaggctccgggacctcctactccctcaccatttcgcgtgtcgaagcggaggatgcagcaacttactactgccaacagtggacctcaaaccctccaaccttcgggggcggcaccaagctggagatcaaacgcaccgtcgcggctccaagcgtgttcatttttccacctagcgatgagcaattgaagtccggaaccgcatcagttgtctgccttctcaataacttttacccgcgtgaagcaaaggtgcagtggaaggtcgacaatgcacttcagagcggaaacagccaagaatcagtgactgagcaggactccaaggactccacttattcactgagctccactctgactctctcgaaggcagattacgagaagcacaaggtctacgcgtgcgaagtaacgcaccaaggcctgtcctcgcctgtgactaaatcctttaaccgaggtgagtgt

SEQ ID NO: 15478 - DNA, 711 bp, Artificial Sequence
  Description of Artificial Sequence: Synthetic coding sequence
atggccgttatggcaccacgcaccctggtcttgttgctaagtggagccctcgccctcacgcagacttgggcacagattgtcttgagccagtctcctgcaattctttctgcctcgcctggtgagaaggtgaccatgacttgtcgggcttcatccagtgtttcttacattcactggttccagcagaagcccgggtcttctccgaagccatggatatatgccaccagcaatctggcttccggcgtgcctgtgaggttctccggatctgggtccggaactagttatagcctcacaatctctcgcgtggaggccgaagacgcagctacgtattactgccagcagtggaccagtaatccccccaccttcgggggcggaaccaagcttgaaattaagaggacagtggccgcaccatcagttttcattttccctccttctgacgagcagctgaagtccggaaccgcctcggtcgtttgcctgctgaacaatttctacccccgagaagccaaggtgcagtggaaggttgataatgccttgcaatcggggaactcccaagagagtgtgacagaacaggacagcaaagatagcacatatagtctctcctctacactgacactgagcaaggcggattacgaaaagcataaagtgtacgcttgcgaggtcacacaccagggcttgtcatccccagttactaagtcattcaaccgaggagaatgc

SEQ ID NO: 15479 - DNA, 1467 bp, Artificial Sequence
  Description of Artificial Sequence: Synthetic coding sequence
atggctcccgtggcagtgtgggctgcactcgcggttggacttgaactctgggcagcggctcatgcactgcctgcccaggtcgcgttcacgccatacgcaccagaaccaggttccacttgcagactgagagaatactacgatcagactgcgcagatgtgttgttcgaagtgttccccagggcagcatgctaaggtgttttgcaccaagacgagcgacacggtctgtgattcgtgtgaggattcgacttacacgcaactctggaactgggtcccagaatgtctgagctgtggatcgcgttgctcctccgatcaagtggaaacccaggcctgcaccagagaacagaatcgaatttgtacctgtaggcctggttggtactgcgctcttagcaagcaagaaggctgtaggctgtgcgcaccacttagaaaatgccgaccaggctttggcgtggccagaccaggtaccgaaactagcgacgtggtctgtaagccgtgtgcccctggaaccttttcaaatactacctcctccaccgacatctgtagacctcatcagatttgtaatgtcgtggcaatcccggggaacgccagcatggatgcggtctgtacttccacctcccctaccagatcgatggcgcccggtgcagtgcatctgccacaaccagtgtccactcgttcccaacacactcagccaactccagaaccatcaaccgctccttctacctcctttctgctccctatgggtccttcgccccctgcagaaggatccaccggcgacgaaccaaagtcctgcgacaagacgcatacctgtcctccgtgtcccgcacctgagctgcttggtggaccatcagtattcctttttcctcccaagccaaaggatactttgatgattagcaggactcctgaagtcacttgcgtggtcgtcgatgtgtctcatgaagatcccgaagtgaaattcaactggtacgtggacggtgtggaagtccataacgcaaaaaccaagccacgtgaagagcagtacaattcaacttaccgcgtcgtttcggtgttgactgttcttcaccaggactggctgaacggaaaagagtataagtgcaaggtcagcaacaaagcacttccagcacctatagaaaaaacgattagcaaggctaaaggacagccgcgtgaaccccaggtgtacactctcccaccctccagagaagaaatgaccaagaaccaagtctccctgacctgcttggtgaagggattctacccttctgatattgcagtggaatgggaatcaaatggacagcctgagaacaactacaaaaccacccctccagtgctggattcagacgggtcatttttcctctactcgaagctgaccgtcgataagtcgcgctggcaacagggaaacgtgttttcctgctccgtgatgcacgaagcacttcacaaccattacactcaaaaatccctttcgctgtcgcctggaaag

SEQ ID NO: 15480 - DNA, 1467 bp, Artificial Sequence
  Description of Artificial Sequence: Synthetic coding sequence
atggccccagtggcggtctgggcggcccttgccgtgggactcgagctctgggcagccgcacatgccctgccagctcaggtggccttcactccgtatgctccagaacctggctccacttgcaggctccgcgagtactacgatcagacggctcaaatgtgctgctcgaagtgctcgccgggacagcatgccaaggtgttctgcaccaaaacttctgatactgtgtgcgattcatgcgaggattccacctacactcaactctggaactgggtgccggagtgtttgagttgtggctcgagatgctcgtccgatcaggtggagactcaagcctgcactcgtgagcagaacagaatttgcacctgtaggccaggatggtactgtgcactttccaagcaggagggctgccggctctgtgcaccactgcgaaagtgccgcccgggatttggagtcgcacggccaggcaccgaaacctccgacgttgtctgcaagccgtgcgcccccggaactttctccaacaccacttcgtccaccgatatctgtcggcctcatcaaatttgtaatgtggtggccatcccaggaaacgcctcaatggacgcagtgtgcacgtccacgtcacctactagatccatggctccgggggcagtgcatctgccgcagccagtgtccaccaggtcccagcacacccaaccgaccccagaaccttctacggcgccttccactagcttcctgctgccgatgggaccgtcgccaccggcagaaggcagcactggagacgagccaaagtcgtgcgataagactcatacctgcccaccatgcccggcgccggaactgctcggggggccgtcggtctttctgtttccgccgaagcccaaggacactctgatgatctccaggacccccgaggtgacctgtgtggtcgtggatgtcagccatgaggatccggaagtgaagttcaactggtacgtggatggcgtggaagtccacaacgccaaaacgaagccgcgcgaagaacagtacaatagcacctaccgcgtggtcagcgtgctcaccgtgctccaccaagattggctgaacgggaaggagtacaagtgcaaagtgtccaataaggctttgccggcgcctatcgagaaaactattagcaaggccaagggacagccgcgggaaccgcaggtctacacgctgcctccgtcccgcgaggaaatgaccaaaaatcaagtcagcctgacttgcctggtcaaaggcttctacccatccgacatcgcagtggaatgggaaagcaatgggcagccggaaaacaattacaaaaccactccgccggtgcttgactcggacggatcattcttcctttactcgaagctgactgtggacaaatcccgttggcagcaggggaacgtcttttcgtgctcggtcatgcatgaggccttgcacaatcactatactcaaaaatccctgtcgctgtctccgggaaag

SEQ ID NO: 15481 - DNA, 1467 bp, Artificial Sequence
  Description of Artificial Sequence: Synthetic coding sequence
atggctcctgtagcggtgtgggccgccttggcggtcggacttgaactttgggccgcggcacatgctttgccagcacaagtggcttttacaccctacgctccagagcctggttctacttgcagactgcgcgagtattatgatcagacagcgcaaatgtgttgcagcaagtgctcccctggacagcatgccaaggtgttctgcacaaagacttcagatacggtgtgtgacagctgcgaggacagtacttatactcagctgtggaactgggtgcctgagtgcctctcttgcggatccagatgttcatccgaccaggttgaaacccaggcgtgtacgagggagcagaacaggatctgcacttgcaggcctggctggtactgcgcgctgtcaaagcaggaaggttgccgcttgtgtgcccccctcaggaagtgccgccctggctttggcgtggctcgccctggtacagaaacctctgacgtggtgtgcaaaccatgtgcacctggaacattctctaatactacctctagtaccgatatctgccgccctcaccagatctgtaacgtggtcgccattccgggcaacgcatctatggatgccgtgtgtacatctaccagccccacaaggtccatggcgcccggagcagttcatctgccccagcccgtatccactagatcacaacatacccagcctacccccgagccttccactgctccatctacaagtttcctgctgccgatgggtccctcacctcccgcagaaggctcaacaggcgacgaaccaaagagctgcgataaaacgcacacttgtcctccatgtcctgctcctgagcttctgggaggtccatcagtgtttctttttcctcccaaacccaaggacaccctcatgatttccaggacccctgaagtcacgtgcgtcgttgtggacgtcagccacgaagatcctgaggtcaaattcaactggtacgtagacggtgtcgaagtccataacgcaaaaactaagccaagggaagaacagtataacagcacctaccgcgttgtgagcgtacttacggtcctgcaccaggactggttgaatggcaaggaatacaagtgcaaagtctccaacaaggctctgccagcgcccattgaaaaaacaatctccaaagctaaaggacaacccagagaaccgcaagtatataccctgcccccctcaagggaagagatgacaaaaaatcaggtttccttgacttgtctggtcaagggtttctacccaagcgatatagctgttgagtgggagtccaacggccagccagaaaacaactacaaaacaactccccctgtcctcgattccgatggttcctttttcctgtactctaagctgacagttgataagagtagatggcaacagggcaacgttttctcttgcagtgttatgcacgaagccctccacaaccattacacgcaaaaatccctgtctctctctcctggcaaa

SEQ ID NO: 15482 - DNA, 1467 bp, Artificial Sequence
  Description of Artificial Sequence: Synthetic coding sequence
atggcaccagtggcagtctgggctgccctcgccgtaggcctggagttatgggcagccgcccacgcactgcctgcccaggtagccttcacaccatatgccccggagccgggcagtacctgccgtctgcgcgaatattacgatcagactgcccagatgtgctgtagcaaatgttcacctggccagcacgccaaggtcttctgcaccaagaccagcgacactgtatgcgactcatgtgaggactcaacctacactcaactgtggaactgggtccccgaatgtctgtcgtgtggttcaaggtgttcgtccgaccaggtggagacccaagcctgtactagggaacagaatcggatatgtacctgtagacccggttggtattgcgcactgtcaaaacaggagggatgcaggctgtgcgctccattgcgtaagtgtcgccctggtttcggtgtggccaggcctgggaccgaaacttccgatgtggtttgtaaaccatgtgctccaggaacattttccaatacaacctctagtactgacatatgtcgacctcatcagatttgtaacgtcgttgcaatacctgggaacgcctccatggatgcggtctgtacaagtacgtcaccgacccggtcaatggcccctggagccgtgcacttgcctcagccggtgagtacgaggagccaacacacgcagccgacccctgaacccagtaccgctcctagcacgagcttcctgctgccaatgggccctagtcctccggcagaaggtagtaccggtgacgagcctaagtcctgcgacaagacacatacatgtcctccctgtcctgccccagagctcctaggaggaccctccgtcttcttgttcccacccaaacccaaagacactctaatgatatccaggactccagaggtaacctgtgtcgtggtggacgtctctcacgaggatccggaagttaagttcaattggtacgtagacggagtcgaggtacacaatgcaaagaccaaaccgcgggaagagcagtacaactccacatatcgcgtagtgagcgtgttaactgtgttgcaccaggactggcttaacggcaaggaatacaagtgtaaggtgtccaacaaagcactccctgctcccatcgagaaaactattagcaaggctaagggccagccccgggagccccaagtgtatactctgcctccctcacgcgaagagatgacgaagaatcaagtgtctctgacatgcctggtcaagggcttttatccctctgatattgctgtggagtgggagagtaacggccagccggagaacaactacaaaactacacctcccgtattggactccgacggctcctttttcctctattccaagctcacagtggacaaatctcggtggcagcagggcaacgtcttctcctgtagtgtgatgcatgaggcattacacaaccactacacgcaaaaaagcctatcactttcacccggtaaa

SEQ ID NO: 15483 - DNA, 1467 bp, Artificial Sequence
  Description of Artificial Sequence: Synthetic coding sequence
atggcgcccgtcgcagtatgggcagcccttgccgtgggattggagctgtgggcagccgcgcacgcactgcccgcgcaagtggcctttacaccctatgcacccgagccgggatcgacctgtaggctccgcgaatactatgatcagaccgcccagatgtgttgctccaaatgtagccccggacagcacgctaaggtgttttgtacaaaaacaagcgacacagtttgcgactcctgcgaggactcgacgtacacccagctctggaactgggtccctgagtgtctgtcatgtggaagtcggtgtagtagcgatcaggtggagacccaggcgtgcactagggaacaaaaccggatttgtacctgcaggcctggatggtactgtgccttgtccaagcaggaaggatgtcggttgtgcgcccctctgcgcaagtgtaggccaggcttcggggtcgctcgccccggcacagagacatccgacgtagtttgtaaaccttgcgctcctggaactttctctaacactacatccagcacagacatctgccggccccaccagatttgcaatgttgtggcaatccccgggaatgccagcatggacgctgtgtgcacaagtacttcacctacaaggtctatggccccaggcgcagtgcacttgccccaacccgttagtaccagatctcagcacacccagcctacacccgagccgtcaaccgcgccatcaacctcgtttctccttccaatgggcccatctccgcccgctgaaggcagtacgggtgatgagcccaagtcctgcgacaagacccacacttgcccgccttgtcccgctcccgaactcctgggcggacccagtgtattcttatttccaccaaagcctaaggatacacttatgatctctcgcactcctgaagttacttgtgtcgtcgtcgatgtgtcccatgaggatccggaagtgaagtttaactggtacgtggatggagtagaggtgcacaacgcaaaaaccaaaccaagggaggagcagtataatagtacctatagagtggtgtccgtattgacagttctgcaccaggactggcttaatgggaaggaatataaatgtaaagttagcaacaaggccctcccagcgccgatagaaaagaccatcagcaaagccaaaggacaaccacgtgaacctcaggtgtacacactgccaccaagcagggaagagatgactaagaatcaagtcagcctgacttgcctggttaagggcttctatccttcagatattgctgtggagtgggaaagcaacggtcagcctgaaaataattacaagaccactcctcctgtgctggactcagacggatcgttcttcctttactccaagttaaccgtagacaagagtcggtggcagcaaggtaatgtattcagctgttcggtcatgcacgaagctctgcataaccattacactcagaagtcactatcattgtcacccgggaaa

SEQ ID NO: 15484 - DNA, 1467 bp, Artificial Sequence
  Description of Artificial Sequence: Synthetic coding sequence
atggccccggtggcggtgtgggcagcactggccgtgggactcgagctgtgggcggccgcgcacgccctgcctgcccaagtggccttcaccccgtacgcgccagagcctggcagcacctgccggctcagagagtactatgatcaaactgcccaaatgtgctgttcgaagtgctcccctggccagcatgcgaaggtgttttgtactaagacctcggacacggtgtgcgactcgtgcgaagatagcacttacacgcaactttggaactgggtgccagaatgcctgtcatgcgggtccaggtgctccagcgaccaagtggaaacccaggcttgcacgcgggagcaaaacagaatctgcacttgtcgccccggctggtactgtgcgctgtcgaaacaggagggatgtagactctgtgcgccgctgcgtaagtgcagacccgggttcggagtcgcccgccctggaactgaaacttcggacgtggtctgcaaaccttgtgcgccaggtaccttctccaacaccacttcaagcactgatatctgccggccacatcaaatctgcaatgtggtggccatcccgggaaacgcttcaatggacgcagtgtgtacttcgacctccccaacgcgctcaatggcgcctggggccgtgcatctgccgcagccagtctccactcgcagccagcacacccagccgactccagaaccgtcgaccgcgccttcaacgtcattcctgctgccaatgggaccgagcccgccggccgaaggaagcactggagacgaaccaaagtcgtgcgacaagacccacacgtgccccccgtgccctgccccggaactccttggagggccgtcggtgttcctcttcccaccgaagccaaaggacacgctgatgatcagccgcactcccgaggtgacttgcgtcgtcgtggacgtttcgcacgaagatcccgaagtcaagtttaactggtacgtcgacggcgtggaagtgcacaacgcaaagaccaagccgcgagaggagcagtacaactccacctaccgggtcgtctcagtgctcactgtgttgcatcaggattggctcaatgggaaggagtacaaatgcaaagtctccaataaggctctcccggcgccgatcgaaaaaaccatctccaaggccaagggacaaccgcgtgagccacaagtgtacacgttgccgccgagccgcgaagaaatgaccaaaaaccaggtgtcgctgacctgccttgtgaagggattctacccgtccgatatcgcagtggaatgggaatcgaatggacaacctgagaacaactacaagaccaccccaccggtcctggattccgatggcagcttctttctgtactcaaaacttaccgtcgataagtctcggtggcagcagggaaacgtgttctcctgttcggtgatgcacgaggcccttcacaaccactacactcagaagtcgttgagcctttccccgggcaag

SEQ ID NO: 15485 - DNA, 1467 bp, Artificial Sequence
  Description of Artificial Sequence: Synthetic coding sequence
atggctcccgttgccgtctgggccgctttggcagtgggccttgagctttgggctgctgcacacgccctcccggcacaggtcgctttcacgccctacgcaccagaacccggaagcacgtgtcgtctacgcgagtattatgatcagacagcacaaatgtgctgcagtaagtgcagcccaggtcaacatgcaaaggtgttctgcacaaaaacgtctgacacagtctgtgattcctgtgaagactcgacgtacacccaattatggaactgggtgcctgaatgtctctcctgtggctcccgatgctcgagtgaccaagtggaaactcaagcttgcactcgagaacagaaccggatttgcacctgtcggccaggatggtactgcgcactgtcaaaacaggaggggtgtcgcttgtgcgctccactgcgtaagtgccgtccaggattcggcgtcgcgagaccaggaacggaaacctctgacgtggtgtgtaaaccgtgtgctccgggaaccttctctaacaccacctcaagcactgatatctgcaggccacatcaaatttgtaacgttgtagctatccctggaaacgcgtccatggacgccgtgtgcacgagcacgagtcccacccgctcgatggccccgggtgccgttcaccttccgcaaccagtctctactaggagccaacatacacaacctacccccgagccgtcgactgctccttccacgtcgtttttgctccccatgggcccgtcccccccagccgaaggttcgactggcgatgagcctaagtcatgcgacaagacccacacttgcccaccatgtcccgctcccgaactcttagggggtcctagcgtgttcctgtttccgcctaagccaaaggatacactgatgatcagccgaacccccgaagtcacttgcgttgttgtcgacgtttcacatgaagatcctgaggtaaagtttaactggtatgtcgatggagtggaagtccataatgcgaagaccaagccccgcgaagagcagtataattctacgtacagagtcgtgtccgtgctcaccgtcctgcatcaggattggctcaacggtaaagagtataagtgtaaggtttcgaacaaggccctccccgcccctattgagaagacgatcagcaaagctaagggtcagccgcgcgagccccaggtctatactcttcctccgtctcgtgaggagatgaccaagaaccaggtaagcttaacctgtcttgtcaaaggattttacccatcagatattgccgtagaatgggagtctaatggacaacctgagaacaactataagactactcctccggtcctcgactctgatgggtcattcttcctgtacagtaagttgacagtggataagtcacgatggcagcaaggaaatgtcttcagctgttcagtcatgcatgaggctttgcataatcattacacccagaagagtcttagtcttagtcccggcaag

SEQ ID NO: 15486 - DNA, 1467 bp, Artificial Sequence
  Description of Artificial Sequence: Synthetic coding sequence
atggcccccgtggcggtctgggccgccttggctgtcggcctcgaactttgggcagcagctcacgctcttccagcgcaggtggcttttaccccttacgcgccggagcctggctcaacctgtcgtctgagagagtactacgaccagacagcccaaatgtgttgtagcaagtgctcacccgggcagcatgctaaggtcttttgtactaagacctcagacacggtctgcgacagctgtgaggatagcacctatactcagctttggaactgggtgcccgaatgtctgagctgcggcagccggtgtagcagcgatcaggtggaaactcaggcttgcacccgcgagcaaaacagaatttgcacatgcaggccaggctggtattgtgcactttctaagcaggaaggatgcagactgtgcgcgcctctcaggaaatgcagacccggctttggtgtggcaagacctggcactgagacaagcgatgtggtctgtaaaccgtgcgcccccgggacattcagcaacaccacctcatccaccgatatttgccgtcctcaccagatctgtaacgttgtagcaatccctggaaatgccagcatggatgcggtgtgcacctccacctcacctacacgatcgatggcaccgggagccgtgcacctgccacagccagtttcaacacgctcccagcacacacagcctacccctgagccatcaaccgctccttctacctcttttcttctcccaatgggcccttcccctcctgccgaaggaagcaccggcgacgaacctaagtcgtgcgataagacccatacatgcccaccctgccctgccccagaactcctcggaggcccctcagtctttctctttcccccaaaacccaaggataccttaatgataagcaggacacctgaggtcacctgcgtggtggtcgacgtcagccatgaggatcccgaggtgaaattcaactggtacgttgatggcgtggaagtgcacaacgctaaaacaaagccgagggaggaacagtacaacagtacctacagagtggttagcgtgctgacagttctgcaccaagattggcttaacggcaaagagtacaaatgtaaggtttccaacaaagccctgcccgcccccatcgaaaaaactattagcaaggccaagggtcaacctcgcgagccacaggtgtatacactgcctcccagcagggaggaaatgacgaagaaccaagttagcctgacatgtttagtgaagggcttttacccgtctgacatcgcagttgaatgggagtcaaacggacaacctgaaaacaactacaaaaccacccctccagtgcttgattccgacggaagcttctttttatactccaagttgactgtcgacaagtcacgctggcagcaagggaacgtgttcagctgttcagtcatgcacgaggccttacataaccactatacgcagaaaagcctctccttgagtcccggcaaa

SEQ ID NO: 15487 - DNA, 1467 bp, Artificial Sequence
  Description of Artificial Sequence: Synthetic coding sequence
atggccccagtggccgtgtgggcagcgcttgcggtgggtctggaactctgggcagcagcacacgcccttccagcccaagtggccttcaccccttacgcgcctgaacccggctcgacgtgtcgtctcagagagtactacgatcagactgcacaaatgtgctgttccaagtgctcaccaggccagcacgctaaagtgttctgtactaagacgtcggacactgtctgtgattcgtgtgaagatagcacttatacgcaactgtggaactgggtcccagaatgcctctcatgtggctcccggtgctcatcggatcaagtggaaacccaagcatgtacccgagagcagaatagaatttgtacttgtcgccctggatggtactgcgcactttccaagcaggaaggttgccgtctttgtgcgccactgagaaagtgtagaccgggtttcggagtggccaggccgggaactgagacttccgatgtggtctgtaaaccgtgcgcaccaggaacctttagcaatacgacttcaagcacggacatttgtaggcctcaccaaatctgtaatgtggtcgcaatacccggaaacgcatcgatggatgcagtctgtacttcaacctcgcctacccgtagcatggcccctggagccgtgcatctccctcaaccagtctcaacccgttcgcagcatacgcaacccacccccgaaccgagcactgcgccttccactagcttcttgttgcctatgggaccgtcgcctccagcagagggaagcaccggcgacgagccaaagtcctgtgacaaaactcacacttgtcctccatgtcctgcaccggaacttctgggcgggcctagcgtgtttcttttcccacctaagccaaaagataccctcatgatttcccggacccctgaagttacttgcgtggtcgtggatgtgtcccatgaagatcccgaagtgaagtttaactggtatgttgatggggtggaagtgcataatgcgaaaacgaaacccagagaggaacagtacaacagcacttacagagtcgtctcggtgcttactgtgcttcaccaggactggctcaacggtaaggaatacaaatgcaaggtgtctaacaaagcacttcccgctccgatcgaaaagacgatttctaaggcaaagggtcaaccaagagagcctcaagtgtacaccctgccaccttcgcgtgaagagatgaccaagaatcaagtgtcgttgacctgcctggtgaagggcttttacccatccgatatcgcagtggaatgggaatcgaacgggcagccagaaaacaactacaagacgactcctcctgttctcgactccgacggatcgtttttcctctactccaagctgactgtcgacaagtctcggtggcaacagggaaacgtgttttcatgcagcgtgatgcatgaggcacttcataaccattacactcagaaatcgctgtcgctgtcacctggcaag

SEQ ID NO: 15488 - DNA, 1467 bp, Artificial Sequence
  Description of Artificial Sequence: Synthetic coding sequence
atggcccctgtggcagtgtgggccgccctggctgtcgggcttgaactctgggccgctgcccacgcactcccggcgcaagtcgcgtttactccatacgccccagaaccgggatcgacctgccggctgcgcgagtactacgaccaaactgcacagatgtgctgcagcaagtgctcacccggacagcacgctaaagtcttttgtactaaaacctccgacaccgtttgcgacagctgtgaagattccacttatacccagctgtggaactgggtccctgagtgtctgagctgtgggtcgagatgttcttccgaccaggtcgagactcaggcttgcactcgtgaacagaacaggatctgtacttgccgcccgggttggtactgtgcgctttcgaagcaagagggatgccgtctctgcgctcctctgcgcaagtgcaggccgggattcggagtcgccaggccgggtaccgagacttctgatgtggtgtgcaagccgtgcgcgccaggaaccttctcgaataccactagctcaactgatatttgccgtccgcatcagatttgcaacgtcgtggcgatcccaggaaacgcaagcatggatgcggtgtgcacctcgacttccccaacgagatcgatggccccgggggcagtgcatctgcctcaaccggtcagcacccgatcacagcacacccagcccaccccggaaccatcgacggctccttctacgtccttccttctgccaatgggcccatccccgccagccgaaggttccaccggagacgaaccgaagtcctgcgataagactcacacctgcccaccgtgcccggcgcctgaactgctgggaggcccctcggtgttccttttcccacctaagcccaaagacactctcatgatctcccggactcctgaagtgacctgcgtggtcgtggacgtgtcgcacgaggacccagaagtgaagttcaactggtatgttgacggggtggaagtgcataatgccaagacgaagccgagagaggaacagtacaacagcacctaccgcgtggtgtccgtgctcaccgtgcttcatcaagactggttgaatggaaaagagtacaagtgcaaggtgtccaacaaggctttgcccgcgccgatcgaaaaaacgatctctaaagctaaaggacagcctcgggagccgcaggtgtatactctgccgccgtcacgcgaagagatgactaaaaaccaggtgagcctcacttgtctggtcaagggcttctacccgtcggatatcgccgttgagtgggagtctaatgggcagccggagaacaactacaagaccactccccctgtgctcgattcagacgggtcgttcttcctgtactccaaactgactgtcgataagtcgcgctggcaacaaggtaatgtctttagctgttccgtgatgcatgaagcactccacaatcactacacccagaagagcctctcgctgtcccctggcaaa

SEQ ID NO: 15489 - DNA, 1467 bp, Artificial Sequence
  Description of Artificial Sequence: Synthetic coding sequence
atggcccctgtcgccgtgtgggccgcgctggccgtgggactggagctgtgggctgctgcccacgctctgccagctcaagtggcatttaccccgtacgccccggagcccgggtccacctgtagactgcgcgaatactacgatcaaaccgcccagatgtgctgctccaagtgcagccccggacagcatgcaaaagttttctgcacgaaaacctccgacactgtgtgtgactcgtgcgaggactccacgtatacccaactttggaattgggtgccggagtgcctctcatgtgggagccggtgcagcagcgaccaagttgaaactcaagcatgcactagagaacagaatcgaatttgcacttgcagaccaggctggtactgcgccttgtccaagcaggaaggatgccgcctctgcgcgccgctccgcaagtgccggccaggtttcggagtggcgcgtccgggaactgaaacctctgatgtcgtgtgtaagccctgcgctccgggaaccttctcgaacaccacctcgtcaaccgacatctgccggccgcaccagatctgcaacgtcgtcgcgatcccaggaaacgcaagcatggatgccgtctgcacttcaacctcccctactcgctcgatggcgccaggggcggtgcatctcccgcagcccgtgtcgactcggtcccagcatactcagcccactcctgaaccttcgactgcaccatcgacttcgttccttttgccaatggggccgtcaccccccgcagaaggatcgactggtgacgagccgaagtcctgcgacaaaacgcatacttgcccaccgtgtcctgccccggagctgctgggaggaccgagcgtgttcctgttcccgccgaagccgaaggacacgcttatgatctcacgcacgccagaggtgacctgcgtcgtggtggacgtgagccatgaggacccggaggtcaagtttaactggtacgtcgatggagtggaagtgcataacgcaaagaccaagccgagagaggaacagtacaactcgacttacagagtagtctccgtgctgactgtcctgcaccaggattggctgaacggaaaggagtacaaatgcaaagtgtccaacaaagccctgccggcccccattgagaaaacgatctcaaaggccaagggacagccgagggaaccgcaagtgtacactctgccaccatcccgggaagagatgaccaagaaccaggtcagtctgacctgcctggtgaaggggttttacccgagcgacatcgcagtcgaatgggagtccaacggacagccggagaacaattacaagactaccccgccggtgctggatagcgatggatcgtttttcctttacagcaagttgacggtggataagtccaggtggcagcaaggcaatgtgtttagctgttcagtgatgcacgaggctctgcataaccattacactcaaaaatcacttagcctcagcccaggaaag

SEQ ID NO: 15490 - DNA, 1467 bp, Artificial Sequence
  Description of Artificial Sequence: Synthetic coding sequence
atggcgcccgtagcagtctgggcagcactggcggtgggactggaactttgggcagcagcacacgcgctcccagctcaagttgcttttacaccatacgcacccgagccgggatccacatgtaggctgcgggaatactacgatcagactgcccagatgtgctgctctaagtgcagcccaggtcaacacgcaaaggttttctgcaccaaaaccagtgacaccgtctgtgattcttgtgaggatagcacctatactcagctgtggaactgggtcccagagtgcctgtcatgcggatctaggtgttcgagcgaccaggttgagacgcaggcatgtacgcgcgagcaaaatcggatatgtacgtgtcgcccaggctggtactgcgcacttagcaagcaagaaggttgtcggctttgcgcccccctcagaaagtgtcggccaggcttcggcgtggcccgcccaggcacagagactagcgacgttgtctgcaagccctgcgctccaggcactttttctaatacaacgtccagcaccgatatttgccggcctcaccagatctgcaacgtcgtcgcaattccaggcaatgcaagcatggatgccgtgtgcaccagcaccagtcccacaaggagcatggccccaggtgccgttcacctgccacaaccggtctctacaaggtcccagcacacacagcctactcccgagccttccactgccccgagcacctcattcttgcttcctatgggaccttcaccccctgcggaaggcagtaccggtgacgagcctaaatcctgcgacaagacccacacttgccccccctgtcccgcccctgagttgctgggcggaccttcagtctttctgttcccccccaaaccgaaagacactctgatgatttccagaacccctgaggtaacatgcgtagtggtagatgtgtcacacgaagacccggaagttaaattcaattggtatgttgatggagtggaggttcataatgcaaagacaaagcctagagaagagcagtataattccacttatcgggtggtgtccgtcctcactgtgctgcaccaggactggctaaacggcaaagagtataagtgcaaagtttctaacaaggcgctcccagcacccattgagaagacaatctccaaagccaaaggtcagcctagagagccccaggtgtacaccttgcctccttcacgtgaggagatgacgaagaaccaggtgagtctgacatgcttagtcaagggcttttatccctctgacatagccgtggaatgggagagcaacggacagcctgaaaacaactacaagacaacaccccctgtattagacagcgatggttccttcttcctgtatagcaagctcaccgtggacaagtcgcggtggcaacagggtaatgtgttttcttgtagcgtcatgcatgaggccctgcacaatcattacacgcagaagtccctcagcctttcaccgggcaaa

SEQ ID NO: 15491 - DNA, 1467 bp, Artificial Sequence
  Description of Artificial Sequence: Synthetic coding sequence
atggcccccgtcgcagtgtgggctgctcttgcagtcgggctcgaactttgggcggcggcccatgctctaccagctcaggtggcttttactccatacgctcctgaacccggtagcacatgcaggctgcgggagtattacgaccagaccgcccaaatgtgttgctctaagtgctccccaggtcagcatgctaaagttttctgcaccaaaaccagtgacacggtgtgcgactcctgtgaagacagcacctacacccagttatggaattgggtgcctgaatgtctgtcatgcggttctcgctgtagctcagaccaggtcgaaacgcaagcatgtacccgggagcagaatagaatttgtacttgtaggccaggttggtactgcgctctgtccaaacaggaggggtgtcgcttgtgcgcccccttacgcaagtgtaggccaggatttggtgtcgcgcggccaggaactgagacaagcgatgttgtctgcaagccttgcgcccctggcacattctccaatacaaccagctccaccgatatttgccggccgcaccagatctgtaacgttgtggccattcccgggaatgcttctatggacgcagtgtgcaccagcaccagtcccactcggtcgatggcgcctggtgctgtgcacctaccccagccagtatctacaagatcgcagcacactcaacccacacctgagccttccaccgcaccatctacgtccttcctactacctatgggacccagcccccccgctgagggctcaactggcgacgagcccaaatcctgcgataagactcacacttgccctccatgcccagcgcccgaactattgggaggcccaagcgttttcctgtttcctccaaaaccaaaagacactctgatgatatcccggacccccgaagtgacgtgtgtcgtggtggacgttagtcacgaggaccctgaggttaaatttaattggtacgtagatggagtggaggtgcataacgccaagaccaaacctcgcgaagagcagtataatagcacctaccgagtggtgagcgtgctgactgttctgcatcaggattggctgaatggaaaggagtataaatgtaaggtcagtaataaagctctcccagcgcccattgaaaagaccatcagcaaggctaaagggcagccccgggagccgcaggtctataccctgccaccctcacgcgaagagatgacgaaaaatcaggtgtcactgacctgcctggttaagggcttctaccccagtgatatagccgtggagtgggagagtaatgggcagcctgaaaataattataagactactcccccagtgctcgattccgatgggtccttcttcttgtacagcaaactaaccgtggataaatcgcggtggcagcaggggaacgtattcagctgctctgtgatgcatgaggccctccacaaccactacacccaaaaatccctcagcctgtcccctggaaaa

SEQ ID NO: 15492 - DNA, 1467 bp, Artificial Sequence
  Description of Artificial Sequence: Synthetic coding sequence
atggcgcctgttgccgtttgggcagccctggcagtgggtctggaactgtgggcggcagcgcacgctcttccggcgcaagttgcatttaccccgtacgcaccggaaccaggaagcacctgtcgcctgcgcgagtactacgatcagaccgcccagatgtgctgctccaagtgcagcccaggtcaacatgcaaaagtgttctgtaccaaaacgtctgacactgtctgcgattcctgcgaagatagcacgtatacgcaattgtggaactgggttcctgagtgcctaagctgcggtagcagatgttcgtccgaccaagtggagacccaggcttgcacacgggagcagaacagaatttgtacctgccgccctggctggtattgcgcgctgtctaaacaagaaggctgtagactgtgcgccccgttgcggaaatgtcgtcctgggtttggcgtggcacgcccggggacggagacttcggacgtcgtctgcaagccatgcgcaccgggcaccttctccaacaccaccagctccacagatatctgtcgcccgcaccagatctgcaacgtggtggcaatacctggtaacgcgagtatggatgcggtgtgtaccagcacgtcgcctactaggtccatggcacccggtgccgtccacttgcctcagcctgtgagtactcgatctcagcatacccagccaaccccggaacccagcaccgcccctagtacgagctttctgctgccaatgggtccatcccctcctgcggaaggctccaccggagacgagcccaagtcatgcgacaagacgcacacttgtccaccttgtccggctcctgagctgctgggcggtccatccgtatttctgttcccaccgaagcccaaagacacgctgatgattagccgaactccggaagttacgtgtgtggtcgttgacgttagccacgaggaccctgaagtgaagttcaactggtatgttgacggcgttgaagtccataacgcaaagactaagccaagagaggaacaatataactcaacttatcgtgtggtgagcgtcctgactgtgttgcaccaggactggctgaatggcaaagaatacaaatgtaaagtaagcaataaggcgctgccggcaccaattgagaaaacaattagtaaggctaaaggtcaacctcgagaaccgcaggtttacactttgccgccgtcccgtgaagaaatgaccaagaatcaggtgagcctgacctgcctggttaagggtttctacccatctgatattgccgtggagtgggaaagcaatggccaaccagagaacaattacaagaccaccccgcctgtgctggattcagatggatcatttttcttgtacagcaagctgaccgtggacaaaagccgctggcagcagggcaacgtgtttagctgctcagtgatgcatgaggccctgcacaatcattatacccaaaagtctctgtccctgagcccagggaaa

SEQ ID NO: 15493 - DNA, 1467 bp, Artificial Sequence
  Description of Artificial Sequence: Synthetic coding sequence
atggcaccggtggccgtttgggccgcattggctgttggactggaactttgggccgccgcgcacgcgctgccagctcaggtcgcattcaccccgtatgcacccgaacctggttcgacctgcagactccgggagtactacgatcagaccgcccaaatgtgttgttcaaaatgtagcccaggccagcatgccaaggtcttttgcaccaaaacttcggacaccgtctgcgacagctgcgaggatagtacttacacccagttgtggaattgggtgcctgaatgcctgtcgtgtgggtcacgctgttctagcgaccaagtcgagactcaggcgtgcactagagaacaaaacagaatctgtacgtgtaggcccgggtggtactgcgcgctgtcaaagcaggagggttgccgcctgtgcgccccactgcggaagtgccgccccgggttcggagtggcacgcccgggaaccgaaacttccgatgttgtgtgtaagccgtgcgccccaggcaccttttctaacaccacttcaagcactgatatttgccgcccgcatcagatatgcaacgtggtcgcaatcccagggaatgcctcgatggacgccgtgtgtacgtcgacttctcccacccggtcaatggcgccaggtgccgtgcacctcccgcaaccagtttcgactcggtcacaacacacccagcctactccagagccttccaccgcgccttcgacgtcctttcttctcccgatgggaccgtccccgcccgcagaaggctcgactggagacgaaccgaaatcgtgcgataagactcacacctgcccgccttgcccagcaccggaactcttgggaggaccgtcagtgttcctcttcccgccgaagccaaaggacaccctcatgatctcgcggactccagaagtaacctgcgtcgtagtggatgtgtcgcatgaggacccggaggtgaagttcaattggtacgtggacggcgtggaggtgcataatgctaagaccaagccacgcgaggaacaatacaacagcacctaccgggtcgtgtccgtgctgactgtgctgcatcaagattggctcaatggaaaggaatacaagtgcaaggtgagcaacaaggctcttccagcacccatcgaaaaaactatctcgaaggcgaaaggtcagccgcgagagccgcaggtgtacacgcttccgccgagtcgcgaggagatgactaagaaccaggtgtccctgacctgcctggtgaagggattctacccgagcgacatcgccgtggaatgggaatccaacggacaacccgagaacaattacaagactactccacccgtcctggacagtgacggctcctttttcctgtattcgaaactgaccgtggataaaagcaggtggcagcaggggaacgtattcagctgctcagtcatgcacgaagccctccacaaccactacacccagaaatcactgtcgttgagcccgggtaag

SEQ ID NO: 15494 - DNA, 1467 bp, Artificial Sequence
  Description of Artificial Sequence: Synthetic coding sequence
atggctcccgtcgcagtatgggcagctttagccgtcggactcgaactgtgggccgcggctcacgctcttcccgcacaggtcgcatttactccatatgcccccgaacccggaagtacttgtcgactacgggaatactatgatcagactgctcagatgtgctgttctaaatgctcacctggacagcatgcaaaagtgttctgtactaaaacttccgatacagtgtgtgactcatgtgaggactcaacatacacacagttatggaattgggtgcccgagtgcctttcatgcggatccaggtgctcatccgatcaggtggaaacgcaggcatgtacacgcgaacagaacagaatctgcacttgtcggcccgggtggtattgtgccctgtctaaacaagaaggatgccgactgtgcgcaccactccgaaaatgccgacccgggttcggggtagcaagacccggaacagaaacatctgacgtggtgtgtaaaccctgtgcccctgggacattctcaaacactacgtcttctactgatatatgcagaccccatcagatctgtaacgtcgtagccatccccgggaacgcttcaatggacgccgtgtgtacatcaacatcacccactcgctcaatggcccctggggctgtgcatctcccccagcctgtctctactagatctcagcacacacagccaactccagaaccctccacagccccatccactagtttccttttacccatggggccatccccacctgctgaagggtcaactggagacgaaccaaaatcatgtgataaaactcatacatgccccccctgccctgcccctgaactcctaggaggaccttctgttttcctgtttcctccaaaacccaaagatactttaatgatatcacgtactcccgaagtgacatgtgtggtggtagatgtgtcccatgaagatcctgaggtgaaatttaactggtatgtggatggggtggaagtgcataatgcaaagactaaacctcgcgaagaacagtacaattctacatacagagtcgtttcagttctaacagtcctgcaccaggattggctcaatgggaaagaatacaaatgtaaagtgagtaataaagccctccccgccccaattgaaaaaacaatatccaaggctaaaggacagcccagagagccccaggtctatacactgcctccttcccgggaagaaatgacaaaaaatcaggtctctcttacatgccttgtaaaaggattctacccctctgatatagctgtggaatgggaatctaacgggcagcctgaaaataactataaaactactccccccgtgctggattcagatggaagtttcttcctttactccaaactgacagtcgataaaagtcggtggcagcagggaaacgtcttttcctgctctgtcatgcacgaagcactccataatcactatactcagaagtcgctctcactttcccccggaaag

SEQ ID NO: 15495 - DNA, 1467 bp, Artificial Sequence
  Description of Artificial Sequence: Synthetic coding sequence
atggctccggtcgcggtgtgggctgcactggctgtggggctggaactgtgggccgctgcacatgcgttgccggctcaggtggccttcactccatacgcgcctgagcccggcagcacctgtcggctgcgagagtactacgaccaaactgcgcagatgtgctgttctaaatgctccccgggacaacacgctaaagtcttttgcactaagacctcagatactgtgtgcgacagctgcgaagattcgacttacacccagctctggaattgggtccctgagtgtctttcgtgcgggtcacgctgttccagcgaccaggtggagactcaagcctgtacgagagaacagaacaggatctgtacgtgcagaccggggtggtactgcgcgctctccaagcaagaaggatgccgcctttgcgcaccgctgcgcaagtgccgcccgggattcggagtggcccgcccaggtactgagacttccgacgttgtgtgtaaaccgtgcgcgcctggaaccttttcaaataccacgtcctcgaccgacatatgcaggccacatcagatctgcaacgtcgttgcgatcccgggtaatgcctcgatggacgcagtgtgtacgtcgacctcaccaaccagatctatggccccgggggcagtgcaccttccccagccagtgagcacccggtcccagcatacccagcctaccccggaaccttcgactgcgccctcgactagcttccttctgcctatgggaccatcacctccggcggaagggtccactggagatgaacctaagtcgtgcgataagacccatacctgccccccatgccctgccccggagctcctcggcggcccgtcggttttcctcttccctcctaaacctaaggacaccctgatgatttcgcgcaccccagaagtcacctgcgtggtggtggatgtgtcgcacgaggatccagaagtgaagtttaactggtatgtggacggggtcgaagtccacaatgccaagactaagccgagagaggaacagtacaactccacctaccgggtcgtgagcgtgctcactgtgctccaccaagactggctcaatggcaaagagtacaaatgcaaagtctccaacaaggctctgcctgccccgatcgaaaaaaccatctctaaggcgaagggacaaccacgggaacctcaggtctacaccctgcccccatcccgcgaagaaatgacgaagaaccaagtttcgctgacttgtcttgttaagggcttctacccctctgacattgccgtcgagtgggagtccaatgggcagccagagaacaactacaagaccactccgccagtgctggacagcgacggatcctttttcctgtattcaaagctgactgtggataaatcgcggtggcagcaaggaaacgtgttctcatgctccgtgatgcacgaggctctccacaaccactacacccaaaagagcctttccttgtcgccaggtaag

SEQ ID NO: 15496 - DNA, 1467 bp, Artificial Sequence
  Description of Artificial Sequence: Synthetic coding sequence
atggcccctgtggcagtctgggccgctttggctgtgggtctggagctttgggcagccgcccacgcgctgcccgcgcaagttgcattcaccccttacgcacccgaacctgggtcaacttgcagacttcgtgagtactacgatcaaactgcacaaatgtgttgctctaagtgttcaccaggccagcacgctaaagtgttttgtaccaagaccagcgatactgtatgtgattcttgcgaggattccacttacacccagctgtggaactgggttccagagtgtctttcatgcggatccagatgcagctcggatcaggtcgaaacccaagcatgcactagagagcagaacagaatttgtacctgcaggccaggatggtactgtgccctgtcaaaacaagaaggctgccggctttgtgcccctctgcggaaatgtcgacctggattcggcgtggctaggcctgggaccgaaactagcgatgtcgtgtgtaagccatgtgccccgggaactttttcgaatactacttcaagcactgatatctgtcggcctcatcaaatctgtaatgtggtggcaataccaggtaacgcatctatggatgcagtatgtacctctacgtccccaactagatccatggcccccggtgcggtgcatcttccacaacccgtctccactagatcccagcatactcagcctacccctgaaccttcaaccgcaccaagtacttcgtttctcctgccgatgggacctagcccaccggcagaaggaagcaccggtgacgaacccaagagctgcgacaagacgcacacttgtccaccttgccccgccccagagctgcttggtgggccaagcgttttcttgttcccacctaagccaaaggacaccttgatgattagccgtactcccgaagttacctgtgtggtggtcgacgtgagtcacgaggatcccgaagtgaagttcaattggtacgtcgacggagtcgaggtccacaacgctaaaactaagccaagggaggaacaatacaattcgacctaccgcgtcgtgtcagtgctcactgtgcttcatcaggattggctgaacggtaaggagtacaagtgcaaagtttccaacaaggcactccctgcacccattgaaaaaactataagcaaggccaagggacagccacgggagcctcaagtgtataccctcccaccaagccgcgaagaaatgaccaagaatcaagtgtcactgacctgccttgtgaagggcttctacccctcggacattgcagtggaatgggaatctaacggccagcctgaaaacaactacaagaccacccctcccgtcctggactccgatggaagttttttcctgtattccaaacttacggtggacaaatccaggtggcaacagggcaatgtgtttagctgttcggtgatgcatgaagcactgcataaccattacactcaaaagtcgctgtcactctcccccgggaag

SEQ ID NO: 15497 - DNA, 1467 bp, Artificial Sequence
  Description of Artificial Sequence: Synthetic coding sequence
atggcaccggtggcagtgtgggcagcgctggcagtcggactggaactgtgggctgcagcgcatgccctgccagctcaggttgcattcactccttacgccccagagcctggatcaacttgccggctgagggagtactacgatcaaaccgcgcagatgtgttgtagcaagtgttcacccggacagcatgcaaaggtcttttgtactaagacttccgatactgtgtgcgactcctgtgaagattccacctacactcaactctggaattgggtgcccgaatgcctctcctgtggatcgcgctgttcttctgatcaggtggaaacccaggcctgtactcgggaacaaaacagaatatgcacttgtagacctggatggtattgcgccctttcgaaacaagaaggctgtcgactgtgtgcaccgcttagaaaatgtcgcccaggcttcggagttgcgcggccgggaactgaaaccagcgatgtggtctgtaagccatgtgctcctggaactttttcgaataccacctcgtcaaccgacatttgcagacctcatcaaatctgcaacgtggtggcaattccaggaaacgcgagcatggatgcagtgtgtacctcgacttcgcccactcggtcaatggcacctggcgctgtccaccttcctcagcctgtctcgaccaggtcccagcacacccagcctacccctgaaccctcgactgcgccctcgacttccttcctgcttcctatgggaccttcgccacctgccgaaggatctacgggagacgaacctaagtcctgcgataagacccacacttgtccaccttgtcctgccccagaactccttggagggccaagcgtctttctttttcctcccaaaccaaaagatactctcatgatctcaaggacccccgaagtgacgtgtgtggtggtggatgtttcccatgaggatcctgaagtgaagttcaattggtatgttgatggagtggaggtgcataacgcaaagactaaaccacgcgaagaacaatacaatagcacgtaccgtgtggtttcggtgcttaccgtgcttcatcaagactggctgaacggcaaggagtacaagtgcaaggtgagcaacaaggccctgcccgcccctattgaaaagaccatcagtaaagcaaaaggacaaccccgagaacctcaagtctacactctgccgccatcccgggaggaaatgactaagaatcaagtctcccttacttgcctcgtcaaaggattctacccttccgacattgccgtggaatgggagagcaatggtcagccagagaacaattacaaaactactccaccagtgcttgacagtgatggcagcttctttctttacagcaagctgaccgttgacaagtccagatggcagcagggaaatgtgttttcgtgtagcgtgatgcacgaggcgctgcacaatcattacacgcagaaatcgctctccttgtcacccggcaaa

SEQ ID NO: 15498 - DNA, 1467 bp, Artificial Sequence
  Description of Artificial Sequence: Synthetic coding sequence
atggcaccagtcgcagtctgggccgcactggccgtcggattggagctctgggctgcggcgcatgcacttcctgcccaagtggcttttacgccctacgcaccagagccaggttccacctgtagactgcgggaatactacgaccagactgcgcaaatgtgttgtagcaagtgttcacctggacagcacgcaaaggtgttttgtactaagacttccgataccgtctgtgattcgtgtgaagattccacctacactcaactttggaactgggtgcctgaatgtctgtcgtgtggctcgcgatgtagttcagatcaggtggaaactcaggcctgcacccgcgaacagaatcgtatttgtacttgcagaccaggttggtactgtgccctcagcaagcaagaaggatgtaggctttgtgcacctctgagaaagtgtaggcctgggtttggcgtggcaagaccggggaccgaaacctcggacgttgtgtgtaaaccatgtgcacccggcacgttctcgaataccaccagctcgaccgatatttgtagaccgcaccaaatttgtaatgtggtggctatcccaggtaatgcctccatggacgcagtctgcacttcgacctcgccgacccgctccatggcgcctggcgcagtccatctgccacaaccagtctcgacccgatcacaacatacgcagccgactcctgaaccttccaccgccccatccacctcttttctcctgccaatgggaccctcccctcctgccgaagggtccacgggcgatgagccaaagtcgtgtgataaaacccacacctgtcctccgtgccccgccccagaacttctgggaggtccaagcgtgtttctgttcccaccaaaaccaaaagatacccttatgatttctcggacccctgaagtgacttgcgtggtcgtcgatgtgtcgcatgaagatcctgaggtcaaattcaactggtacgtcgatggagtcgaagtgcataatgcaaaaaccaaaccacgcgaagaacaatacaacagcacttatcgggtggtgagcgtgctgactgtcctccaccaagactggctcaacggtaaggaatacaagtgtaaagtttcgaacaaggcccttccagcccccatcgaaaagaccatcagcaaagccaaaggccagccaagagaaccacaggtctacacccttccacctagccgcgaagaaatgacgaaaaatcaagtgtccctgacctgcctcgtgaaggggttctacccgtcggacatcgcagtggagtgggagtccaacggtcaaccggaaaacaactacaagactaccccaccggtgctggacagcgacgggtcgtttttcttgtactcaaaacttaccgtggacaagtcgcgatggcagcaaggaaacgtcttttcatgttcagtgatgcatgaagcccttcacaatcactacacccagaagtcactttccctttctcccgggaag

SEQ ID NO: 15499 - DNA, 1467 bp, Artificial Sequence
  Description of Artificial Sequence: Synthetic coding sequence
atggccccagtggcagtgtgggcagctcttgcagtggggctggaactttgggccgccgcacacgcactgccagctcaagtggcgtttaccccttacgcacctgaacccggtagcacttgtagactccgagaatactacgatcagaccgcgcaaatgtgctgttcaaagtgctcgcccggccaacacgcaaaggtgttttgtactaagacgtcggataccgtctgtgattcgtgcgaagattccacctacactcaactttggaactgggtgccagagtgcttgagctgtggttcccgctgttcctcggatcaggtggaaacccaagcgtgtacccgtgagcaaaatcggatctgtacttgcagaccgggatggtactgtgcgctcagcaagcaagaaggatgtcgactctgcgctccacttcggaagtgcagacctggatttggtgtcgcacgacctggaacggaaacctctgacgtagtatgcaaaccttgtgccccgggcaccttctcgaacactactagttcaactgatatatgtaggccacatcaaatttgtaatgttgtcgcaatcccaggaaacgcttccatggatgcggtgtgtacttcgacttcgcctacccggtcgatggcgccaggcgcggtccacctgcctcagcctgtttccactcggagtcaacatacccagcctactccagagccatcaaccgcaccctccacgagctttcttctcccaatgggtccgagccctcccgccgagggctcgaccggtgatgaacccaaaagctgtgataagactcatacctgtcccccttgtcctgcacccgaactgttgggcggaccttcagtgtttctcttcccgccgaagcctaaagatactcttatgattagtcggactcctgaagtgacttgtgtggtggtggacgtgtcccatgaggacccagaagtgaagttcaattggtacgtggacggagtggaggtccataacgcaaaaaccaaacctagggaagaacagtacaactcgacgtaccgggtggtgagcgtgcttactgtgctgcaccaggattggctcaatggaaaagagtataagtgcaaggtgagcaataaggccctgccagcgcctattgagaaaaccattagcaaggcgaaaggacagcctagggaacctcaggtgtataccctgcccccctcacgcgaagaaatgactaagaaccaagtctcccttacttgccttgtgaagggattttacccgtcagatattgccgtcgaatgggaatcgaatgggcagccagagaacaactacaagacgactccgcctgttcttgactccgatggatcgttttttctttactccaagctgactgtcgacaaaagcaggtggcagcagggaaacgtcttttcgtgcagcgtcatgcatgaggcgctgcacaaccattacacccagaaatcgctcagcctttccccaggaaag

SEQ ID NO: 15500 - DNA, 1467 bp, Artificial Sequence
  Description of Artificial Sequence: Synthetic coding sequence
atggcgcctgtcgccgtgtgggcggccctggccgtggggctggagctgtgggcagccgcacacgcattacctgcccaggtcgccttcacaccttacgctccagaacctggctcgacttgtcgcctcagggagtactacgatcaaactgcccagatgtgttgctccaagtgttctccgggccagcatgcaaaagtgttttgcacaaaaacatccgatactgtttgtgattcttgcgaagattctacctacacccaactgtggaactgggtcccagaatgtttgtcctgtggaagccgctgctcctcagaccaggtcgagacacaggcctgcacccgggagcaaaatagaatttgcacgtgtagacctggatggtattgcgccctttcaaaacaggagggctgtcgtttgtgcgcacccctcaggaagtgtagaccgggttttggtgtggcccggccaggaactgagacttccgatgttgtctgcaaaccatgtgctccagggacattttccaatacaacatcctccactgatatctgccgaccacaccagatttgcaacgtcgtggctatcccagggaacgcttcaatggatgctgtatgtacgtcgacatctcccactcgctccatggcccccggcgcagtgcatctgcctcagcctgtgagtacccggagccaacatactcagcccactcctgagccctcaaccgcgccatctacctcatttttgctgcccatgggcccctcaccacccgccgaaggaagtacgggcgacgagcccaaaagttgcgataagacacacacctgccctccttgcccggcccccgaattattggggggaccctcagttttcctattcccccccaagccaaaagatacactgatgatatcccgcactccggaagtgacttgtgttgttgttgatgttagccatgaggatcctgaggttaagttcaattggtatgtagatggagtcgaggtccataacgccaagaccaaaccacgggaggagcagtacaattccacctacagagtcgtgtctgtcctcactgtgctgcaccaggattggctgaatggtaaggagtataaatgcaaagtctctaataaagcccttcctgctcccatagaaaaaacgataagcaaggccaaagggcaaccccgtgagccacaggtgtacacactgcctccgagcagggaggagatgactaagaaccaggtgagtctgacctgtctggtgaagggcttctacccctccgacatagcggtggaatgggagagcaatgggcagccagagaacaactataagacgactcccccagtgctggactctgatggatccttttttttgtattccaaactcacggtagataagtcgaggtggcagcagggcaatgtgttcagctgcagcgtgatgcacgaggcgctccacaaccattatacgcaaaagtctctgtccctcagccctgggaaa

SEQ ID NO: 15501 - DNA, 1467 bp, Artificial Sequence
  Description of Artificial Sequence: Synthetic coding sequence
atggctccagtggccgtgtgggctgcactggctgttgggctcgaactgtgggcggcagctcatgctctgccagctcaagtcgcgtttaccccatatgctccggaaccagggtccacatgtaggctacgggagtattacgatcagacagcccagatgtgctgctccaagtgcagcccaggacaacatgccaaggtgttctgtacgaaaacatccgataccgtttgcgattcctgtgaggattctacctacacccagctgtggaattgggtaccagagtgtctttcttgcggcagcaggtgctcttcagatcaggtggaaacgcaggcgtgcacacgcgagcagaatcggatatgcacctgtagacctggatggtactgtgccctaagcaagcaagaagggtgcagactgtgcgcacccctacggaagtgcaggcctgggttcggagtggccagaccgggaacagagaccagcgatgtggtgtgtaagccctgtgcccctgggacattcagcaatacaaccagctcaactgacatatgccggccacatcagatctgtaatgtggtggcaatccctgggaatgcctccatggacgcagtgtgtacgtctactagccctactagaagcatggctcccggggccgtgcatttgcctcaacccgtgagtacacggtcccaacacacccagcccactcccgaaccaagtaccgctccatctacctctttcttactgcccatgggtccctctcccccagctgaaggctccaccggcgacgaaccgaagtcctgtgataaaacccatacctgccctccatgcccagcacccgagctgttgggaggtcccagcgttttccttttccctccaaaacctaaagacacattgatgataagtcggacacccgaggtgacctgcgtggtcgtcgatgtgagtcacgaggaccccgaggtgaagtttaattggtacgttgacggagtcgaagtccataatgctaaaaccaagccacgggaagagcaatataactctacctatagagtggtcagcgtactaacagtgctccaccaggactggctgaacggtaaggagtataagtgcaaagtatcaaataaggcactacccgcccctattgagaagaccatctcaaaagccaaaggccagccaagggagccccaggtttatactctccctccttctagggaggagatgacaaagaaccaggtgtccctgacatgcctcgtgaaggggttttatccttcggacattgccgtggagtgggaatcgaatgggcagcccgaaaacaattataaaacgaccccacccgtgctggatagtgacggaagcttctttctgtattccaaacttactgtggataagtccaggtggcaacaagggaacgttttcagctgcagtgtcatgcatgaagcccttcataatcattacacccagaagagtctgtcgctgagtcccggaaaa

SEQ ID NO: 15502 - DNA, 1467 bp, Artificial Sequence
  Description of Artificial Sequence: Synthetic coding sequence
atggcacccgtagccgtctgggccgccttggctgtcggacttgaactttgggccgctgcgcacgctctgcccgcccaggtggcgttcacaccttacgcccctgagcccggctctacctgtcgcctgcgagaatactacgaccaaacagctcagatgtgctgctcaaaatgcagccctgggcagcacgcgaaagtcttctgcacaaaaacatctgatactgtgtgtgactcctgcgaggactctacatatacccagctctggaactgggtccctgagtgtttgagctgcggctctaggtgcagctccgaccaggtggaaacccaggcctgcacgagggagcagaataggatttgtacctgtcggcccggatggtattgcgccctatcaaaacaggaggggtgtaggctgtgcgcaccgctccgtaagtgtcgacctggattcggagttgctaggccaggcaccgagacctcagacgtagtgtgcaaaccttgtgcccccggcacgttttctaacacgaccagcagcaccgacatttgccggcctcatcaaatctgtaatgttgtcgccatcccgggcaacgctagcatggatgccgtctgcacaagtacctccccaacacgatcaatggcccccggcgccgtgcaccttccccagcctgttagtactcgaagccaacacacacagccaacgccagagccatctacagctcccagtactagcttcctgttgcctatgggaccctctccacctgccgagggaagcactggcgatgaaccaaagtcttgtgataaaacccacacttgcccaccttgccccgctcctgaactcctaggcggacccagtgtgttcttgttcccccccaaaccaaaagatacactgatgattagccgaacgccggaagtgacctgcgtggtggtggacgttagtcacgaggatcctgaggtgaagtttaattggtatgtagatggcgttgaagtgcacaatgctaaaactaagcctagagaggaacagtataattccacctatcgggtcgtgagtgtcctgaccgtcctgcaccaagactggttaaacggaaaggaatataaatgcaaagtgtccaacaaggccttacctgcccccatcgaaaagacaattagtaaagctaagggacagccgcgagagccacaggtgtacacattacccccctctcgagaagaaatgactaagaatcaggtatctctgacatgcttagtcaaaggcttctacccttccgacatcgccgtggagtgggaatctaatggccagcccgagaacaactataagaccactccgcccgttcttgatagcgacggtagcttcttcctgtattctaagctaacggtggacaagtcaaggtggcagcaggggaacgtgtttagctgtagcgtgatgcatgaggccctgcacaatcattatacccaaaaatcactgtctcttagccccgggaaa

SEQ ID NO: 15503 - DNA, 1467 bp, Artificial Sequence
  Description of Artificial Sequence: Synthetic coding sequence
atggctccagttgctgtttgggccgccctggctgtggggttggagctctgggctgctgcccacgccttgcctgcacaagtcgcatttactccgtacgctcctgaaccaggatccacctgcagacttagagaatattacgaccagactgcacagatgtgctgcagcaaatgcagtccaggacagcatgctaaagtcttctgcaccaagacttcagatacagtctgtgacagctgcgaagactcaacctatacacaactgtggaattgggtaccagagtgcctgtcttgtggttctaggtgcagctctgatcaggtcgaaacccaagcttgcacaagagagcagaaccggatatgcacctgccggcctggatggtactgcgctctgtctaaacaagagggctgtaggctttgtgcacctcttagaaagtgcaggcccgggtttggagtggcaagaccaggcaccgagacatccgacgtagtatgcaagccttgcgccccagggactttctctaacactacgtcatcaaccgatatctgtagaccacatcaaatttgcaacgtcgtcgctatccctggcaacgccagcatggacgctgtgtgcacatcaacgtcccctactcgatctatggctccaggcgctgtccatctaccacaacctgtctccacccggtctcagcatacacaaccaaccccagaaccaagcactgcaccttcaacaagttttttgttgcctatgggcccgagccccccagccgaaggctctacaggtgatgagcccaagagctgcgacaaaacccacacctgccccccctgtccagcccccgaactgctcggcggcccttctgtcttcctgttcccccctaaacccaaagacacactcatgatctcacgtacacccgaggtgacttgtgtcgtggtggacgtgagccacgaagaccccgaggttaaattcaactggtacgtagacggagtggaggttcacaacgcaaagacaaaaccacgcgaggagcaatacaatagcacatatagagtcgtcagcgtgttgacagtgctccaccaagactggctgaacggtaaggagtacaagtgcaaagtctctaacaaggccctgcccgcacccatcgagaaaaccataagtaaggccaaagggcagcctagagaaccccaagtttacactttacccccctcacgagaagaaatgactaaaaaccaggtttcattgacttgcctcgtgaaaggattctatcccagtgatatcgccgtggaatgggagagcaatggtcaacccgagaataactacaagaccacacctccagtcttggacagcgatgggagttttttcctttattctaagctcacagtggacaaatccagatggcaacagggcaacgtgttctcatgcagcgtgatgcacgaggccctgcataaccactacactcagaaatctctgagcctgagtcccggcaag

SEQ ID NO: 15504 - DNA, 1467 bp, Artificial Sequence
  Description of Artificial Sequence: Synthetic coding sequence
atggcacctgtcgcggtgtgggccgcacttgcagtcggacttgagctttgggcggcagcacatgcacttcctgcgcaagtcgcttttactccttacgcgcctgaaccagggtccacttgtcggctgagggagtactacgaccagacggcccaaatgtgctgttccaagtgttcccctggccagcatgcaaaagtgttctgcaccaagacctccgataccgtgtgcgactcgtgcgaagattcgacttacacgcagttgtggaattgggtgccagaatgcctctcttgtggaagccgctgctcaagcgaccaggtcgaaactcaggcatgtactcgtgaacaaaacagaatttgtacttgtcggccgggttggtactgcgcactttccaaacaggagggttgtcgactctgtgctcctcttcggaagtgtagacccggttttggagtggcaagacctgggactgaaaccagcgatgtggtctgtaagccttgtgcacctggaacgttctcaaacaccacttcgtcgaccgatatctgccgaccacaccaaatttgcaacgtggtggcaatcccaggaaatgcaagcatggatgccgtgtgtacttcgacgtcaccgactagatcgatggcgcccggagccgtccatctgcctcagccggtgtcaactcggtcacaacatacccagcccactcctgaaccttcgactgcaccctcaacgtcattcctgctgcctatggggccatcaccccctgccgaaggctccaccggcgatgaacccaagtcctgcgacaagacgcatacttgccccccatgtcccgcacctgaactccttgggggtccctcagttttcctgtttccacccaagcctaaagataccctgatgatttcgaggacgcctgaagtgacgtgtgtcgtggtcgatgtgtcccacgaagatcccgaagtgaagttcaactggtatgtggatggagtggaggtccacaatgctaagaccaagcctagagaagaacagtacaactctacctatcgcgtggtgtccgtgctcacggtgttgcaccaggattggcttaacggcaaggaatacaagtgtaaagtctccaacaaggcactgccagcaccaatcgagaaaaccatttccaaggcaaagggccagcctagagaaccacaagtgtacactctgccgccttcacgcgaggagatgacgaaaaaccaagtgagcctgacctgtctggtcaagggcttttaccctagcgatatcgccgtcgaatgggagagcaacggacaaccggagaacaattacaagactactccaccagtgctggactcagatggctcgtttttcctttactccaaactgaccgtggacaaatcccggtggcaacaaggaaatgtgttttcgtgctctgtcatgcatgaggcccttcacaatcattatacgcaaaagtcgctctcgcttagcccgggaaag

SEQ ID NO: 15505 - DNA, 1467 bp, Artificial Sequence
  Description of Artificial Sequence: Synthetic coding sequence
atggctccggtggccgtctgggctgctctggccgtgggtctggagttatgggcagctgctcatgcattacccgcccaggtggcttttacgccctacgcccccgaacctggaagtacatgtcggctacgcgaatattacgaccagaccgcccagatgtgctgtagcaaatgttctcctggacagcatgccaaggtgttctgcaccaagacatccgatactgtttgtgacagttgtgaagacagcacctatactcagctgtggaactgggtgcccgagtgtctgagctgtggcagtaggtgttccagtgatcaggtggaaacgcaggcctgtactagggagcagaatagaatttgcacatgtcggcccggttggtactgcgcattgagtaagcaggagggatgtaggttgtgcgctcccctgaggaagtgccggcctggctttggagtggccaggcctggcacagaaacctctgacgttgtctgcaaaccatgcgcccccgggacgttctctaatactacgtcaagcaccgatatctgtcggccacaccaaatatgtaacgtcgttgcaatccctgggaatgcgtctatggatgctgtctgtacatcaacgtctcccacgaggagtatggcacctggggctgttcacctgccccaaccggtgtccacccgatctcagcacacacagccgacccccgaaccaagcaccgctccgtctacctcttttctgctgccaatgggcccctcacccccagccgagggaagtaccggcgacgagcctaagtcttgcgataaaactcatacttgtccaccatgtccagcaccggaactcctggggggcccctcagtcttcttattcccgcccaagccgaaagacactttgatgatatctcggacacccgaagttacctgcgtagtggtggacgtgagccacgaagatccagaagtcaagttcaattggtacgtggatggggtggaagtccacaatgccaagaccaagcccagagaagagcagtataattcaacttaccgggttgtctccgtgttaacagtgttgcaccaggactggctcaatgggaaggagtacaaatgcaaggtgtctaataaggccttacctgctcccatcgagaagacgatttcgaaagcaaaaggtcagcctcgggagccccaggtgtacaccttgccaccatcccgggaagagatgactaagaaccaagtgtcattaacttgtctcgtaaagggtttctacccttctgacattgcggtagaatgggagagcaacggccagccggaaaacaattacaagaccacacctccggttcttgacagcgatggctccttctttctttatagcaagctgactgtggacaagtctcgttggcagcagggaaatgtgttttcttgctcagtgatgcacgaagcgcttcataaccattatacccagaaaagcctctcattgtcccctggaaag

SEQ ID NO: 15506 - DNA, 1467 bp, Artificial Sequence
  Description of Artificial Sequence: Synthetic coding sequence
atggcccctgtggctgtgtgggctgccctggcagtggggctcgagttgtgggccgccgcccatgccctgcccgcacaggtcgccttcaccccatacgcacctgaacctggcagtacatgccgactacgcgaatattatgatcagacggcgcagatgtgctgtagcaagtgctcgcccgggcagcacgccaaagttttctgtactaagacatctgatactgtctgtgactcctgtgaggacagtacctacactcagctatggaactgggtccctgaatgtctgagttgtggcagccggtgttcgtcagatcaagttgagacccaagcgtgcactagagagcagaacaggatctgcacttgtaggccggggtggtattgcgcactgagcaagcaagaaggatgccggctttgcgcgccccttcgaaaatgtcggccagggttcggagtggcacgacccggcaccgaaacatctgacgtggtctgtaaaccatgcgcgcccggcacatttagtaataccacaagttccaccgacatttgccggcctcaccaaatctgtaacgtcgttgccatccctggcaatgcctctatggatgcggtctgcacatctaccagcccgaccaggtcgatggctcctggggcagttcacctgccgcagccagtgagcactcgctcccagcatactcagccgacgcccgagccttccaccgccccctctaccagttttctactgcctatgggtccctccccgcccgcagaaggcagcacaggagacgaacctaagagctgcgataaaacccatacatgtcccccatgccctgcgccagaactgcttggcggcccatctgtctttctgttcccacccaagccaaaggacaccttgatgatttcccggactcccgaggtgacatgtgttgtggtcgacgtctctcacgaagatcctgaagtcaaatttaactggtacgtggacggcgttgaagttcacaacgccaagacaaagccaagggaggagcagtataattctacgtacagagtagtaagtgtgcttactgtcctccaccaggattggctgaacggtaaggaatataaatgcaaggtctctaataaagccctgcccgcccctatcgagaaaactatttccaaagccaagggccaaccccgagaaccccaggtctatacactcccacccagccgggaagagatgaccaagaatcaggtctcattgacttgtctggtgaaggggttctatccgagcgatattgctgtggagtgggaatcgaacgggcaacctgaaaacaactataagacaactcctcccgtactggattcagatgggtcattttttctgtactctaagctcacagtcgataagtctaggtggcagcaaggcaatgtattttcatgttccgtgatgcatgaggccctccataaccattatacacaaaagtcactgagtttatcccccggaaaa

SEQ ID NO: 15507 - DNA, 1467 bp, Artificial Sequence
  Description of Artificial Sequence: Synthetic coding sequence
atggccccggtcgctgtgtgggcagcgctcgctgtggggctcgagctctgggccgcggctcacgcgctgcctgcccaagtggcattcaccccatatgctccggaacctggcagcacttgccgcctgagagaatactacgaccaaaccgcacagatgtgctgctcgaagtgctcaccaggccagcacgcgaaggtcttttgtaccaagacctcagacaccgtgtgtgattcgtgcgaagattccacgtacactcagctgtggaattgggtgccggagtgcctctcctgtggaagtcgatgctcatcagaccaggttgaaacccaagcctgcaccagagagcaaaaccggatctgcacctgccgccctggatggtactgtgctttgtcgaagcaggagggatgccgcctctgcgccccactgaggaagtgccgtccaggattcggggtggcacgcccaggaaccgagactagcgacgtcgtctgtaagccctgcgccccaggaactttctccaataccacttcctcgacggacatctgccggccacaccagatttgcaacgtggttgctataccgggaaacgccagcatggatgccgtgtgtacctccactagtccgaccagatcgatggcacctggcgcggtccatctgccacagccggtgagtacgagaagccaacatacgcagccgacgcccgagccatcgaccgccccgtcgacttctttcctgcttcctatgggaccaagcccacctgctgaaggttcgactggagacgaacccaaatcatgtgataagacgcacacctgccccccgtgccccgcccctgaactcctgggcggaccgtcagtgtttctgttccccccaaaacctaaggacaccctgatgatcagccggactccggaggtgacttgcgtggtggtggatgtgtcacatgaggatccggaagtgaaattcaactggtacgtcgacggggtcgaagtgcataatgccaagaccaagccccgggaggagcaatacaattcaacctaccgtgtagtgtccgtattgactgtgttgcaccaggattggctcaacggcaaagagtacaagtgcaaagtgagcaataaggccctgccggcgcccatcgaaaaaactatctcgaaggcaaaaggacagcctcgcgaaccccaggtgtatactctgccaccgtcacgcgaagagatgacgaaaaaccaagtcagcctcacttgcctggtcaaggggttctacccttcggacatcgctgtcgaatgggagtcgaacgggcagccggaaaacaactacaagaccactccacccgtgctggactccgacggatcattctttctttacagcaagctcaccgtcgataagtcccggtggcaacagggaaacgtgttctcctgtagtgtgatgcacgaggcacttcacaatcattacacccaaaaatccctgtcgctgagcccgggaaag

SEQ ID NO: 15508 - DNA, 1467 bp, Artificial Sequence
  Description of Artificial Sequence: Synthetic coding sequence
atggctcctgtggctgtttgggcggcacttgcagtgggccttgaactctgggcggcagctcatgcacttcctgcccaagtggcattcactccttacgcaccagaacctggctcaacctgtcggctgcgcgaatactacgaccagaccgcccaaatgtgttgttccaagtgttcacccggtcagcatgcaaaagtgttctgcactaagacctccgataccgtctgtgattcgtgtgaggactcgacctacacccagctgtggaattgggttcctgaatgtctgtcgtgtgggtcccgttgttcatccgatcaggtcgaaactcaggcatgcactagggagcagaatagaatttgcacttgtcggcccggatggtactgtgcactgagcaagcaagagggatgtcggctgtgcgctcctctgagaaaatgcaggcctgggtttggagtcgcacggcctggtactgagacttcagatgtggtgtgtaagccgtgcgccccgggaaccttttccaacaccactagctccaccgacatttgtcgccctcatcagatttgcaatgtggtggcaatccctggtaacgcctcgatggacgctgtgtgcacctcaacctcgccaactagatcaatggcccctggtgctgtgcacctgccacagcctgtgtccaccagatcccagcacactcagccgaccccagaaccttccactgccccatccacgtcctttctccttccaatgggtccttcacctcctgccgagggaagcactggggatgagcccaagtcgtgtgataagacgcacacttgtcctccatgcccggcgcctgaactccttgggggaccttctgtctttcttttccctcctaagccaaaggatacgctcatgatctcgaggacccctgaggtgacttgtgtggtcgtggacgtcagccacgaagatcctgaagtcaagttcaactggtacgtggacggggtcgaggtccataacgccaagactaagccacgcgaggaacagtacaacagcacttacagagtcgtcagcgtccttacggtgctgcatcaagactggctgaacggaaaagaatacaaatgtaaggtgtcaaataaggcactgccagcacctattgaaaagaccatctcaaaggcaaaaggtcagcctcgagaacctcaagtgtacactctgccaccaagcagagaggagatgactaagaaccaagtgtcgctcacttgtcttgtcaaggggttttacccatccgacatcgccgtcgaatgggaatccaacggacaacccgagaataactacaagactactccccctgtgctggatagcgatggttcattcttcctgtactcgaagctgaccgtggataaaagcaggtggcagcaaggtaatgtcttttcatgctccgtgatgcatgaagcgctgcacaatcactacactcaaaagagcctctccctttctcccggtaag

SEQ ID NO: 15509 - DNA, 1467 bp, Artificial Sequence
  Description of Artificial Sequence: Synthetic coding sequence
atggcaccagtggcggtgtgggcagcgctcgccgtcggactcgaactgtgggcggcggcacacgcccttccggctcaagtcgctttcacgccgtatgccccggagccgggctcgacttgtcggctgcgggaatactacgaccagaccgcccagatgtgctgctcgaagtgctcaccaggacagcatgcaaaggtgttctgcaccaagacctccgacactgtgtgcgacagctgcgaggattcaacctatacccagctctggaattgggtgccggagtgcctgtcctgtggatcgaggtgttcctccgaccaggtcgaaacgcaggcctgcacgagagaacaaaaccggatctgcacttgccgaccgggctggtactgcgccctgagcaagcaggaagggtgcagattgtgcgcacctctgagaaagtgcaggcccggattcggggtggcacggcccggaactgaaacttcggacgtcgtgtgtaagccatgcgctccgggcaccttctcaaacactacttcgagcaccgacatctgccgaccccatcaaatctgcaacgtggtggcaattccgggcaatgcttcgatggatgccgtgtgcacttctacttctccgaccagaagcatggctccgggagccgtgcacctgcctcaaccagtgagcacccgcagtcagcatactcaacctaccccggagcccagcaccgccccatccacttcgttcctgctgccgatgggtccaagcccgcccgcggaaggttcaacgggagatgaaccgaagtcctgcgataaaacccatacctgcccgccctgtcctgccccggagttgctggggggcccatctgtgttcctgttcccgccaaagccaaaggacactctgatgatctcgcgaaccccggaggtgacttgtgtagtcgtcgacgtgtcgcacgaggacccagaggtcaaattcaattggtacgtggacggagtggaagtgcacaatgccaagacgaagccgcgcgaggaacagtacaactctacttaccgggtcgtgtccgttttgaccgtgctgcatcaggactggctcaatgggaaagagtacaaatgtaaggtgtcaaataaggccctgccggcccccatcgagaaaaccatcagcaaggccaagggacagccgagagaaccacaggtgtacacgctcccaccttcccgcgaagaaatgaccaaaaaccaggtgtcactgacctgcctggtcaagggcttctacccttcggacattgccgtcgaatgggaatcaaacggacagccagagaacaactacaagactactccgccggtgctcgactcggatggtagcttcttcttgtacagcaagctgactgtcgacaaaagccggtggcagcagggtaacgttttttcgtgttccgtgatgcacgaagccctccacaatcactacacccagaagtccctgtccctgagccctggaaag

SEQ ID NO: 15510 - DNA, 1467 bp, Artificial Sequence
  Description of Artificial Sequence: Synthetic coding sequence
atggccccagtggccgtctgggccgctctagctgtgggtctggagttatgggcagccgcccacgccctgcctgcccaggtggctttcactccctatgcgccagagcccggtagcacttgccggttgcgggaatattatgaccagactgcacagatgtgttgcagtaagtgttccccgggtcagcacgccaaggtattctgcacgaagacgtccgatacggtgtgcgatagttgtgaggatagtacctacactcagttgtggaattgggtcccagagtgcttgtcctgtgggtcccgctgctcctccgaccaggtggagactcaagcatgcacgcgggaacagaatcggatttgcacctgtcgtcctgggtggtactgtgctctctctaagcaagaaggctgtcgcctttgcgctccacttcgaaagtgtagaccaggcttcggagtggctaggcccggcaccgagactagcgacgtggtgtgtaaaccctgtgcccccggcacattttccaatactacctcttccacagacatatgtaggccacatcagatatgtaacgtggtggctatccccggaaatgctagcatggacgccgtgtgtacaagcacgtctcccacccgttccatggcccccggcgccgtccacttgcctcagcccgtgtccacccgttctcagcatacacagccgacccccgagccatccacggcaccttccacctctttcctgctaccaatgggcccatccccaccagccgaagggtcaaccggcgacgaaccgaagagctgtgataagacacacacctgtcctccctgcccagcaccagaactgctggggggaccgtcggtattcttgttcccccccaagcccaaagacacgctgatgatttcccgcaccccagaagtcacctgtgttgttgttgacgtgtctcacgaggatccagaggtgaaattcaattggtatgtcgatggagtcgaggtgcacaatgctaagactaagcctcgggaggaacaatataactctacataccgggtggttagcgtgttgaccgtcctgcatcaagattggttgaatgggaaggaatataagtgtaaagtatcaaacaaagccttgcctgcccctattgagaaaaccatatctaaggcaaagggccagcctcgcgagccacaggtgtacacacttccaccctcccgggaggagatgaccaagaaccaggtgagcctgacttgtctcgtcaagggtttctatccaagtgacatcgcggtcgagtgggaatccaacggccaacctgagaacaactacaaaaccacaccccccgtcctggattcagacggttccttcttcctgtactccaagctgactgtcgataaaagccgctggcagcaaggtaatgtgttctcttgctctgttatgcacgaggctctacacaatcactacacacaaaaaagtttgtcactctctcctggcaag

SEQ ID NO: 15511 - DNA, 1467 bp, Artificial Sequence
  Description of Artificial Sequence: Synthetic coding sequence
atggcccccgtggcggtgtgggcagcgctggccgtgggattggagctgtgggctgccgcccacgcgctgccagcccaggtcgcattcactccctacgcaccagagccaggatcaacgtgccggctgcgcgaatactacgatcagacggcccagatgtgctgctcaaaatgctcgcctggacagcacgccaaggtcttttgtaccaagacttctgataccgtctgcgactcttgcgaagatagtacctacacgcaactctggaattgggtccccgagtgtcttagctgcggaagcagatgctcatcagaccaggtggaaacccaggcctgcacgagagagcagaaccgcatctgcacttgtcgcccgggctggtattgcgccctgtcgaaacaggaaggatgccggctgtgcgctcccttgcggaagtgtcgcccgggatttggcgtcgcccgccctggaactgaaaccagcgatgtcgtgtgcaagccgtgtgctcctggaaccttttccaacactacctcctccactgacatctgccgcccgcaccagatctgcaatgtggtggccattccggggaatgcatccatggacgccgtgtgtacttccacctcccctactcggtcgatggcacctggtgcggtgcacctcccacaaccggttagcacccgaagccagcacactcagcccacgccagagccgtcaacggccccgtccacctccttcctcttgcctatgggaccgagcccaccggcggagggcagcacgggagacgagccaaagtcatgcgacaagacccatacctgtccgccatgtccggcacctgaactgctgggcggcccgtcggtgtttctgttcccgccgaaacctaaagacaccttgatgatctcgagaaccccagaagtgacttgtgtggtggtggatgtctcccatgaggatccagaggtgaaattcaactggtacgtcgatggggtcgaagtgcataacgcaaaaactaagccccgcgaagagcaatacaactcaacttaccgggtggtcagcgtgctgacggtgctgcaccaggattggctcaatggcaaggaatacaagtgtaaagtgtcgaacaaggcattgcctgcgccgattgagaaaactatctcgaaagcgaagggccaaccgcgagagccgcaagtgtataccctgccaccttcccgggaggagatgaccaaaaaccaagtgtcactgacctgtcttgtcaagggcttttacccgtcagacatcgcggtggaatgggagtccaatggacaaccggaaaacaactacaaaaccacgcctccggtgctggacagcgacggtagcttctttctgtacagcaagctcactgtcgacaagtcccgctggcaacaggggaacgtgtttagctgctccgttatgcacgaagcgctgcataaccattacacccagaaatcgctgtcactcagtccgggaaaa

SEQ ID NO: 15512 - DNA, 1467 bp, Artificial Sequence
  Description of Artificial Sequence: Synthetic coding sequence
atggcaccagtagccgtctgggcggctctggccgtggggctggagctttgggcggcggctcacgccctgccagcacaagtcgccttcacgccctacgccccggagccgggatcgacctgccggctcagagaatactacgaccaaactgcgcagatgtgctgctcaaaatgctcgcctggacagcacgccaaggtcttttgcactaagacttccgacactgtgtgtgactcatgcgaggacagcacctacactcagctgtggaactgggtgccagaatgcctgtcatgtggaagtcgctgttcgtccgatcaggtggagacgcaggcttgtaccagagagcaaaatcgcatctgcacctgcaggccggggtggtactgtgccttgtccaagcaagagggatgccggctctgcgcgccgctccgtaaatgccggccgggctttggcgttgcacgccctggaacggaaactagcgacgtggtctgcaagccgtgcgcccctggaactttcagcaacaccacctcaagcaccgatatctgccgcccgcaccagatctgtaatgtcgtggccatcccaggaaacgcttctatggacgcggtgtgcacgtcgacttcacccacccggtccatggcaccgggagcagtgcacctgccccaaccggtgtcaacccgaagccaacacactcagccaaccccggaaccatcaactgccccttccacctcattcctgctgcccatgggaccttcgccgcctgcggaagggtccaccggtgatgaacctaagagctgcgataaaacccatacctgcccaccgtgcccagccccggagctcctgggcggaccttccgtgtttctcttccctccaaagccgaaggatactctcatgatttcgagaacgccggaagtcacctgtgtggttgtggatgtatcgcacgaggacccggaagtaaagttcaactggtacgtggatggcgtcgaagtgcacaacgcaaagactaagccacgcgaagaacaatacaattctacttaccgggtggtgtcggtactgaccgtgctgcatcaggactggctgaatggtaaggagtacaaatgcaaggtgtccaacaaggctttgcccgcccccatcgaaaagactatttcgaaggcaaaaggacaaccgagagagccgcaggtctataccctgccaccgtcccgcgaagaaatgaccaaaaatcaggtgtctcttacttgtcttgttaaggggttctacccatcggatatcgctgtggaatgggaatccaacggtcagcccgagaacaattacaagaccacgccaccggtcttggactccgacggctcgttcttcctctatagcaagctgacggtcgacaaaagcaggtggcagcagggcaacgtctttagctgctcggtgatgcatgaagctctccataaccattacactcagaaatcattgagcctgagtccgggaaag

SEQ ID NO: 15513 - DNA, 1467 bp, Artificial Sequence
  Description of Artificial Sequence: Synthetic coding sequence
atggctcccgtagctgtatgggcggccttggctgtcggccttgagctgtgggccgccgcccacgccttgccggcccaggtggcctttaccccctacgccccagaaccaggcagcacatgtagactcagggaatattacgatcagacggcccaaatgtgttgcagtaagtgctcccctggtcaacacgctaaagtcttttgtaccaagacctccgacacagtttgtgattcctgtgaagactccacctatacccagttgtggaattgggtcccagagtgcctgagctgcggttctcgatgcagttcagatcaggttgagactcaggcgtgcacgagagagcagaatcggatctgcacatgccgacccggctggtactgtgcgctttctaagcaggagggatgcagactgtgcgcaccattgcgcaagtgcaggcctggatttggtgtggcccggcccggtactgagacatccgatgtggtatgcaagccctgcgctcctggcacattctctaatactaccagttccacagacatctgcagacctcaccagatctgtaacgtggtggctattccgggtaatgcctccatggatgccgtgtgcacgtcaacgtcccccacgcggtctatggcccccggcgcggtacacctccctcagcccgtctccaccaggtcccagcacacacaacccactccagagccatctactgctccaagtaccagttttttgctgccgatgggaccttctccaccagccgaagggagcaccggagacgaaccaaagtcatgtgataagactcacacctgtcccccctgtcctgctccggaactgctggggggtcccagcgtgtttttgtttccacctaagcccaaggatacactgatgatatccagaacccctgaggtgacctgtgtggtggttgacgttagtcacgaggaccccgaggtaaagtttaactggtatgtggatggtgtggaagtgcataacgccaagaccaagcccagggaggagcagtataacagtacctaccgagtggtctctgtactgacagtcctgcatcaagactggttgaatggaaaggagtataaatgtaaggtcagtaacaaggctcttccagcacccattgagaagacgatcagcaaagcgaaagggcagcccagggagccccaagtatacactctgcctccaagcagggaggagatgactaagaaccaagtgtccctcacatgcttggtaaaggggttctaccctagtgacattgccgtcgaatgggaatctaacggtcagcccgagaataattacaaaactaccccgcccgttctggacagcgatggcagtttcttcctgtacagtaagctcactgtcgacaaatcaaggtggcaacaaggcaacgttttttcttgctcagttatgcatgaggctcttcataatcattacacacaaaaatcactgtccctttctcctgggaag

SEQ ID NO: 15514 - DNA, 1467 bp, Artificial Sequence
  Description of Artificial Sequence: Synthetic coding sequence
atggctcctgtcgcagtttgggcggctcttgcggtggggctcgagctgtgggcggcggcgcacgcgctgcctgcgcaagtggcattcaccccatacgccccggagccgggcagcacctgccgtctccgcgaatactacgaccaaaccgctcagatgtgctgctctaagtgctcgccaggccagcacgcaaaagtgttctgcaccaagaccagcgataccgtttgcgactcatgcgaggactccacctatacccaactgtggaactgggtcccggagtgcctgagctgcggatccagatgctcatcggaccaggtggaaactcaggcgtgcactcgcgaacagaaccggatatgtacctgtagaccgggatggtactgtgcgctctcgaaacaagaaggctgccggttgtgcgccccgctgcggaagtgtaggcctgggtttggcgtggcccggcctggaaccgaaacctcagacgtcgtgtgcaaaccgtgtgccccaggaaccttctccaacaccacctcatcaacggacatctgccgcccccaccaaatttgcaatgtggttgccatcccgggcaacgcttcgatggacgccgtgtgcacctcgacgtcacccactaggtcgatggcgcctggggcggtccatctgccacagccggtgtccactcggagccaacatacccaaccaactccggaaccttcgaccgcgcctagcacttccttcctgctgccgatgggaccttccccaccagctgagggctcgaccggagatgagccgaaatcatgcgataagactcatacgtgcccaccatgccctgcaccggagctcctgggaggtccgagcgtctttctttttccgccaaagccaaaagacactctgatgatctcacgcacccccgaagtgacgtgcgtcgtcgtggacgtgtcgcacgaagatccggaagtgaagttcaactggtatgtggatggagtcgaggtccacaacgctaagaccaagccgcgggaagaacagtacaattcgacctaccgagtggtgtcggtcttgaccgtcctgcaccaggactggcttaacggcaaagaatacaaatgtaaagtgtccaataaagctctgccggcgccgattgaaaaaactatctcaaaggcaaagggccaaccgcgcgagccacaagtgtacacccttccgccgtcccgagaagaaatgactaagaaccaagtgtccctgacctgccttgtgaaggggttctacccaagcgatatcgccgtggagtgggagtcgaacggacaacccgagaataactacaagactactccaccagtgctcgactcagacgggtccttctttctgtactctaaattgaccgtggataaatcacgctggcagcagggcaatgtgttctcctgtagcgtcatgcatgaagcactgcacaaccattatactcagaagtccctgtcactttcgccgggtaag

SEQ ID NO: 15515 - DNA, 1467 bp, Artificial Sequence
  Description of Artificial Sequence: Synthetic coding sequence
atggccccggtcgctgtctgggccgctctggcagtcggattggaactgtgggcagccgcgcatgcacttccagcccaagtggcatttactccgtatgcgccggagccgggctccacctgcagactccgcgaatactacgaccagactgcccagatgtgttgctcaaaatgctcgccgggccaacacgcaaaggttttctgtactaagactagcgatactgtctgtgactcctgtgaggattcaacgtacacgcagctgtggaactgggttccagagtgtctcagctgcggctcccgctgctcctcggaccaagtggaaactcaagcctgcaccagggaacaaaacaggatctgcacctgccgccctggatggtactgcgcactctcgaagcaggagggatgtcgactgtgcgcgcctctgaggaagtgccggcccggattcggggtggcaagaccgggaaccgaaacttcggacgtcgtgtgcaaaccgtgtgccccgggaaccttctccaacactacttcgtcaaccgatatctgccggccgcaccagatctgtaacgtagtggcaatcccgggaaatgcaagcatggacgcggtctgcacgtcgacttcaccaacccgctcaatggccccaggcgcggtccatctcccccaacccgtcagtacccgcagccagcatacccagcctaccccggagccttccactgctccgagcacttcgtttcttttgccgatgggcccgtcgccaccagccgaaggttccaccggcgatgagccgaagtcgtgcgataagacgcacacgtgcccgccatgcccagcacccgagctgctggggggaccaagcgtgttccttttccctccaaagcctaaagacactttgatgatctcgagaacccctgaggttacctgcgtggtggtcgatgtgagccacgaggaccccgaggtgaagttcaattggtacgtcgacggtgtggaggtccataatgctaagacgaagccgagagaggagcagtacaattccacttaccgcgtggtcagtgtgctgactgtcctccatcaggattggctgaacggtaaggaatacaagtgcaaagtttcgaacaaggcgcttcccgctccgatcgagaaaacgatcagcaaagcgaaagggcagccgcgggagccacaggtgtacaccctgccaccgagccgagaagagatgaccaagaaccaagtcagtcttacgtgcctggtgaagggattttacccgagcgacatcgcggtggagtgggaatccaacggacagccagaaaacaactacaagaccacccctccagtcctggactccgatgggagcttttttctctactcaaaactgaccgtggacaagtcaagatggcagcaagggaatgtgttcagctgttccgtgatgcacgaggccctgcacaatcactatactcaaaagtcactgtcactgtcgcctggaaaa

SEQ ID NO: 15516 - DNA, 1467 bp, Artificial Sequence
  Description of Artificial Sequence: Synthetic coding sequence
atggctccagttgccgtttgggcagccttggctgtgggtttagaactttgggcagcagctcacgctctgcctgcccaggttgctttcactccttatgcccctgagcctggttctacctgccgcctgcgcgaatattatgaccagacagctcaaatgtgttgttccaaatgctctcctgggcaacatgctaaagtgttttgcaccaaaacctctgatactgtgtgtgatagttgcgaagactccacctacactcagctctggaactgggttcccgaatgccttagctgcggctccaggtgcagctccgaccaggtagagacacaggcctgcactcgagaacagaatcgcatctgcacctgccgcccgggatggtattgcgcactgtctaagcaagagggctgccggctctgcgcccctctccgaaagtgcagacccggatttggcgtggctcgccccggcaccgagacatctgatgtagtgtgtaaaccatgcgcacccggtactttcagtaacaccacctcaagcacggacatctgccgcccccaccagatctgcaatgttgtcgccattcctggcaacgcctccatggacgccgtctgcacttctacctcacctaccaggtctatggctcccggggccgtgcatctgccacagcctgtttcgaccaggtcgcaacatacacaacccacacccgaaccctctaccgccccgtctacctctttcctcctgccaatggggccttcaccacctgccgaaggttccaccggcgatgagcccaagagctgtgacaaaactcatacctgcccaccttgcccggcgcccgaattgcttggtgggccgagtgtctttctttttccaccaaaacctaaggatacactcatgattagccgaacccccgaggtgacttgtgttgtggtcgacgtatcccacgaagatccagaggtgaagtttaattggtacgtcgacggggtcgaagtccacaacgccaagactaagccacgggaggagcagtacaactccacctacagagtagtgtctgtactgaccgtgctacaccaggactggctgaatgggaaagagtacaaatgtaaagtgtccaataaagccttgcccgcgcctatagaaaaaaccatatcaaaagctaaggggcaacctcgcgagccgcaggtttacactctgccccccagtcgcgaggagatgacaaaaaaccaggtctcactcacatgcctggttaagggcttttatccatccgatatagcagtggaatgggagtccaatggacagcctgagaacaactataagactactccgcccgttctggattcggacggcagcttttttctatactccaaactgactgtcgataagagccgctggcagcagggcaatgttttttcttgttccgtcatgcacgaggccctgcataatcattatacgcaaaagtcattaagcctcagtccgggaaag

SEQ ID NO: 15517 - DNA, 1467 bp, Artificial Sequence
  Description of Artificial Sequence: Synthetic coding sequence
atggccccagtcgcagtgtgggcagcactcgccgtcggtcttgaattgtgggcagcagcacatgcattgccagcccaagtggcatttaccccttacgcgcctgaaccaggctcaacctgcagactgcgagaatactacgaccaaaccgcacaaatgtgttgctccaagtgctcaccaggtcagcacgcaaaggttttttgtaccaagacgtccgatacggtctgtgatagctgtgaagatagtacctacacccaactctggaattgggtgccagaatgtctgtcatgtgggtcacgctgtagctccgatcaggtggaaactcaggcatgcactagagaacaaaatcggatttgtacgtgtcgccccggatggtactgtgcactgtcgaagcaggagggttgtcgcctctgtgcgcctctgcgcaagtgcagacccggttttggagtggcaagaccggggactgagacttcggacgtggtgtgtaagccctgcgcaccaggaaccttttcaaacactacttcgtcgactgacatctgtcggcctcatcagatctgcaacgtcgttgcaatcccagggaacgcatcgatggatgcagtgtgtacttctacttcgccaactcggagcatggcgccaggagcggtccacctgccccaacccgtgtcgacccgctcacaacatactcagccaactccggagcctagcaccgcaccctcgaccagcttcctgcttcctatggggccttcgcctcccgccgaaggatcgaccggtgacgagccaaaatcatgtgacaaaacccacacctgtcctccttgcccagcacccgagctgcttggcggaccctccgtgtttcttttccccccaaagccaaaggacaccctgatgatctcgcgtaccccagaagtcacttgcgttgtggtggatgtcagccacgaagatcctgaagtgaagttcaattggtacgtggatggagtggaagtccataacgccaagaccaagcctagggaagaacaatacaactccacttacagggtggtgtccgtgcttactgtacttcatcaagattggctgaacggcaaagagtacaagtgtaaagtctccaacaaggcacttccagcgccgatagagaaaacgatttcgaaggcaaaaggacaacctcgagagccacaggtgtacaccctgcctccgagcagagaagaaatgaccaagaaccaagtgtcccttacgtgcttggtgaaaggtttctacccctccgacatagccgtggaatgggaatccaatggacagcctgagaataactacaagacgacccctccagtgcttgattcggatggtagcttttttctttactcaaaactcactgtggataagagccgttggcagcagggcaacgtctttagctgttccgtgatgcatgaggcactgcacaaccactacacccaaaaaagcctttcactgtcccccggaaag

SEQ ID NO: 15518 - DNA, 1467 bp, Artificial Sequence
  Description of Artificial Sequence: Synthetic coding sequence
atggcaccggtcgcggtgtgggcagcactcgcagtgggactggaactgtgggccgcagcccatgccctgccggcccaggtggcatttaccccgtatgcccctgaaccaggctcgacttgtcgcctccgcgagtactacgatcagaccgcccaaatgtgctgttcgaagtgttcacctggtcagcatgcaaaggtgttttgtactaagacctcggacaccgtctgtgactcctgtgaagattcaacttacacccagctctggaactgggtgcctgaatgtctgtcgtgcggaagcagatgttcttcagatcaagtggaaactcaagcctgcaccagggagcaaaaccgcatttgtacgtgccgtcccggctggtactgtgccctgtcgaagcaagagggatgtagactgtgtgctcccctgcgtaaatgtagacccggctttggagtggcccgcccaggcactgaaacctccgatgtggtgtgtaagccctgtgcaccaggaaccttcagcaacactaccagctcaaccgacatatgccgccctcaccaaatttgtaacgtggtcgcgattccgggaaatgcctctatggacgcggtctgtacctccacctcccccactcgctcgatggcacctggggccgttcatcttccccaaccagtgagcaccagatcccagcatacccaacctaccccagaaccgtccaccgcaccgtcgactagctttctgctcccaatgggaccatcgcctcctgcagagggatccaccggtgacgaacctaaatcctgcgataaaacccatacttgtccgccttgtccagcccctgaactgcttggtggtccttcggtgtttctcttccctccaaagcctaaagatacccttatgatcagcagaacgccggaagtcacttgtgtggtggtcgatgtgtcccatgaagatccagaagtcaagtttaactggtacgtggacggagtcgaggttcataatgcaaagaccaagccccgcgaggaacagtacaactccacctaccgggtcgtgtccgtccttactgtgttgcaccaagattggcttaatggaaaggaatacaaatgtaaggtgtcgaacaaggcccttcctgcgcccattgaaaagacgataagcaaggcaaaaggacaaccccgagagccacaagtctacactctgccaccatccagagaagaaatgaccaaaaaccaagtgagtctcacctgcctggtgaagggtttttaccctagcgatatcgccgtggaatgggagtctaatggacagcccgagaacaattacaagaccactcctccagtgctggattccgatggatcatttttcctctactccaagctcaccgtcgataaaagccggtggcagcagggtaacgttttcagctgctccgtcatgcatgaagcccttcataaccactacactcagaagtcactttccctgtcccccggaaaa

SEQ ID NO: 15519 - DNA, 1467 bp, Artificial Sequence
  Description of Artificial Sequence: Synthetic coding sequence
atggcacccgtggcagtatgggcagcccttgccgtggggcttgagctctgggctgccgcccatgcgctgcccgcccaggttgcctttactccctatgcccctgagcccgggtctacatgccggttacgtgaatattatgaccagaccgcacaaatgtgttgttcgaaatgcagtcctggccagcacgccaaagtattctgcacaaagacctccgacactgtatgcgacagttgcgaagactcaacatacacacaactgtggaattgggtccctgaatgtctgtcttgcggatcacgttgctctagtgaccaggtggagacccaggcctgtacacgcgaacagaacagaatctgcacgtgcaggcccggctggtattgcgccctgagtaaacaggagggttgtcggctgtgtgcacccctgaggaaatgtcgcccaggcttcggagtcgcgcgacctgggacagaaacatctgacgtggtttgcaagccttgcgctcccggaaccttctccaataccacaagctccactgacatatgtcgcccacaccagatctgtaatgttgtcgcaattccagggaacgcttccatggacgcagtctgcacctctacttcacccacgagatccatggcccccggagccgtgcatttacctcagcccgtcagcacacggtcgcaacacactcagcctacaccagagccttccaccgctccctctacttcttttttgctgcccatggggccgtccccccctgctgaagggtccacaggcgacgaaccaaagagttgcgataagacacatacatgcccaccatgtccagccccagaacttctcggtgggccctccgtatttctgtttccacccaaacccaaggacactttaatgataagccggacgcctgaggtcacatgcgtggtcgtggatgtcagccacgaggatcctgaggtgaagtttaactggtacgttgatggcgttgaagttcacaatgcgaagaccaagccaagagaggaacagtacaattccacgtatagggtggtgtccgtcttgaccgtgctgcatcaagactggctgaatggtaaggaatacaaatgtaaggtgtcgaataaagccctcccagccccgattgagaagacaatatctaaagcaaaaggccagccccgtgaacctcaggtgtatacgctgccacccagccgggaggagatgacaaagaatcaggtatctctcacttgtttggttaaaggtttctatccgtccgatatcgccgtggaatgggagagtaacggccagccagagaataactataagaccacccccccggtccttgacagcgatggtagcttcttcctgtatagcaaacttaccgtggacaaaagccgctggcaacagggcaacgtgtttagctgttctgtcatgcatgaagcattgcacaaccactacacccagaagtcattatctttgtcccctggcaaa

SEQ ID NO: 15520 - DNA, 1467 bp, Artificial Sequence
  Description of Artificial Sequence: Synthetic coding sequence
atggccccggtggcagtgtgggctgcacttgcagtcggactggaactgtgggcagccgcccatgcacttcccgcacaagtggcatttaccccatacgcacctgagccgggatcgacttgtagactccgcgaatactatgatcaaacggcacagatgtgttgtagcaagtgctcgcctggtcaacatgccaaggtcttttgcaccaagacctcggataccgtgtgcgactcgtgcgaagattcgacttacacccaattgtggaattgggtgccggaatgcctttcatgtggctcgcgatgtagcagcgaccaggttgaaactcaagcatgtacccgtgagcagaacaggatttgcacttgccgaccgggttggtactgtgccctgtcaaaacaggaagggtgccggctctgtgcccctctccggaagtgccgtccaggatttggtgtcgcccgaccaggaactgagacgtcagatgtggtgtgcaagccttgcgctcctggtaccttctccaatacgacttcctcaacggatatttgtaggccccaccaaatatgtaacgtcgtggcaattcctggaaacgcgagcatggatgcagtgtgtacgtccacttcacccacgcggtcaatggcccctggtgccgtgcaccttcctcaacctgtgtctacgcgctcgcagcatacgcagcctacccccgagccttcaacggcaccttcgaccagctttctccttccaatggggccttcgccaccagcagagggatcgactggggatgaacccaagagctgtgataagacccatacgtgcccaccttgtcccgccccggagctgctcggaggtccatcagtctttctgttcccacctaagccaaaggatactctgatgatctcacgtactcctgaggtcacttgtgtggttgttgacgtctcacatgaggaccctgaggtgaaattcaactggtacgtcgatggagtcgaggtccataatgcaaagactaagcctagagaggaacagtataactcaacttaccgggtggtgtcagtgctgactgtgctgcaccaagactggttgaacggaaaagaatacaagtgtaaagtgtcgaacaaggccctcccagcacctatcgaaaagactattagcaaggcaaagggccagccgagagagcctcaagtgtacactcttcctccctctagggaagaaatgactaagaaccaggtgagccttacttgtctggtgaaggggttttacccctctgatatcgcggtggaatgggaatccaacggtcaacctgaaaacaattacaagaccacccctccggtcctggattcagacggatcatttttcctgtactccaagctcaccgtggataagagccgctggcagcaagggaacgtgttcagctgctccgtgatgcatgaagcactccataaccactacacccaaaaatccctgtcactgtccccgggaaag

SEQ ID NO: 15521 - DNA, 1467 bp, Artificial Sequence
  Description of Artificial Sequence: Synthetic coding sequence
atggcacccgtcgcggtgtgggccgctctggcggtggggctcgagctttgggcggcagcacatgcactgccagcccaggtcgcatttactccatacgcacctgaaccaggttccacctgtagacttcgcgagtactacgatcaaactgcacaaatgtgttgtagcaaatgctcacctggacaacatgccaaggtgttctgcacgaaaaccagcgataccgtctgcgactcctgtgaggactccacctacactcaactgtggaactgggttccggaatgccttagctgtggatccagatgctcatccgatcaagtggaaacccaggcgtgtactcgtgaacaaaacaggatttgtacgtgtcggcccggttggtactgtgccctctcgaaacaagagggatgtcgactgtgtgcaccactgcggaagtgtagaccaggtttcggagtggcacggcccggcaccgaaacttccgacgtggtgtgtaaaccgtgcgcacccggtactttctccaacacgacttcgtcaacggacatatgtcgaccgcaccaaatttgcaacgtggtcgcgattccaggaaacgcatcaatggacgcagtctgtacgtccacttccccaactcgtagcatggctccaggtgccgtgcatctcccacaacctgtgagcactaggtcacagcacactcaaccaactcccgaaccctcaaccgcaccttcaacctcctttctgcttcccatgggaccgtcgcctcctgcagaagggtcaacgggcgatgaacccaagtcctgcgacaaaacccatacgtgtcccccttgtcctgcacccgagctcctcgggggccctagcgtgttccttttccctcctaagccaaaggatacgcttatgatatcacgaactccagaagtgacgtgcgtggtggtggatgtgtcacatgaggaccctgaggtgaagtttaactggtacgtcgacggtgtcgaagtccataacgccaagaccaaacctcgcgaagagcagtacaattcgacttacagagtggtttccgtgctcaccgtcctgcatcaggattggctcaatggcaaagaatacaagtgcaaggtgtccaacaaggcactccctgcacctatcgaaaagaccatttccaaggcgaagggtcagcctagggagccacaagtctataccctgccaccttcaagagaagaaatgaccaagaaccaagtgtcattgacctgtctggtcaagggtttttacccctcggacattgcggtggaatgggaatccaacggtcaacctgaaaacaattacaagactactccaccagtgctggattcggatgggagcttctttttgtactctaagctcaccgtggataaatccagatggcagcaaggaaacgtgttctcgtgttcggtgatgcatgaggcgctgcataatcattacactcagaagtcactctccctgtcgcccggtaaa

SEQ ID NO: 15522 - DNA, 1467 bp, Artificial Sequence
  Description of Artificial Sequence: Synthetic coding sequence
atggcgccggtagcggtatgggcggcgttagcggtaggtctagaattatgggcggcggcgcatgcgctaccggcgcaagtagcgtttacgccgtatgcgccggaaccgggttcgacgtgtcgtctacgtgaatattatgatcaaacggcgcaaatgtgttgttcgaaatgttcgccgggtcaacatgcgaaagttttttgtacgaaaacgtcggatacggtatgtgattcgtgtgaagattcgacgtatacgcaactatggaattgggtaccggaatgtctatcgtgtggttcgcgttgttcgtcggatcaagttgaaacgcaagcgtgtacgcgagaacaaaatcgaatatgtacgtgtcgaccgggttggtattgtgcgttatcgaaacaagaaggttgtcgactatgtgcgccgctacgtaaatgtcgtccgggttttggtgttgcgcgtccgggtacggaaacgtcggatgttgtttgtaaaccgtgtgcgccgggtacgttttcgaatacgacgtcgtcgacggatatatgtcgaccgcatcaaatatgtaatgttgtagcgataccgggtaatgcgtcgatggatgcggtatgtacgtcgacgtcgccgacgcgatcgatggcgccgggtgcggtacatctaccgcaaccggtttcgacgcgttcgcaacatacgcaaccgacgccggaaccgtcgacggcgccgtcgacgtcgtttttactaccgatgggtccgtcgccgccggcggaaggttcgacgggtgatgaaccgaaatcgtgtgataaaacgcatacgtgtccgccgtgtccggcgccggaattactaggtggtccgtcggtatttttatttccgccgaaaccgaaagatacgctaatgatatcgcgtacgccggaagtaacgtgtgtagtagttgatgtatcgcatgaagatccggaagttaaatttaattggtatgtagatggtgtagaagtacataatgcgaaaacgaaaccgcgtgaagaacaatataattcgacgtatcgagttgtttcggttttaacggttttacatcaagattggctaaatggtaaagaatataaatgtaaagtttcgaataaagcgttaccggcgccgatagaaaaaacgatatcgaaagcgaaaggtcaaccgcgagaaccgcaagtttatacgctaccgccgtcgcgagaagaaatgacgaaaaatcaagtatcgttaacgtgtctagtaaaaggtttttatccgtcggatatagcggtagaatgggaatcgaatggtcaaccggaaaataattataaaacgacgccgccggtattagattcggatggttcgttttttctatattcgaaattaacggtagataaatcgcgttggcaacaaggtaatgttttttcgtgttcggttatgcatgaagcgctacataatcattatacgcaaaaatcgttatcgttatcgccgggtaaa

SEQ ID NO: 15523 - DNA, 1467 bp, Artificial Sequence
  Description of Artificial Sequence: Synthetic coding sequence
atggccccagttgcagtgtgggcagcccttgcagtgggacttgagttgtgggccgctgcccacgcgttgccggcccaagtggcctttaccccttacgcgcccgagcccggatccacctgtcgccttagggaatactacgaccagactgctcagatgtgctgttctaagtgttcacctggccagcatgcaaaggtgttttgtactaagacctccgataccgtctgcgattcttgtgaggattccacctacactcagctctggaactgggtgcctgagtgtctttcgtgtggatcacgttgtagttccgatcaagtggaaactcaggcatgtactcgggagcaaaaccgtatctgtacttgtcggcctggctggtactgcgcactcagcaagcaggagggatgtcgattgtgtgcgcccctcagaaaatgtagacctggattcggtgtggcccgccctggaaccgaaacttcagatgtggtgtgcaagccgtgtgcccctggtacttttagcaataccacctcttcgaccgatatttgccgcccacatcagatttgcaatgtggtggcaatccctggcaatgcctccatggatgccgtctgtacttccacctcgccgacccgctcgatggcccccggggcagtgcatttgccacagccggtgagcaccagatcacaacacacccagcctacccctgagccttctacggcaccgtcgacgtccttcctgcttccaatgggaccatcgccacctgcagaaggatcaacgggcgatgaaccaaagtcatgtgacaagacgcacacctgtcctccttgtccagcacctgagttgttgggaggcccgagcgtgttcctctttccacccaaaccaaaggatactctcatgatttcgagaacgcctgaggttacttgtgtagtcgtggatgtgtcgcatgaggaccctgaagtgaagttcaactggtacgtggacggcgtggaagtccacaatgctaaaaccaagcctcgggaagaacaatacaacagcacttacagagtcgtgtccgtcctgactgtcctccatcaagattggcttaacggcaaggaatacaagtgcaaggtgtccaacaaagcactccctgcaccaatcgaaaagactatttcaaaagcaaaagggcaacctcgagaacctcaagtctacactctccctccatcacgcgaggaaatgactaaaaaccaagtctcgctgacttgtcttgtgaaggggttttacccttcagatattgccgtggaatgggaaagtaacggacagcccgagaataactacaagactacccctcctgtgctggactcggatgggtcgttctttctgtactcaaaacttactgtggataagagcagatggcagcaaggtaacgtcttttcctgttcggtgatgcatgaagcacttcataaccactatacgcagaagtcgctgtcgctgtcccccggtaaa

SEQ ID NO: 15524 - DNA, 1467 bp, Artificial Sequence
  Description of Artificial Sequence: Synthetic coding sequence
atggctcccgtggctgtatgggcagcattggcggtgggcctcgaactgtgggcagcggcacacgctctcccagcccaagtcgcgtttactccatacgcacccgagcctgggtctacatgtcgtcttcgagagtattacgaccagactgctcagatgtgttgttctaagtgctcccctggccaacacgctaaggtgttctgcacaaagacttctgacaccgtgtgtgactcctgcgaagactctacatatactcagctgtggaattgggtacctgagtgtctcagttgcggaagtagatgtagtagcgaccaagtcgagactcaagcctgcacaagagagcagaataggatttgtacttgtcgccctggatggtactgcgccttatccaagcaggaaggatgccgactttgcgccccactaagaaagtgccgtcccggattcggagttgcaagaccaggaacagagactagtgacgttgtgtgcaagccttgtgctcctggaactttctcaaacacgacctctagcaccgacatctgtcgaccgcaccaaatttgcaatgtcgtcgcgattcccggcaatgcaagtatggacgctgtttgcaccagcacttcccctacccgttcaatggcgccgggggctgtccatctccctcaacccgtctccactaggtctcagcacacccagccaacaccggaaccaagtaccgcaccatcaacctcgttccttttacccatgggtccgtccccgcccgctgaaggatcaaccggagatgagccgaagtcatgcgataagacccatacctgcccgccgtgccctgcccccgaattacttggagggccttcagtgttcctcttcccgccgaaacccaaagatactctgatgatcagccgcactcccgaagttacttgcgtggtggtggacgtgtcacacgaggacccagaggtcaaatttaactggtacgttgacggagtagaggtccacaacgcgaaaacaaaaccccgggaagaacagtacaatagtacttacagagtggtgtcagtcctgactgtgctccatcaagattggttgaatggaaaggaatacaagtgtaaagtgtccaacaaggcgttgcctgcacctatcgagaaaaccatcagtaaagctaagggtcagccacgagagccccaggtgtacaccctgccaccatcccgcgaagagatgacaaagaaccaggtttcacttacatgcctagttaaaggtttctacccatcagatatcgctgtagagtgggagagtaacggtcaaccggagaacaattacaaaacaacgccccctgtgctggacagtgacggttctttcttcctatattcaaaactcacggttgataaaagtcgttggcagcagggaaacgttttttcgtgctcagtcatgcatgaagccttgcacaaccactacacccagaagagtctgtcactgtctcccggaaag

SEQ ID NO: 15525 - DNA, 1467 bp, Artificial Sequence
  Description of Artificial Sequence: Synthetic coding sequence
atggctcccgtagccgtatgggccgcattggcggtgggcctagagctttgggctgcggcccatgccctgcccgcacaggtggccttcactccctacgctcccgagccaggatccacctgcaggttgcgtgagtactatgaccaaaccgcccaaatgtgctgttctaagtgttcaccaggacaacacgcaaaggtgttctgcaccaagacatcagataccgtctgcgacagttgcgaggattctacttatactcaactctggaattgggttcccgagtgtcttagctgtggttctaggtgtagttcagaccaggtagagacacaggcttgcacaagggagcaaaaccgaatatgcacatgtcggccaggttggtactgtgccttgtccaagcaggaaggctgccgcctatgcgctcccctgcggaaatgccggcctggattcggggtggcaaggcctggcacagaaacatccgacgtggtgtgtaaaccctgtgctccgggaacctttagtaacactacctcaagcacggacatttgtaggccccatcagatttgcaacgttgtcgcgatccccggaaatgcttctatggatgccgtgtgtacatctacctcccctacccggtctatggcccctggcgcagtccacctgccccagcccgttagcactcgatcgcagcatacccagccgaccccagaaccatccactgcacctagcacatcctttctgctcccaatggggccatcaccacctgcagagggctccacaggcgacgagcccaagagttgcgacaagacgcatacctgtccgccctgtcctgcacccgagctgctaggtgggccgtccgtgttcctgtttcctcccaagcctaaggataccctgatgatctcacgcacccccgaggttacatgcgtggtggttgacgtttctcacgaagacccagaggtgaaatttaactggtatgtggacggcgtggaggtacacaacgcaaaaaccaaacctagagaggaacagtacaattcaacatacagagtggtctctgttctgacagtgctgcatcaagactggcttaacggtaaggaatataagtgcaaggtgagtaacaaggctctcccagctccaatcgagaagacaatttcaaaggcgaaaggccagccccgcgaaccccaggtgtacactcttcctcctagcagggaagaaatgacaaaaaatcaggtgtctctcacttgcctggtgaagggcttctatccctccgatatcgcagtggagtgggagtccaatgggcagccagaaaacaactataagacaacaccccctgtactggatagcgacgggagtttcttcttatattcaaagctaactgtcgacaagtctcggtggcaacaaggaaatgtgttttcttgttcagtgatgcacgaggcgctccacaaccattacacacagaagtccttaagtttgagtcctggcaag

SEQ ID NO: 15526 - DNA, 1467 bp, Artificial Sequence
  Description of Artificial Sequence: Synthetic coding sequence
atggctccagtggctgtatgggcggcgctggcagtaggcttagagctttgggcggcagctcatgctctgccagctcaggtggcctttacgccttatgcaccggagccaggttccacctgccgacttcgtgagtattacgaccagacagcgcagatgtgttgtagtaagtgctctcctggacagcacgccaaggttttctgcaccaaaacctctgatacagtctgtgattcttgtgaagactctacatatacccagttgtggaactgggtgcctgagtgcttaagttgcggctctcgttgctcctcagaccaggtagaaacccaggcctgtactcgagagcaaaacaggatctgcacatgtcggcccggttggtactgtgccctttccaagcaagaggggtgtcggttgtgcgctcccctgaggaagtgtcgcccaggctttggggtggctaggccgggcaccgagacctctgatgttgtttgtaaaccatgcgctcctggcaccttttctaatacgacatccagcactgacatctgtcgaccccaccagatctgtaatgtcgtcgctatcccaggcaatgctagtatggacgccgtatgcacgagtacgagccctacgaggtcaatggctccaggagctgtgcatctaccccagcccgtcagtacgaggtcgcagcatacccaacccacgccggagcccagtaccgccccgtctacaagcttcttgctacccatggggccatctccccccgctgagggttcaacaggagacgaacctaaaagttgcgataaaacccatacgtgccctccctgtccagcccctgaattgcttggagggccatctgttttcttgttcccacctaagcccaaggatacactgatgatcagtaggacaccagaagtgacatgtgttgttgtcgacgtgtcacacgaagatcctgaagtgaagtttaactggtatgtggacggcgtggaggtacacaatgcaaagacaaagccccgcgaagagcagtataactccacatatagggtcgtgtcagttctgactgtcctacaccaggattggctgaatggaaaagaatacaaatgtaaggtcagcaataaagctttaccggccccaatcgagaagacaatttctaaggccaagggccagccgagagagccccaggtttatacactgccaccctcccgtgaagaaatgaccaaaaaccaggtctccctgacttgtctggtgaagggtttctatcctagcgacatcgctgttgagtgggagtctaacggacaacccgaaaataattataagacgactccccctgttctggactcagatggctccttcttcttatacagcaaactcacagttgataaatctcgatggcaacaaggtaacgtgttcagctgctccgtcatgcacgaggccctgcataaccactacactcaaaaaagcctaagtttgtcccctggcaag

SEQ ID NO: 15527 - DNA, 1467 bp, Artificial Sequence
  Description of Artificial Sequence: Synthetic coding sequence
atggcgcctgtggctgtgtgggcggcccttgctgtcggcctggaactgtgggccgcggctcacgccctgccggcccaagtggcattcaccccatacgcacccgaaccgggatcgacttgtaggttgagagaatactacgaccagactgcacagatgtgttgctccaaatgcagcccaggtcaacacgccaaggtgttctgcaccaaaacctcagatactgtctgcgactcgtgcgaggactccacctacacccagctgtggaactgggtgccagagtgtctttcgtgcggatcgcggtgctcaagcgaccaggttgagactcaggcgtgtacccgcgagcaaaaccggatctgcacctgccgaccggggtggtactgcgcgctgtccaagcaagagggatgccgcttgtgcgctcctcttcgtaagtgccgcccgggattcggcgtggccagaccaggaaccgaaacttcagacgtggtttgcaagccgtgcgccccaggtaccttctccaatactacgtcctccaccgacatctgcagaccccatcaaatttgcaacgtggtggccattccaggaaatgcctcgatggacgccgtgtgcacctcgacttccccgacccggtctatggcaccaggcgcagtgcatctcccgcaaccggtgtccactcgcagccagcacacgcagccgacccctgagccttccactgcgccgtcgacttccttcctgctgccgatgggaccgtcgcctccagctgaaggctcaaccggagatgagcccaaatcctgtgacaagacccatacttgtccaccttgcccagctcccgaactgctgggaggccctagcgtgttcctgtttccgcctaagccaaaggacaccctgatgatctcgcggactccggaagtcacttgtgtggtcgtggatgtgtcacatgaagatcccgaagtcaagttcaattggtacgtggacggggtcgaagtccacaacgcgaaaaccaagccacgcgaggagcaatacaacagcacttaccgggtcgtgtcagtgctgacggtactccaccaggattggctcaacggcaaggaatacaagtgcaaggtgtctaacaaggccctgcctgcaccgatcgagaaaactatctcgaaggccaaagggcagccgagagagccgcaggtgtatacgctcccgccgagcagggaagagatgactaagaatcaagttagtctcacctgtctcgtcaagggattttacccgtccgatatcgcagtggagtgggaatcgaacggtcagcccgaaaacaattacaagactaccccgcccgtcctggattcggacggatcgttcttcctctatagcaaactcacggtggataaatcccgctggcagcaggggaacgtctttagctgcagcgtgatgcacgaagcgctgcacaatcattacacccagaagagcctctcattgtcaccaggaaag

SEQ ID NO: 15528 - DNA, 1467 bp, Artificial Sequence
  Description of Artificial Sequence: Synthetic coding sequence
atggccccagtggcggtgtgggccgctctggccgttggactggagctctgggccgccgctcatgccctccctgctcaagtggcctttaccccttacgcccctgagccggggagcacgtgtcgcctgcgggaatactacgaccagacagcccagatgtgctgtagcaagtgcagcccaggccagcacgcaaaggttttctgtacaaagaccagcgataccgtgtgcgactcctgcgaagacagcacttacacgcagttgtggaattgggtgccagagtgtctatcatgcggttctagatgttcctcagatcaagtggagacccaggcctgcaccagggagcagaaccgaatatgtacctgtcgaccaggctggtattgtgccctctcgaagcaggaaggatgcaggctctgtgcacctttaaggaagtgccgtccaggatttggagtcgctagaccaggtacagagactagtgacgtggtctgtaaaccatgtgcacccggcacgttctcgaatactacttcatcaaccgacatttgccgacctcaccaaatatgcaatgtcgttgcgattccagggaatgctagcatggacgccgtctgcacatcaacatctccaacccgctcaatggcccccggagcagtccatcttcctcagcctgtttccactcggtctcagcacacacaacccaccccggaaccaagcactgctccatcaacctcctttctgcttcccatgggaccatcgccgcctgccgagggctctaccggggacgaacctaagagttgcgataagacgcacacatgcccaccatgcccggcccctgaactattgggcgggccatctgtgtttctctttcctcctaagccaaaggacactcttatgatatcaagaactccagaggtcacttgtgtggtcgtcgatgtgtcacatgaagaccctgaagtgaagttcaattggtatgtcgatggcgtggaggtgcacaacgccaaaaccaagccccgagaagaacagtataatagtacgtatagagtcgtgtcagtgctgacagtcctacatcaggactggctgaatggaaaggagtacaaatgtaaagtcagcaacaaggcgctgcccgccccgatcgagaagacaatttccaaagccaaaggacaaccccgagagccccaggtatacacgctgccaccttccagggaggagatgacaaagaatcaggtcagtctcacatgcttggtcaagggcttttacccatcagatatcgccgtggaatgggaaagcaatggtcagcctgagaacaattataagaccacgcccccagtgctggatagcgatggcagcttctttctttacagcaagctgactgtggataaatcccggtggcagcaggggaacgtcttctcgtgttccgtcatgcatgaagccctgcataaccattacacccagaagtccttgtctctgtccccaggcaaa

SEQ ID NO: 15529 - DNA, 1467 bp, Artificial Sequence
  Description of Artificial Sequence: Synthetic coding sequence
atggcccctgtagcagtgtgggccgcgctggctgtgggactggagctgtgggccgctgctcacgccctccctgcccaggtggccttcacgccgtacgcccctgaaccaggctcaacctgccggctgagagaatactacgaccaaaccgcccagatgtgctgtagcaagtgctccccgggacaacacgccaaggtgttctgcaccaagacttccgatactgtgtgcgactcgtgcgaggattccacgtatactcagctctggaattgggtgcccgagtgcctctcgtgcggctcacggtgctcaagcgatcaggtcgagactcaagcctgtactagagagcaaaaccgcatctgtacttgtcgacctggttggtactgcgcactttcgaagcaggaaggatgtaggctctgcgccccccttcggaagtgcagaccgggcttcggagtcgctcgccccggcaccgaaacctccgacgtcgtgtgtaaaccctgcgccccgggcactttttcgaacaccacgtcctcaaccgatatctgcaggccgcaccagatctgtaatgtggtcgcaatcccgggcaatgcaagcatggacgcggtgtgcacctcaacttcgcctaccaggtccatggctccgggagccgtccacttgccgcaacctgtgtcgaccaggagccaacacacccaacctaccccggagccgtcgaccgctccttccacctccttcctccttccaatgggaccctctccccctgctgaaggatcaaccggagacgaacctaaaagctgcgataaaactcacacctgtcccccatgcccggcgcccgagttgctggggggaccttccgtgttcctgttcccaccaaagccaaaggacacgctcatgatctcgcgcactcccgaggtgacctgtgtggttgtggacgtaagccacgaggatccggaagtcaagttcaactggtacgtggatggcgtggaggtgcataacgccaaaacgaaaccacgcgaagaacaatacaactccacttaccgggtggtcagcgtcctgactgtgctgcaccaggactggttgaacggaaaggaatacaagtgcaaagtgtcgaataaagcgctcccagcaccgatcgaaaagactattagcaaagccaagggacagccgcgcgaaccacaggtctatactctgccacctagcagggaagagatgaccaagaatcaagtgtccctcacctgcctggtcaaagggttctacccttcggacatagctgtggagtgggaatctaatgggcagcctgagaataactacaagactactccacccgtcctcgactccgacgggtcctttttcctctacagcaaactgaccgtggataagtcgagatggcagcaaggaaacgtgttcagctgctcagttatgcatgaggcgctgcataaccattacacccagaagtcactgtcacttagcccaggaaaa

SEQ ID NO: 15530 - DNA, 1467 bp, Artificial Sequence
  Description of Artificial Sequence: Synthetic coding sequence
atggcacccgtggccgtctgggctgctctagccgtggggctggaactctgggccgcagcccacgcattacccgcccaggtagcttttactccttatgctcctgaacctggatccacgtgtcgtctgcgcgagtactatgaccagactgcacagatgtgttgcagcaagtgctcccccggtcagcacgctaaggtgttctgcacaaaaacatctgataccgtctgtgactcgtgcgaggatagtacatatacacaactctggaattgggtgcccgaatgtctgtcctgcgggtccagatgtagttccgaccaggtagagacacaggcatgtaccagagaacagaatcgcatctgcacctgtaggcctggatggtattgcgcactctccaaacaggaagggtgtcggctgtgcgcccccctgcgcaaatgccgcccgggatttggcgtggccagacccggcactgaaacttctgacgtcgtgtgcaagccttgcgccccgggaacctttagcaacacgacgtcttcaaccgacatttgccggcctcaccagatctgtaacgtggtggcgattcctgggaatgcctccatggatgctgtctgcacgagcacttcccccactcgaagcatggcacccggagcagtgcacctgccacagcccgtgagcacacggagtcaacacacacagcccacccccgaaccctcaaccgcgccaagcacgagcttcctgttaccgatgggcccatcacctcctgccgagggctctacgggagacgaaccaaagagctgtgataaaacccatacgtgtcccccctgtccggcccctgagttacttggcggaccctctgtcttcttgttcccgcccaagccgaaggacactcttatgatctcacggacaccagaggtcacctgtgtggtagtggatgtctctcatgaggatcccgaggttaaatttaattggtacgtagacggcgtggaggtacataacgcaaaaaccaaacctcgcgaggaacagtataactcgacatacagagtggtctctgtcctaaccgtgcttcatcaggactggctgaacggtaaggagtacaagtgcaaggtgagcaacaaagcacttcctgctcccatcgaaaagactatcagcaaagcaaaggggcagccccgcgagccccaggtttacaccctccccccttcaagagaagagatgacaaagaatcaggtttctctgacttgcctagtgaaaggattctacccgtctgacatagccgtggaatgggagtccaatgggcaacccgagaataactacaaaaccactccgccggtgctggattcagacggtagcttttttctttatagcaagctgactgtggacaagagccggtggcaacagggtaacgtttttagttgctccgtgatgcacgaggctctgcataatcactatacacagaagtcgctttcactgtcacctgggaag

SEQ ID NO: 15531 - DNA, 1467 bp, Artificial Sequence
  Description of Artificial Sequence: Synthetic coding sequence
atggcaccggtggcagtctgggccgctttggccgtgggcctggagctctgggccgcagcccatgcccttccggctcaagtggcatttactccatacgccccagagcctggaagcacctgcaggctccgggaatactatgaccaaactgctcagatgtgctgctccaagtgctccccgggacaacacgctaaagtcttttgcaccaaaacgtcggataccgtgtgtgactcatgcgaggattcaacttacacgcaactttggaattgggtgccagaatgcctgtcgtgtggatcgcgctgctcttcggaccaagtcgaaacgcaggcgtgcacccgcgaacaaaacagaatctgcacttgccggcccggatggtattgcgcactgtcgaaacaggaaggatgcaggctttgcgcgcctctgcgcaaatgtcggccgggtttcggagtggcccgcccggggactgaaaccagcgatgtcgtctgcaaaccgtgtgcgccaggcactttctccaacactacgtcgtctactgacatctgccgaccgcaccagatctgcaatgtggtcgccatcccgggcaacgcatccatggacgccgtctgcacctcaacttcaccgactagaagcatggcacctggcgcggtgcatctgccacagcctgtgagcactcgctcgcagcacactcagcctacccctgagccgtcaactgccccctccacttcgttcctgctgccgatggggccatcaccgccggcagaaggctcgaccggagacgagccaaagtcgtgtgacaagacccacacttgcccgccatgcccggcacccgagctgctgggaggaccgagcgtgttcctgttccctccaaagccgaaggacacccttatgatctcgagaacgcccgaagtgacgtgcgtggtcgtggacgtgtcgcatgaagatccggaggtgaagttcaactggtacgtcgatggagtggaggtgcataacgccaagactaagccgcgagaggagcaatacaactcgacttaccgggtggtttcggttctgaccgtcctccaccaagactggttgaacggcaaggaatacaagtgcaaggtgtcgaacaaagccctcccagcccctatcgagaaaactatctcaaaggctaagggacagcctcgggaacctcaagtctacactctgccgcccagcagagaagagatgactaagaaccaggtgtcattgacctgccttgtgaagggattctacccgtcggatattgcggtggaatgggagagcaatggacagccggaaaacaattacaagaccactccacctgtgctggattcggacggctcgttcttcttgtactcgaaactgactgtggataaatcgaggtggcaacagggcaatgtgttctcatgctccgtgatgcacgaggcactccataaccactacactcagaaatccctttcgctgtccccaggtaaa

SEQ ID NO: 15532 - DNA, 1467 bp, Artificial Sequence
  Description of Artificial Sequence: Synthetic coding sequence
atggctcctgtagctgtttgggctgctttagctgtcggactagaattatgggccgctgcacatgcgttgccagcccaagtcgcttttacgccgtatgctccagaaccaggctctacgtgtagactcagagagtattacgatcaaaccgcacaaatgtgttgcagcaagtgctcaccgggacagcatgctaaggttttctgcaccaaaacgtctgatacagtgtgcgactcttgcgaagatagcacatacacccagttgtggaactgggtccctgaatgcctttcgtgcggtagtaggtgtagcagcgatcaagttgagacacaggcctgcacaagagaacaaaatcgaatttgtacgtgccgtcccggatggtactgtgctttgagtaaacaagaaggatgtcgtctatgcgccccacttcgtaaatgtagacctggatttggagttgccagacctggcacagaaacatctgatgtcgtttgtaaaccatgcgctccaggtaccttctccaatactacatcttcgactgatatttgtagaccacaccagatttgtaacgtggtggccattccggggaatgcttccatggatgcagtctgcacctcaacatctccgacgcggagtatggcaccaggagctgttcacctgccacagcccgtcagtacccgctcgcagcatacccaaccaaccccggagccatcaacggctcccagtacatctttccttctcccaatgggaccgtcacccccagcagaaggaagcacaggtgatgaaccaaagtcatgcgataaaacgcatacctgcccgccatgcccagctccggagcttcttggaggtccgtcagtttttctattccctccgaagcccaaagatacattaatgattagcagaactccggaggttacatgcgttgttgtggatgtatctcatgaggatccagaggtgaagttcaactggtatgttgacggcgttgaagtccacaacgctaagacaaaaccccgtgaagaacagtacaattctacttatagggtggttagtgtgcttacagttttgcaccaggattggttgaatggtaaggaatacaaatgtaaggtgtcgaacaaggcccttcctgctccgatcgagaaaacaatttccaaggcaaaaggacagccgcgtgagccccaggtctacactttaccaccatctcgggaagagatgactaagaaccaagtatcgttaacttgcttagtgaagggattttatccatcagatatcgccgttgagtgggagtcaaatggacaaccagagaataattataaaacaactcccccagtcctagatagcgacggtagtttctttctttactctaaattgacggtcgataagtctcgatggcaacagggaaacgtattttcatgtagtgttatgcacgaggcacttcataaccactatactcagaaaagcttgagtcttagtccaggaaaa

SEQ ID NO: 15533 - DNA, 1467 bp, Artificial Sequence
  Description of Artificial Sequence: Synthetic coding sequence
atggcccccgtcgccgtgtgggccgccctagcagtgggtttggagctgtgggctgccgctcacgcgctccccgctcaagtcgccttcacaccctacgcccccgagcccggttccacctgccggttacgtgaatactacgaccaaacggcccaaatgtgctgctccaaatgcagccctggtcagcacgcaaaggtcttctgcaccaagacttccgacaccgtttgtgatagttgcgaggactccacttacacccagttgtggaactgggtgccagaatgcttgtcatgtggtagccggtgcagctcggaccaagtggagactcaggcgtgtacccgcgagcagaatcgcatctgcacctgtagacccggctggtactgtgctctgtccaagcaggagggttgtcgtctctgcgcgcccctgcgtaagtgccggccaggcttcggagttgcccgccccggtactgagacaagcgatgtcgtttgcaaaccttgtgccccaggtaccttttcgaacactacctcctccacagacatatgtcgccctcaccagatctgcaacgtcgtggccattcccggcaacgcttccatggacgccgtctgtacctcaacttcacctacgcgttccatggcgcccggcgcagtccatctccctcagcccgtctccacccgcagccaacacacccaacccaccccggaaccctccactgccccttcaacctccttccttttgcctatgggccctagccctcccgcagaaggttccaccggcgacgagcccaaatcctgtgataagacccatacctgccccccgtgccccgcaccagagctgcttggcggcccttccgtgttcctcttcccccccaagccgaaggacacccttatgatctccaggacgcctgaggtcacttgcgtggtcgtggacgtcagccacgaggaccccgaagtcaagttcaactggtatgtggacggtgtggaggtccataacgccaagactaaacctcgtgaggagcagtacaacagcacctaccgcgtggtgtctgtcctgacggttttgcaccaagactggctgaacggtaaggagtacaagtgtaaggtcagtaataaggcattaccggcccccatcgaaaaaaccatctcgaaggctaagggacagccgagagagcctcaggtctatacattgcctccgtcgagggaggagatgactaagaatcaggtctctctcacttgcctcgtcaagggcttctaccccagcgacattgctgtggaatgggagagcaacggccagccagagaacaattacaagacaacccctcccgtccttgacagcgacggatccttcttcttgtacagcaagctcaccgtggataaaagccgctggcagcagggaaacgttttctcttgctccgtgatgcatgaggcactgcataaccactacacccagaaaagtctgtcgttgtcgcctggaaag

SEQ ID NO: 15534 - DNA, 1467 bp, Artificial Sequence
  Description of Artificial Sequence: Synthetic coding sequence
atggcccctgtggcagtgtgggctgccttggctgtcgggctggaactgtgggccgccgcgcacgctttgcctgctcaggtggctttcaccccttacgcaccggaaccaggcagtacttgccggctgcgggaatactatgaccaaacggctcagatgtgctgcagcaaatgtagcccaggccagcatgctaaagttttttgtacgaaaacaagtgatactgtgtgtgactcctgcgaggattctacttacacccagctgtggaattgggtacctgagtgtctgagctgcggaagccgctgcagctccgatcaggtggagacccaggcctgtacacgggagcagaatcgtatctgcacctgccggccaggttggtattgtgcactgtcaaaacaagaaggttgcaggttatgtgctcctctgcgaaagtgcagacccggtttcggggtggcgaggcccgggaccgagacgtctgatgtggtttgtaagccatgcgctcctggcactttttccaacactacttcaagcaccgatatttgtcgccctcatcagatttgtaatgtagttgcgatccctgggaacgcatcgatggacgctgtgtgtacgtctacttccccaacacgcagcatggctccgggcgctgtgcatctcccgcagccagtgtcaactcgaagtcagcacactcagcccacccctgagccttcaacagccccctccacatcatttctactgccgatgggtccctcccctcccgcagagggctccacgggcgatgagccgaagtcttgcgataaaactcatacttgccctccatgtcccgcccccgagctcctgggggggccatcagtgtttctgtttccacctaagccaaaggacacattgatgattagccgcacccccgaagtgacctgcgtggtcgtggatgttagccacgaggaccctgaggtaaagtttaactggtatgtagatggagtagaggtgcacaatgccaaaaccaaacctcgggaggagcagtataactctacctacagagtggtgtcagtactgaccgtcctgcatcaggactggctgaatggcaaggaatataaatgcaaagtgtccaacaaagctctgcctgctccaatcgaaaaaaccatttctaaggcgaagggacagcctagagagcctcaggtttatacactgcctccctcacgagaggaaatgactaaaaatcaggttagtctaacctgtctggtgaagggcttttatccgtcagatattgccgtggagtgggagtctaatggtcagccggagaataattataaaacaacccctccagtgcttgacagtgacggcagtttttttctttattctaaattgaccgtcgacaagtccaggtggcaacaagggaatgtgttctcctgctccgttatgcatgaagccctgcacaatcactatacgcagaaatctctgagtttgagccctggaaaa

SEQ ID NO: 15535 - DNA, 1467 bp, Artificial Sequence
  Description of Artificial Sequence: Synthetic coding sequence
atggctccagttgcagtctgggctgctttagctgttggacttgaattatgggctgcagcacatgctttacctgcacaagttgcttttactccatatgctcctgaaccaggatcaacatgtagattgagagaatattatgatcaaacagctcaaatgtgttgttctaagtgttcaccaggacaacatgctaaagtattttgtactaaaacatctgatacagtttgtgattcttgtgaagattcaacatatactcaattatggaattgggttccagaatgtttatcatgtggatcaagatgttcatcagatcaagttgaaacacaagcttgtactagagaacaaaatagaatttgtacatgtagaccaggttggtactgtgcactttctaaacaagaaggatgtagactttgtgcaccattaagaaaatgtagaccaggattcggagtagcacgtcctggaacagaaacttcagacgttgtttgtaaaccatgtgctccaggtactttcagtaacactacttcatctactgatatttgtagaccacatcaaatttgcaatgttgtagcaattccaggtaatgcttctatggatgcagtttgtacatctacttcacctactagatcaatggccccaggagcagttcacttaccacaacctgtttctacaagatcacaacatactcaacctacacctgaaccatcaacagctccatcaacatcttttttacttccaatgggaccatcaccaccagcagaaggatcaactggtgacgaaccaaaatcttgtgataaaacacacacatgtccaccatgtccagctccagaacttttaggaggaccttctgtttttttatttcctccaaagcctaaagatacattaatgatcagcagaactccagaagttacttgtgtagtagtagacgtaagtcatgaagatcctgaagttaaatttaattggtatgttgacggggttgaggtgcataatgcaaaaactaaaccaagagaagagcagtataattctacgtatagagtggtttcagttcttactgtattacatcaagattggttaaacggaaaggagtataaatgtaaagttagtaataaagctttaccagcaccaattgaaaaaactattagtaaagctaaaggacaaccacgtgaaccacaagtgtatacattacctccaagtcgtgaagagatgactaagaatcaagtttcacttacttgtcttgttaaaggattctatccaagtgatattgctgttgaatgggagagtaatggacaaccagaaaataactataaaacaactcctccagttcttgattctgatggaagtttctttttatattcaaagcttactgttgataaatcaagatggcaacaagggaatgtttttagttgttcagttatgcatgaagctttacacaatcattatacacaaaaatcattatcacttagtcctggaaaa

SEQ ID NO: 15536 - DNA, 1467 bp, Artificial Sequence
  Description of Artificial Sequence: Synthetic coding sequence
atggctccggtggctgtgtgggctgcactcgctgtggggctggaactctgggccgctgcccatgctctgcccgcgcaagtagcttttaccccctacgcccctgagcccggaagcacctgcagacttagagaatattacgaccagaccgcgcagatgtgctgtagtaagtgctctccaggacagcatgcaaaggtgttctgcactaagacctccgataccgtctgtgacagttgcgaggacagcacatacacccagttgtggaactgggtgcctgaatgtctctcctgtggcagcagatgctccagtgaccaagtggaaactcaggcctgtactagagagcagaacaggatttgtacatgccggcctggctggtactgtgcattgtccaagcaggaagggtgtcgcctctgcgccccattgcggaagtgtaggcccggctttggtgtggcccggcctggtacagagacatcagatgtggtgtgcaagccctgtgcaccggggacattctccaacacaacctcgtctaccgacatctgtagacctcatcagatctgtaacgtggtcgccatccctggcaacgcttctatggatgctgtgtgtacatcaacgtcgcctaccaggagcatggctccaggagcagtgcacctcccccagccagtgagtacgagatctcagcacacacagccaacgcccgagcccagcacagctccctctaccagctttttacttccaatgggcccaagcccaccggcggagggatctacaggcgatgagcccaagagctgtgacaaaactcacacttgtcctccctgccctgctcccgaactcttaggcggacctagcgttttcctgttccctcccaagcctaaggacactctgatgatatccaggacccccgaagtgacatgtgtcgtggtcgatgtgtcacacgaggatccagaagtcaagttcaattggtacgtggacggggtggaggtccataacgccaagaccaaaccccgcgaagaacagtataactccacctatcgtgtagtttcagtcttgacagtgttgcaccaagactggctcaatggtaaggagtacaagtgcaaagtgtccaacaaggctctcccagcccccatcgagaagacaatcagcaaggcaaagggccaaccgcgcgagcctcaggtgtacactctgccgcccagtagggaagagatgacaaaaaatcaggtgtccctgacttgtctcgttaaagggttttacccaagtgacattgctgtcgaatgggagtctaacggtcaaccggagaacaattataagaccacaccaccagtgttggacagcgacggttctttcttcctctattctaagcttaccgttgataagagtcggtggcaacagggaaatgttttctcctgtagcgtgatgcacgaagccctccataatcattatactcagaagagcctgtccctgtcccccggcaag

SEQ ID NO: 15537 - DNA, 1467 bp, Artificial Sequence
  Description of Artificial Sequence: Synthetic coding sequence
atggcaccagtggcagtgtgggctgcccttgccgtgggtctggaactctgggcagcggcacatgcgctgccagcacaagtggcgtttactccctacgcccctgaaccgggttccacttgtagactcagggaatactacgatcagactgcacagatgtgttgctcgaagtgtagccctggccaacatgcaaaagtcttttgtaccaagacttcagataccgtgtgcgattcgtgcgaggacagcacttacactcagttgtggaactgggtgcccgagtgtctttcgtgtggatcgaggtgttcctcggaccaagtggaaacccaggcctgcactcgcgaacagaaccgcatttgtacgtgccgacctggttggtactgcgcactcagtaagcaagaaggatgtcgactctgtgcgccccttaggaagtgcaggcccggatttggagtcgcccggccaggaactgaaacctccgatgtggtctgtaaaccatgtgcccctggaaccttttcgaataccacctcgtcgactgacatttgtcgacctcaccagatttgcaatgtcgtggccattcccggcaacgcctcaatggatgccgtgtgcacttccacctcgcctactcggagcatggcacccggcgccgtccatcttccacagccagtgtcgacgagatcgcagcacactcagccaaccccagagccctccaccgcacccagcacctcgtttctcttgcctatgggacccagccctcctgcagaaggttccaccggggacgagcctaagtcgtgtgacaagactcatacctgtcctccttgtcctgcaccggagctgctgggagggccttcggtattcctcttcccaccgaaaccgaaggataccctgatgatctctcgtactccggaagtcacctgcgtggtggtggatgtcagccacgaagatccggaggtcaagtttaactggtacgtggatggtgttgaggtgcataatgctaagacgaagccacgagaagaacagtacaactcaacctacagagtcgtgagcgtgctgacggtgcttcatcaagattggctgaacggaaaggaatacaagtgtaaggtgtcgaataaggccttgcctgcaccaatcgagaaaacgattagcaaagccaaggggcagcctagagaaccacaagtgtatactcttcctccttcccgagaagaaatgaccaagaatcaagtctcgctcacctgtcttgtcaagggattttacccgtccgacattgcagtcgaatgggaatcaaatggccaacctgagaataactataagaccaccccgcccgtgcttgattcggatggatcgttttttctgtactcaaaacttaccgtcgacaagtcgcgatggcagcagggtaacgtcttttcctgctcggtgatgcacgaagcactgcataaccactacacccagaaatccctctccctttcaccaggtaaa

SEQ ID NO: 15538 - DNA, 1467 bp, Artificial Sequence
  Description of Artificial Sequence: Synthetic coding sequence
atggctcctgtggctgtgtgggctgcgctagctgtgggacttgaactctgggctgccgcgcacgccctgcccgctcaggtggcattcactccttacgctccagaacctggatccacttgtaggctgagagaatactatgatcagacagcacagatgtgttgttccaaatgctctcctgggcagcacgcaaaagtgttttgcactaaaacatccgacacagtgtgtgattcttgcgaagattccacatacacacagttatggaactgggtccccgaatgtctgagttgcgggtcccggtgctcctctgaccaagttgaaacacaagcttgtacacgcgaacaaaacagaatatgtacatgtagacctggatggtactgtgcactctctaaacaggaagggtgcagattatgtgcccctcttagaaaatgccgcccaggattcggagtagccagaccagggactgaaacatctgatgtagtgtgtaagccctgtgcccccggaacattttccaatacaacaagttctacagatatctgtcgccctcaccagatctgtaacgttgtggcgatacctggaaatgcctctatggacgccgtctgcacaagtacatctcccactaggtcaatggctcctggggctgtgcatctgccccagcccgtttccactcggtcacagcatactcagccaacaccagaaccctccacagccccctcaacttcctttctcctcccaatgggacccagtccacctgcagaagggagtactggagatgaacccaaatcatgcgataaaactcatacatgccctccatgcccagcacctgaactactggggggaccctcagtttttctctttcccccaaagccgaaagatacactcatgatctcacgaacacccgaagtcacgtgtgtggtggttgacgttagtcatgaagatcccgaggtcaagtttaattggtatgttgatggggtcgaagtacataacgctaaaacaaaaccgagggaagaacagtataattccacttatcgcgtggtgtccgtgctcactgtacttcaccaggattggctcaacgggaaagagtacaaatgcaaagtgtccaataaagctctaccagcacccattgagaaaactatttctaaagccaaagggcagcctcgggaacctcaggtgtacactctgcccccttcaagagaagagatgactaaaaatcaagtttcactcacatgtctcgtgaaaggattttatccctccgatatcgccgtcgaatgggaaagtaatgggcagccagaaaacaattacaaaactactccccctgtgctggattccgatgggagtttctttttatattctaaattgacggtagacaaatctcgctggcagcaggggaatgttttttcttgctccgtgatgcacgaggctctgcacaatcattatacacagaaatccttgtcactttctcccggaaag

SEQ ID NO: 15539 - DNA, 1467 bp, Artificial Sequence
  Description of Artificial Sequence: Synthetic coding sequence
atggctccggtagctgtgtgggctgctctggcagtgggtttggagttgtgggcagccgcccacgcacttccagcccaagttgctttcaccccctatgcacccgagcctggctctacgtgtaggttgcgggagtactacgaccagactgcacaaatgtgttgcagtaaatgcagccctggccagcacgcaaaagtgttctgcaccaagacctctgatactgtgtgcgacagctgcgaagactcaacctacacacagctgtggaattgggtccccgaatgcctgagttgcggctcacggtgcagcagcgaccaggtcgaaacccaggcgtgtacccgcgagcaaaaccggatttgtacctgtaggcctggctggtattgtgccctgtctaaacaggaaggctgtcggctgtgtgcaccactgcggaagtgtagacccgggttcggggttgcccgaccgggcacagaaaccagtgatgtggtttgcaagccgtgtgctcccggcactttctcaaacacaacctcttccacagacatatgtagaccgcaccagatttgtaatgtggtcgctatccccggcaatgcctccatggatgccgtctgtactagtacgtccccaacgcgatctatggcacccggcgccgtccacctgcctcaacctgtctctacccgctcacaacatacgcagccgacccccgagcccagcaccgctccttcaactagttttttactgcccatggggccctccccccctgccgaagggagtacaggcgatgaaccaaagtcttgcgacaagacccatacctgccctccttgtcctgcaccagaattgttgggtggaccctccgtctttctcttcccccctaagcctaaggacacacttatgattagcagaacccccgaggtcacctgcgttgtggtggatgtgtctcacgaggaccctgaggtcaagttcaactggtatgtggacggcgtagaggtccacaacgccaaaactaaacctagagaggaacagtataactcaacctatagggtggtctcagtactcaccgtgttacatcaggattggctcaacgggaaggaatataagtgtaaagtgagcaacaaggctctgcctgcacccatcgaaaagaccataagtaaggctaagggacagccccgggaaccgcaggtgtacacgctgccaccttcaagagaggaaatgaccaaaaaccaggtgagtttaacttgcttagtaaagggcttctatccgagtgacatcgccgtggaatgggagagcaatggtcagccagagaacaactataagacaacaccgcctgtgctcgactctgatgggtctttttttctgtactccaaactcactgtggataagagccgctggcagcagggaaacgttttcagttgtagtgttatgcatgaagctctgcataatcactatactcagaaatccttatcactgtctccaggaaaa

SEQ ID NO: 15540 - DNA, 1467 bp, Artificial Sequence
  Description of Artificial Sequence: Synthetic coding sequence
atggccccagtcgccgtgtgggcagccctggcagtcggactggaactgtgggctgcagcacacgctcttcctgcgcaggttgcctttaccccttatgcacccgaacctggctcaacttgtagacttagagaatactacgaccagactgcacagatgtgttgttccaagtgttcacccggacaacatgcgaaagtgttttgtaccaagacttcggacactgtgtgcgattcctgtgaagattcgacgtatactcaactgtggaattgggtgcctgagtgtctgagctgtggttcgagatgttcctcggatcaggtggaaactcaagcatgtacccgagagcagaataggatatgtacctgtagacctgggtggtactgtgctctgtcgaaacaggaaggatgtagactgtgtgctccccttcggaagtgtagacctggatttggagtggcaagaccgggaaccgagacttccgatgtggtgtgcaagccctgtgcacccggcactttttccaatactacctcgagcaccgacatttgccgccctcatcagatctgcaatgtggtggccatccctgggaacgcctccatggatgcagtctgcactagcacttcgccaacccgctcaatggcacctggagcggtccatctgcctcagccagtgtccactcgttctcaacatacccaacctaccccagagcccagcaccgctccttctacctcgttcctgcttccgatgggtccttcaccgccagccgaaggctccacgggcgacgagcctaaatcctgtgacaaaacgcatacctgtccaccttgtcctgctcctgaactgcttggaggaccatcggtgtttcttttccccccaaagcctaaagataccctgatgattagcaggactccggaagtcacctgtgtggtggtggatgtctctcacgaagatcctgaggtgaaattcaattggtacgttgacggggtggaagtgcataacgcgaaaacgaaacccagggaagaacaatacaactcgacttaccgggtcgtgtctgtccttactgtgctccaccaagattggctgaacggcaaggaatacaaatgtaaggtttccaataaagcgctgcctgcccctattgaaaagactatttcgaaagcaaagggacagccgagagaaccccaagtgtacactcttcctccaagccgggaggaaatgaccaaaaaccaagtctcccttacttgtcttgtgaaggggttctacccttccgatattgcagttgagtgggagtcaaacggacagcctgagaataactacaagaccacgccaccagtcctggattcggatggatcgtttttcctttacagcaagttgactgtggataagtcacgttggcaacaaggtaatgtgttttcgtgcagcgtgatgcacgaagccctccataatcattacacgcaaaagtcactgtcgctcagccctggtaag

SEQ ID NO: 15541 - DNA, 1467 bp, Artificial Sequence
  Description of Artificial Sequence: Synthetic coding sequence
atggccccagttgctgtctgggctgctctcgccgtcggcctggaattatgggcagccgcccacgccctaccagcccaggtggcattcactccatacgcacctgaaccgggctcgacatgccggcttcgggagtactatgatcaaaccgcccagatgtgttgctccaagtgctcgccgggccagcatgccaaggttttctgcacgaagacctcagatacggtgtgtgattcgtgtgaagactcgacgtacacccagctttggaactgggttccggagtgcctgagctgcggttcgagatgctcctcggaccaagtggagactcaggcttgtacacgcgagcagaaccggatttgcacctgccggcctggctggtactgcgcactgtcgaagcaggagggatgtagattgtgcgctcccttgcgcaagtgtcgaccaggcttcggcgttgctcgcccaggcacggagactagcgatgtcgtctgcaagccatgcgcgcccggtacgttctccaatactacgtccagtaccgacatttgccgcccccatcaaatatgtaacgtggtggccatcccgggtaacgcttcgatggatgccgtttgcaccagtaccagccctactcgatccatggccccaggggcggtgcacctaccacagcccgttagcacccgcagtcaacacacacaacccaccccggagccaagcaccgccccatccacgagttttctgttgccaatgggaccaagtccacccgccgagggcagcaccggagatgagccaaagtcttgtgacaagactcacacgtgcccaccctgcccggccccagagctgctaggcggaccgtcggtcttcttgttcccacccaaaccgaaagatactttaatgatcagccgcacgcccgaggtcacgtgcgttgttgtcgatgtgtcgcacgaggatcctgaggtcaaatttaactggtacgtggacggcgtggaggtccataacgccaaaaccaagccacgcgaggagcaatacaatagcacctatcgcgtggtctccgtactgacggtactgcaccaagactggctcaacggcaaggagtataagtgcaaagtgtcgaataaggcccttccagcaccgatagaaaagaccatatcaaaagcaaagggtcagccgcgagaaccccaagtgtatacattaccaccttcacgagaggagatgacgaagaaccaggtatcgctaacatgtctggtcaagggcttctacccatcagatatcgccgtggagtgggaatcgaacggccagccggagaacaattacaaaacgactccgccggtcttagacagcgacggctccttctttctatattcaaagctgaccgtggacaagtcgaggtggcaacagggaaacgtcttctcgtgtagcgttatgcacgaagccctgcataaccattacactcaaaagagtctgagtctgtcgccaggtaag

SEQ ID NO: 15542 - DNA, 1467 bp, Artificial Sequence
  Description of Artificial Sequence: Synthetic coding sequence
atggctcccgtcgccgtgtgggctgcgctcgcagtgggcctggagctgtgggccgccgcgcacgccctgccagcacaggtggcgtttaccccgtatgcgcctgaacccggctccacgtgcaggctgcgggagtactacgatcagaccgcccagatgtgctgctctaaatgctcacccgggcagcacgccaaggtgttctgcactaaaaccagtgatacagtctgcgacagctgcgaagattcaacttatactcaactgtggaattgggtccccgaatgcctgtcatgcggtagcaggtgcagtagcgaccaggtcgaaacccaggcatgtactagggaacagaatcggatctgtacctgcagacccggttggtattgcgcactgtccaaacaggaggggtgccgattgtgcgcgccactcaggaagtgccgccctgggttcggagtggcccggccaggaaccgagactagtgatgtggtttgcaaaccctgtgcccctggaaccttctcaaataccactagttccacagacatctgccgcccgcaccaaatttgcaatgtggttgctatccctggcaacgcttccatggacgcagtctgcactagcacatcacctacacggtccatggctccaggggccgttcatctccctcagccagtgagcacgaggtcccagcatacgcagcctacccccgaaccatccactgcgccttctacgagcttcctcctgcccatggggccaagtccacccgctgagggcagcactggcgacgagcccaagagttgtgacaaaacacacacgtgtccaccttgcccagcccctgagcttctgggtggcccgagtgtcttcctcttccctcccaagccaaaagatactttgatgatctctcgaacccctgaggttacatgtgtggtcgtggacgtttcacacgaggatcctgaggtaaaattcaactggtatgtggacggcgtggaagtgcacaacgccaagactaaaccgagggaggaacaatacaactccacatatcgcgtagtttctgtgctgactgtgcttcatcaggactggctcaacggtaaggagtataagtgcaaggtatccaacaaggcactgcctgccccgattgagaagacaatcagtaaggccaaggggcagcccagagagcctcaggtttataccctccccccctccagggaagagatgacgaaaaaccaggtgtcccttacatgcttggtgaaagggttttatccaagtgatatcgcggtggaatgggagtccaatggtcaacctgagaataattataagaccaccccaccagtgctggacagtgacgggtccttttttctgtattctaaactgacagtggacaagtctcgctggcagcagggtaatgtcttttcctgcagcgtcatgcacgaggcactgcacaatcactacacccaaaagagtttgtccctgtccccaggaaaa

SEQ ID NO: 15543 - DNA, 1467 bp, Artificial Sequence
  Description of Artificial Sequence: Synthetic coding sequence
atggctcccgtggctgtttgggcggctctggcagtaggcctggagctgtgggcagctgctcatgccctgcctgcccaggttgcattcaccccctatgcacctgagcccggtagtacttgtcggctacgggagtactacgatcagacagcacaaatgtgctgttcaaagtgttccccgggtcagcacgccaaagtgttctgtacaaaaacgtctgatactgtttgcgactcctgcgaggattcaacatacacccagctgtggaattgggtgcctgagtgtctgtcttgcggatctcggtgttcctcggaccaagtagagactcaggcttgtacaagggaacagaatagaatctgtacttgtcggcctggctggtactgtgcactgagcaagcaggagggttgtagactatgtgcacccctgagaaagtgtcgcccaggcttcggtgtggctagacctggcactgagacttctgatgttgtatgtaagccttgtgcccctggtacatttagcaacactaccagttctaccgacatttgccgcccacatcagatttgcaacgtggtcgcaattccaggcaacgcctcaatggacgccgtgtgcactagcactagtccgacaagatctatggcccctggcgctgtccatctaccgcagcccgtatcaacaaggagccagcatactcagcctaccccggagcccagcactgcaccgtcaacctcctttctcctccctatgggccccagcccaccagctgagggcagcaccggggacgagcccaagagttgcgataaaactcatacttgccccccctgtccggccccagaattgttgggaggaccatcagtcttcctatttccgccaaaaccaaaagacaccctcatgataagcaggacccccgaagtgacctgtgtcgttgtggacgtgtcccacgaggacccagaagtgaagtttaattggtacgtggacggcgtggaggttcacaacgccaagactaaaccacgggaggaacagtacaatagtacttatagggttgtgtccgttctgactgttctgcaccaggattggctcaacggtaaagaatataagtgtaaggtgtctaataaagcccttcccgcccctatagagaagacaatcagtaaggccaaagggcagccccgggagccacaggtgtataccctgcccccgtcccgagaggaaatgactaaaaaccaagtaagcctaacttgcttagtcaagggattttatccgagcgatatagccgtggaatgggaaagcaacggccagcctgaaaacaactataagacaactcctcccgtgctagacagtgatggttcattctttctgtatagtaagctgacagtggataaaagccgttggcagcagggcaatgtgttctcgtgtagtgtgatgcatgaagccctccacaatcactacacgcagaagtccctgagtttatctcccgggaaa

SEQ ID NO: 15544 - DNA, 1467 bp, Artificial Sequence
  Description of Artificial Sequence: Synthetic coding sequence
atggctcccgtggccgtgtgggctgccctggcagtggggctcgagctttgggctgccgcccacgccttgccggcccaagtggccttcaccccatacgcacccgagcctggtagtacatgcaggctaagagaatactacgaccagacagctcagatgtgttgttctaaatgctctccagggcagcacgctaaggtcttctgcactaagacatccgataccgtctgcgacagctgtgaggattcgacctacacccagctgtggaattgggtgccggaatgcctcagttgcggatctagatgctcgtcagaccaggtggaaacccaggcgtgcacacgtgaacagaaccgcatatgtacgtgcagacctggctggtactgtgccctctctaaacaggagggctgcagattgtgcgcccctctgcgtaagtgccgccctggatttggtgtcgcaagacctgggacagagaccagcgacgtggtctgtaagccgtgcgctcctggcacctttagcaataccacttcttccacagacatatgccggccccaccagatctgcaatgtggtagcgattcccggcaatgcctctatggacgccgtatgtaccagcacttctccaacccgaagcatggcgcctggggcggtgcatctgcctcaacccgtctcaacaaggtctcagcatacccagccgacacccgaaccaagcaccgcgcccagcacttccttcctgcttcctatgggaccaagccctcctgcagagggtagcacaggggatgagcccaagagttgcgacaagacgcatacctgccctccttgtcccgcccccgagctgttagggggacctagtgtgttcttatttcctcctaaacccaaggacacactaatgatctctcgaactccagaagtaacttgtgtggtggtcgacgtttcccacgaggatcccgaggtaaaatttaactggtacgttgacggtgtggaggtgcacaacgcaaagaccaagccccgcgaggagcagtacaactcgacctatcgcgtggtgagtgtcctaacggttctccatcaggactggttaaatggtaaggagtacaaatgtaaagtgtcaaacaaggctctgccggcccccatcgagaaaaccatatccaaggccaagggacagcccagagaaccacaggtgtataccctgcccccctcaagggaggagatgaccaaaaaccaggtaagtctgacgtgcttggtgaaaggattctaccctagtgatatcgcagtagagtgggaatccaacgggcagccggagaacaactacaagacaacacctcccgtgctggactctgacgggagtttctttttgtatagcaaactgacggtggacaagtctcggtggcagcaggggaacgttttctcttgctctgtcatgcatgaggctctacataaccactacacgcagaaaagcctttctctttctccaggaaag

SEQ ID NO: 15545 - DNA, 1467 bp, Artificial Sequence
  Description of Artificial Sequence: Synthetic coding sequence
atggctccagtcgccgtgtgggctgcattagccgttggtcttgagttgtgggctgcggctcatgcgttgccagcccaggtcgccttcaccccctacgcccccgagcctggctcgacatgtcgcctccgtgagtattatgaccagaccgcgcagatgtgctgtagcaagtgctcccctggtcagcatgctaaagtcttctgcaccaagacaagcgatacggtgtgtgacagctgtgaagattcaacttatacccagttgtggaactgggtgcccgaatgcctgagctgtgggtcccggtgttcctccgatcaagtggaaacccaggcttgtacaagagagcaaaaccgtatatgtacctgccgacctggatggtattgcgcattatccaagcaggaggggtgtcgtctgtgcgctcctctcaggaagtgtagacctgggttcggcgttgctaggccaggcacagaaacaagcgacgtagtgtgcaagccctgtgctccgggaacatttagcaacaccacctccagcaccgacatctgcagaccacatcagatctgcaacgtcgttgcaataccggggaatgcttcaatggacgcagtatgcacctcgacatcccccaccaggtctatggccccgggagcagtccacctgcctcaaccagtgtctacaagaagtcagcacactcagccaacacccgagcccagcacagctccgagcactagttttctgttaccgatgggcccatctccaccagccgaagggagcaccggggatgaacccaaatcttgtgacaagacccacacttgccccccctgccctgctcccgagctgcttggcggaccatcagtgttcttgttccctcccaaaccaaaggacactctgatgatttcgcgtaccccagaggtgacgtgcgtggtggtcgatgtgtcccacgaagatccagaggtgaagtttaactggtacgtggacggagtggaagtgcacaacgccaagaccaagcctagagaggaacagtataattcaacataccgggtcgtgtctgtcctcacagtactgcaccaggactggttgaacggaaaggagtacaaatgcaaggtgagcaacaaagccttgcccgcccctatcgagaagacaatcagcaaggcaaagggccagccccgggagcctcaggtctatacacttccaccatccagagaagagatgaccaaaaaccaggtatccctgacttgcctggtgaaaggcttttacccatccgatatagcggtcgagtgggaaagcaacgggcagccagagaacaactacaagacaaccccacccgtgctggattctgacggatcattttttctctattccaaattgactgtggacaaatcacgatggcagcagggcaatgtcttcagttgcagtgttatgcatgaagccctacacaaccactacacacagaagtctctgagcttgtcccccgggaaa

SEQ ID NO: 15546 - DNA, 1467 bp, Artificial Sequence
  Description of Artificial Sequence: Synthetic coding sequence
atggccccggtcgcagtttgggccgccctggccgtcggattggagctgtgggcagctgcgcacgcgctgccggcgcaggtggcgttcactccgtacgcccctgagcctggatcgacttgcagattgcgggaatactacgaccaaactgcccagatgtgctgctctaagtgttcaccaggacaacacgctaaggtgttctgcactaaaactagcgacaccgtgtgcgactcctgcgaggactcaacctacacccagctttggaactgggtgccagaatgtctgtcctgcggatcccgctgctccagcgaccaggtggaaactcaggcctgcactcgcgaacagaacagaatctgcacgtgccgacccggttggtattgcgcactgtcaaagcaggaaggatgtcgcctctgtgcgccgctcaggaagtgccgcccgggcttcggggtcgcacgcccgggaaccgaaactagcgatgtggtctgcaagccatgtgcacctgggaccttttcgaataccacttcgagcactgacatctgccgccctcatcagatctgcaacgtcgtcgccatccctggtaacgcttccatggatgctgtgtgtacttctacctccccgactcggtccatggcccccggagctgttcacctgccgcagccagtaagcacgcggtcgcagcacacccagcctactccggagccgtctactgcgccatctaccagcttcctgctcccgatggggccatcgccacccgccgaagggtcaactggcgacgagcctaagtcatgcgataagacccacacctgcccgccttgccctgccccggagctcctgggcggaccatcggtgttcctgttcccgcctaagccgaaagacactcttatgatctcccggaccccggaggtcacttgcgtggtcgtcgacgtctcacacgaggatccggaagtgaaattcaattggtacgttgatggagtggaagtgcacaacgcaaagaccaagccgcgggaagagcagtacaactcaacttatcgtgtggtgtccgtgctcaccgtcctgcatcaagactggctgaacggaaaagagtataagtgcaaagtcagcaacaaggccttgcctgcgccgatcgagaaaactatttcgaaggcaaagggtcaaccgcgcgaaccgcaagtctacaccctgccgccctcgcgtgaagagatgactaaaaatcaagtgtccttgacctgcctcgtgaagggattctacccaagcgatatcgcagtcgaatgggaatccaatggacagcctgagaacaattacaagaccactccgccagtgttggattcagacgggtcgttctttctgtactcaaagttgactgtggataagtccagatggcagcaaggaaacgtcttcagctgctcggtgatgcacgaggccttgcataaccactatacccaaaaaagcctgtcactttcgccgggaaag

SEQ ID NO: 15547 - DNA, 1467 bp, Artificial Sequence
  Description of Artificial Sequence: Synthetic coding sequence
atggctcccgtcgccgtctgggctgcactggcagtcggactggagttgtgggcagctgctcacgctctgcccgcacaagtagcattcaccccatacgcaccagagccaggttccacttgccgtttgagagagtactacgatcaaactgcccagatgtgttgctcaaaatgtagtcctggtcaacacgctaaggtgttttgcacaaagacatccgacacagtttgtgacagctgcgaggacagcacatatacccaactttggaactgggtgcctgaatgcttgagttgcggcagtcgttgttcttccgaccaggtggagacacaagcatgcactagggagcagaaccgtatctgtacttgcaggcccggttggtactgcgccctgagcaagcaagagggctgccgcctgtgtgcccccctgagaaagtgtagacccggcttcggagttgctcgtccaggaaccgagactagcgatgtcgtatgtaaaccttgtgctcctggcactttctcaaacactacatccagtacagacatctgcaggccacatcaaatttgcaacgtcgttgccattcctggaaacgcatccatggacgccgtctgcaccagcacttcacccaccagaagtatggcccctggcgctgtgcacttgcctcagcctgtgtcaacacgctcccagcacacacagcccacaccagagccaagcaccgcccctagtacctctttcttgctcccaatgggcccctctccacctgccgaaggatccacaggtgatgaacccaagagttgcgacaaaacacacacatgtcccccatgtccagctccagaactccttggaggaccctctgtattcctgtttccacccaagcccaaggataccctcatgatatccaggacccctgaagtcacctgcgtggtggtagatgtgtcccacgaggaccctgaagtcaagtttaactggtacgtggatggagtcgaggtgcacaacgctaagacaaaacctagagaggagcaatataatagcacatatcgcgtggtttccgtcctcaccgtgctgcatcaggattggctcaatggcaaggagtacaagtgtaaggtttccaacaaggctcttcccgcccctatcgagaagaccatttctaaagccaagggacaacccagggagccacaggtatacactctgccacccagccgtgaggagatgactaaaaatcaggtgagtctgacctgtctcgtgaaaggcttttatccctccgatatcgcagtcgaatgggagagtaatggacagccagaaaataactataaaaccaccccccccgtgctcgactctgacggttcttttttcctgtatagcaagctcacagtggataagtccagatggcaacagggaaatgtgttctcttgctcagttatgcacgaagcacttcacaaccactacacacaaaagtcactgagcctgagtcctggcaag

SEQ ID NO: 15548 - DNA, 1467 bp, Artificial Sequence
  Description of Artificial Sequence: Synthetic coding sequence
atggccccagtggccgtgtgggctgccctagccgttggcctggagctctgggccgctgcacatgctcttccagctcaagtggctttcactccttatgcccccgagcccggaagtacctgccgtttacgcgaatattacgatcagactgcacagatgtgttgttctaagtgctccccaggccagcatgctaaagtgttctgcacaaagaccagcgatacagtctgcgactcttgcgaggacagtacctatacccagctgtggaattgggttcccgagtgtctgtcatgtggatcaaggtgttcctccgatcaagttgaaacccaggcctgcacacgagagcaaaacaggatttgtacctgcaggcccggctggtactgcgccttaagcaagcaggaaggctgtcggctgtgcgccccactgcgtaagtgcaggccaggcttcggcgtggctcgtcccggaacagagacatctgacgttgtctgtaaaccttgtgcaccaggcacatttagcaacaccaccagctccaccgacatatgtcgcccacaccagatttgtaatgtggtagccatacctggcaacgctagcatggatgccgtgtgtacctcaaccagccctacacggtcaatggcaccgggtgctgtgcatctccctcaaccagtgagcacacggagtcagcatacacagcctacaccagagccttctactgcccctagcaccagtttcctgttgccaatgggacccagcccccccgccgagggctcaactggcgacgaaccaaagtcctgcgacaagactcatacttgcccaccctgtccggctcccgaactactggggggccccagcgtgtttctgttcccaccgaagccaaaagataccttgatgatttccaggacccccgaggtgacatgcgtggttgtcgatgtgagtcacgaggaccctgaggtgaagtttaactggtacgtggacggggtcgaagttcacaacgctaaaaccaagccaagggaagaacaatataattctacttatcgggttgtttccgtgttgactgtgctgcatcaggactggctgaatggcaaagagtataaatgcaaagtgtccaataaggccctgccagctcctattgaaaagaccatatcaaaggctaaaggacagccacgggaaccccaggtgtacaccttaccaccatcccgggaggagatgaccaagaatcaggtctctctgacatgtctggttaagggtttctatccatcagatatagcagttgaatgggagagcaatgggcaaccagagaacaactataaaaccacccccccagtcctggattctgatggctctttctttctgtactctaaactgactgtggataagtctagatggcagcagggaaacgtgttcagctgctctgtcatgcacgaggccctgcacaatcattatacacagaaatctctatccttgtcccccggaaag

SEQ ID NO: 15549 - DNA, 1467 bp, Artificial Sequence
  Description of Artificial Sequence: Synthetic coding sequence
atggcacccgtggcagtctgggcggcattggctgttggactggagctgtgggctgctgcccacgccctgcccgctcaagtggctttcactccctatgcccccgaaccaggctctacctgtcggctaagggagtactatgaccaaaccgctcagatgtgttgttcaaagtgttcccctgggcaacacgcaaaagtattttgtaccaaaacatctgacacagtgtgtgattcatgcgaagactccacatacacccaactttggaactgggtgcctgagtgtctgtcatgcggatccaggtgcagttctgaccaggtggaaacacaagcttgcacgcgcgaacaaaatagaatttgtacctgtcggcctggttggtattgtgcgctgagcaagcaagagggctgtcgcctttgcgcccccttgcggaaatgccgcccaggtttcggagttgcacgaccaggaacagagaccagcgacgtcgtttgtaagccctgtgcccctggaacttttagcaacactacctcgagcaccgacatctgcaggcctcaccagatctgtaacgtcgtcgcaatccccgggaatgctagtatggacgctgtgtgcaccagtacatctcctacacgatccatggcaccaggagccgtccacctgcctcagccagtaagtactaggagccagcacacgcagcctaccccagagccttccacagccccttccacctcattcctcctgccaatgggcccttccccaccagcggaaggttctacaggagacgagccaaagtcttgtgacaagacccacacatgtccgccctgccctgctccagagctactggggggcccatctgtcttcctgttcccgcccaaacccaaggacaccctgatgataagcaggacccctgaggtcacatgtgtggttgtggacgtttcacacgaggaccctgaagtgaagtttaattggtacgtcgatggggtcgaggtgcacaacgctaagacaaagcctagagaggaacagtacaattctacataccgcgtggtttctgtgttgactgtgttgcatcaggactggctcaatggaaaagagtacaaatgcaaggtctccaataaagctttgcctgctccaattgaaaagacaatcagcaaagccaaggggcagcccagggagcctcaagtgtatacccttccgccgtcccgggaagagatgaccaaaaaccaggtgtcactgacctgtctggtcaagggcttctatccatcagacattgccgttgagtgggagtccaacggccaacccgaaaacaactataaaacaactcctcccgttcttgactcggacggatctttcttcttgtacagcaagctgacagtagataaatcacgctggcaacagggaaatgttttcagttgttccgttatgcatgaggctctacacaatcactacacacaaaagtccctgtccctgagccctggaaag

SEQ ID NO: 15550 - DNA, 1467 bp, Artificial Sequence
  Description of Artificial Sequence: Synthetic coding sequence
atggccccagtggccgtctgggcagcactcgccgtagggctcgagctatgggccgcagctcatgctctgcctgcccaggtggctttcactccgtacgcccccgaaccaggatctacttgtcgcctgcgagagtactatgatcagacagcccagatgtgctgcagcaaatgttcgcccggacagcatgcaaaagtgttttgcacgaaaacctcagacacagtatgcgattcttgcgaagactctacctatacccagctttggaattgggtccccgagtgcctgtcatgtgggtccagatgcagttcagatcaggtggagacacaagcgtgcaccagggaacagaacagaatctgtacttgcaggcctggctggtattgcgccctctcaaagcaggaaggctgccgactctgcgcgcccttaaggaaatgcaggcccggattcggcgtggcccggcccggaactgaaacttccgacgtggtttgcaaaccctgcgccccagggacgttttccaacactacctccagcaccgacatctgccggccccaccaaatatgtaacgtagtggccatcccgggaaacgcgtcaatggacgctgtgtgcacaagtaccagccctactcgctctatggctcctggagccgttcatctgcctcaacccgtctccaccaggtctcagcacacccagccaacccccgaaccttcaactgcgccatcgacgagtttcttattgcccatgggcccctctcccccggctgagggctccacaggagatgagcccaaatcctgtgacaagacgcatacttgtcctccttgtccggcccccgagctgttaggcggcccgtcagtttttttgttccctccgaagcccaaagacacactgatgattagtcggacccctgaggtgacatgcgtggtggtagacgtttcccacgaggatcctgaggtgaagttcaattggtatgtggatggcgtcgaggttcacaatgcaaagacaaaacccagggaggagcagtacaatagtacgtatagggtggtgtcagtcctgacagtgttgcaccaagattggctgaatggaaaggagtataaatgtaaggtcagcaacaaagccctgcctgcccccattgaaaagacgatttcgaaagcgaaaggccagcccagagagccacaggtgtacaccttgcccccgtcgcgtgaagaaatgaccaagaatcaggtcagcctgacctgtttggttaagggcttttaccctagtgacatcgctgtggaatgggagtcaaacgggcagcccgaaaacaattacaagactacccctccggtattagattcggatggcagctttttcctttatagtaagctgaccgtagacaagtcgaggtggcagcagggcaacgtcttcagttgtagcgtgatgcacgaggccctgcataaccactatacccaaaagtctctgagcctaagtccaggaaag

SEQ ID NO: 15551 - DNA, 1467 bp, Artificial Sequence
  Description of Artificial Sequence: Synthetic coding sequence
atggctcccgtggctgtgtgggccgcacttgcggtggggttggaactctgggctgccgctcatgccctgcctgcccaggtagcatttactccctatgccccggagcccggatcaacatgtagattaagagagtactatgaccagaccgcacagatgtgttgttctaagtgctcgcctggacagcacgcaaaagttttttgtacaaaaacatcagatacagtgtgtgacagctgtgaagacagcacttacacccagttatggaattgggtcccggaatgtctgagctgcggcagccgatgcagcagtgatcaggtagaaacccaggcgtgcactagagaacagaataggatttgcacttgcagacctggctggtactgcgccctatctaaacaagaaggttgcaggctctgtgcccctctccgaaagtgcaggccaggatttggggtcgccagacctggcacagaaacctccgatgttgtgtgtaagccctgcgctcccgggacatttagtaacacaactagctctaccgacatttgtagaccccaccagatatgcaatgtggtggccatacccggcaatgcctccatggatgctgtctgcacctcaactagcccgacacggagcatggcccctggggcggtgcatctgccccagcccgtatctacccgaagtcagcacactcaacctacaccagagcctagcaccgcgccctcaaccagttttctgctgcctatgggccccagtcccccagccgaaggcagcaccggggacgagcctaaaagctgcgataagactcatacctgtcctccatgcccagctccagagctgctggggggcccttccgtttttttgtttccgccaaagcctaaggacacgctgatgatctcacgaactcctgaagtcacatgtgtagtggtcgacgtctctcacgaagaccccgaggtgaagtttaactggtacgtggatggcgtggaagttcacaatgcgaagactaaaccccgagaggagcagtataactcaacctatcgagtggtaagcgtactgacggtcttgcaccaggactggcttaacggtaaggagtataaatgcaaggtgtccaataaggccctgcccgcacctatcgagaagactatttccaaggcgaagggtcagcccagagagccacaggtgtacacactccccccaagtagggaggaaatgaccaaaaaccaggtgagtttaacctgcctagttaaaggtttctacccaagtgatatagctgtggagtgggagtccaacggtcagccggagaataattataaaactactcctcccgtgctcgactcagacggctctttctttctgtacagtaagctgacagtggataagtcaagatggcaacagggcaatgtgttcagttgttccgtcatgcacgaagcacttcataaccactatacccagaagtccctgtctctttctcctggtaaa

SEQ ID NO: 15552 - DNA, 1467 bp, Artificial Sequence
  Description of Artificial Sequence: Synthetic coding sequence
atggcccctgtggccgtgtgggccgctctagcagtgggcttagagctctgggcagccgcgcatgccctccctgctcaagtcgcctttacaccctatgcgccagagcctggctccacctgtcgccttagggagtattacgaccagaccgcgcaaatgtgctgtagtaaatgtagtccagggcaacatgccaaggtcttttgcacgaaaacatctgataccgtgtgtgattcttgtgaggacagcacctatacccagctgtggaactgggttcccgagtgtctctcatgcggcagcagatgttcgagcgatcaggtagagacacaggcctgcacacgcgagcagaacagaatatgtacctgcagacccggttggtactgcgcactgagcaagcaggaaggttgccggctctgcgcccccctccgcaagtgcaggcccggttttggcgtagctaggcctggaaccgaaacatctgacgttgtgtgcaagccttgcgccccgggcacctttagcaacactacaagctccacggacatctgtcgaccccaccagatctgtaacgtggtggcaattcctggcaacgcctccatggatgcagtctgcacatcgacatcgccaacccgatctatggcccccggggccgtacacctacctcagcctgtgtccacacgcagccagcatacacagccaacacctgagccctccacagctcccagtactagctttctcctgcctatgggcccgagcccaccagcagagggaagcactggagatgagccaaagtcctgcgataaaactcatacctgtcctccctgtcccgccccagaactactagggggcccctcagttttcctgttcccacctaagccaaaggacacacttatgatatcacgcactccagaagtgacatgcgtggtggtggacgtcagtcacgaggaccctgaagtgaagtttaattggtacgtggacggagtcgaagtgcacaatgcaaagaccaaacctagagaggagcaatataactctacatatagggtggtgtccgtgctgactgtcctgcatcaagattggctaaatgggaaagagtataagtgtaaggtgtcaaataaggccctgcccgcaccgattgaaaaaacaatatctaaggccaaggggcaacctcgtgagcctcaggtttacacgctgcctccaagcagagaggagatgaccaaaaaccaagtcagcctgacttgccttgtaaagggcttttacccaagtgacattgcggttgaatgggaatctaacggccagccagagaataattacaaaaccaccccgcctgttcttgacagcgatgggtcttttttcctatattcaaagcttacagtggacaagagtcgctggcaacaagggaatgtattcagctgcagcgtcatgcatgaggccttacataatcactacacccagaaaagcctgagtctctcccccgggaag

SEQ ID NO: 15553 - DNA, 1467 bp, Artificial Sequence
  Description of Artificial Sequence: Synthetic coding sequence
atggctccggtggcggtgtgggcagcgcttgctgtcggactggagttatgggccgccgcacatgcgctgcctgcacaagtcgcatttacaccgtacgcgccggagcctgggagcacgtgtcggttaagagaatattacgaccaaactgcacagatgtgctgttctaagtgttcaccgggtcagcatgcgaaagtattttgcactaaaacatcagacacggtttgcgactcctgtgaagactctacatatactcaactgtggaattgggtccctgaatgcttgtcttgtgggtcccgttgctcgtcagatcaggtcgagacacaggcctgtacaagggaacagaatagaatctgcacgtgcagaccgggatggtattgcgcgttatcaaaacaggaaggatgccgcctgtgtgcgcctttaagaaagtgccgaccgggatttggggttgcccgcccgggaacggaaacatccgatgttgtctgcaagccttgcgcccctggcacattttctaatactacgagttccactgatatctgccgtcctcatcaaatctgtaacgtcgttgctatcccaggaaacgcgtcgatggatgccgtgtgtacttctacgtcacctacccgctctatggcgcctggagcggtgcatttgcctcaacctgtgagcaccaggagccaacatacacaaccgactccagaaccttcgacagcgccctcgacatctttcttgttaccgatgggccctagtccacccgctgaaggatcaacaggcgacgagccgaaatcgtgcgacaaaacacatacatgtccgccgtgtccagctccggaactgctaggaggtccaagtgtatttctttttccgcctaagcccaaggataccctgatgattagcaggaccccagaagtcacttgcgtcgtcgtggatgtgtcccatgaagatcctgaagtcaaatttaattggtacgtcgatggcgtggaagtccacaacgctaaaacaaagccaagggaagaacaatataactcaacttatcgcgtggtatctgtgctgaccgttctccatcaagattggcttaacgggaaagagtacaagtgcaaagtttcgaataaggcactgccggcaccgattgaaaaaacaatatcaaaggcaaaaggtcagcctcgggaacctcaagtctatacgttaccgccctcccgagaagaaatgacgaaaaatcaagtttctcttacttgcttagtgaagggtttttatccgtcagatatcgctgtagagtgggaatcaaacggccagcctgaaaacaactataaaactacgccgccagtcttggatagcgatgggtctttttttctgtatagtaaacttaccgtagataagtcgcggtggcagcaaggtaatgttttctcttgttcagtcatgcacgaggcactgcataaccattatacgcagaaaagcctatctctgagtccgggcaaa

SEQ ID NO: 15554 - DNA, 1467 bp, Artificial Sequence
  Description of Artificial Sequence: Synthetic coding sequence
atggcgcctgttgccgtttgggccgcactcgccgtgggcctggaactgtgggccgctgctcatgccctcccagctcaggtggcattcacaccttatgcccctgagccggggagtacctgccgcctgcgggaatactatgatcagaccgcgcagatgtgctgctccaagtgttcccccggccagcacgccaaggttttttgtacaaagacctccgataccgtgtgcgacagttgtgaagattctacttacactcagctctggaattgggtgccagaatgtctgtcatgcgggtcacgctgcagcagtgatcaagtggagactcaggcatgtacccgcgaacaaaaccgtatttgtacatgtcgacccgggtggtactgcgccctgtccaaacaggaggggtgcagactgtgcgccccacttagaaagtgcagaccgggatttggcgttgctcggcccggaacggaaacatcagacgtggtgtgcaagccatgtgctcctggaacttttagcaatacaacttcttcaacggacatctgtcgaccccaccaaatctgtaatgtagtggccatcccggggaacgctagcatggacgcagtttgcacctctacttcaccaaccagaagtatggcacctggtgcagtccatttaccacagccggtctccacacggagccagcacacccagcctacaccagagccatccaccgcaccgtcgacatcgttcttactacccatgggtccttccccaccagctgaagggtctacgggggacgaaccgaagtcctgtgataagactcacacatgtccaccttgccctgctcctgagctcctcggagggccgtcagtgtttctgttcccccctaagccaaaagacactctgatgattagccgaacacctgaagtgacctgtgtggtggtcgacgtctcacacgaggaccctgaggtgaaatttaattggtatgttgacggagtggaagtgcacaatgcaaaaacgaaaccaagggaagagcagtataattctacctatagggttgttagcgtcttgactgtgttacaccaggactggctgaacgggaaggaatataaatgtaaagtcagtaacaaggctctccccgcacccatcgagaaaaccatatcaaaggcaaaaggccaaccgcgcgaaccccaggtctacaccctgcctccgtcgcgggaggaaatgacaaaaaaccaggtgagtctgacctgcctggttaagggattctacccctctgatatcgcagttgagtgggagtccaatggccagcccgagaataattataaaactacacctcccgtcttggattctgacggtagcttctttctgtattcaaagttgacggtagacaagtctagatggcaacaaggcaatgtcttttcctgctccgtcatgcatgaggcgctccataatcattacacccagaagagtttatcactttctcctggaaag

SEQ ID NO: 15555 - DNA, 1467 bp, Artificial Sequence
  Description of Artificial Sequence: Synthetic coding sequence
atggcaccggtcgctgtttgggccgccctggcggtgggactggagctgtgggcagcagcacatgcactccctgctcaggttgctttcaccccgtacgctccggaaccgggctccacctgccggctgagagaatactacgaccaaaccgcacagatgtgctgctcgaagtgctcaccgggacagcatgccaaggtgttctgtacgaaaacctcggacactgtgtgtgattcgtgcgaggactcgacctacacccaactgtggaactgggtgccggaatgcctgagctgcggtagccggtgctcgtcggaccaagttgagactcaagcgtgtactcgcgaacagaaccgcatctgcacgtgccgcccgggatggtactgcgctctcagcaagcaggagggatgccggctttgcgccccactccgtaaatgccgccctggctttggcgttgctcgccctggtaccgagacttccgatgtcgtgtgtaaaccgtgcgccccaggaactttctccaacactacctcctctactgacatctgccgcccccaccagatctgtaacgtggtcgccatccccggcaacgcgtccatggatgctgtgtgcacctccacgtccccaactcgctccatggccccgggtgccgtccatctgcctcaaccggtgtcaactagatcgcaacatacgcagcctaccccggaaccatcgactgccccatcgaccagcttcttgctgccaatgggaccttcgccgccggcagaagggagcacgggcgatgagccaaagtcctgcgacaaaacccatacttgcccaccttgcccagcgccagaactgctcggcggacccagcgtctttctttttccgccgaagccaaaagataccttgatgatcagccgcacgcctgaggtgacctgcgtcgtggtcgacgtctcccatgaagatccggaagtgaagtttaactggtacgtggacggagtggaagtgcacaacgctaagaccaaacctagggaagaacagtataactcaacgtaccgcgttgtctcagtacttaccgtgttgcaccaagattggttgaatggaaaggagtacaagtgcaaagtctctaacaaggcactgccggcgccaatcgaaaagacgatctcaaaagccaagggtcagccaagagagccgcaagtctatacgctgccgccatcacgggaagaaatgactaagaaccaagtgtctctgacctgcctggtgaaaggattctacccatcagacatcgcagtggagtgggaatcgaatggccagccggaaaacaactacaagaccactccgccggtgctcgactcggatggttctttcttcctgtactcgaagctgaccgtggacaaaagccggtggcagcagggaaatgtgttctcctgctcagtcatgcacgaggccctgcacaaccactacacccagaaatccctgtcactctcaccagggaag

SEQ ID NO: 15556 - DNA, 1467 bp, Artificial Sequence
  Description of Artificial Sequence: Synthetic coding sequence
atggcacctgtggcagtctgggccgctcttgccgtgggccttgagctttgggcggccgcacacgcactcccagcccaagtggcctttaccccttacgcaccggagccgggttctacttgtcgacttcgggagtactatgaccagaccgcccaaatgtgttgtagtaagtgtagccctggtcagcacgctaaggtgttttgcaccaagacctccgatactgtgtgtgacagctgcgaagatagcacgtacacccagctttggaattgggtgcctgaatgcctctcctgtggctccaggtgttcgagcgaccaggtggaaactcaggcgtgcactcgggaacaaaacagaatctgtacttgtcgcccaggttggtattgtgcactgtcgaaacaggaaggctgtcgattgtgtgcaccactgcggaaatgtcgccccggattcggtgtggcaaggccaggaaccgagacttcagacgttgtatgtaagccttgtgcgcctggtactttctcgaacactacgtccagtactgatatatgccgcccccatcaaatttgcaacgtcgtggcaatccctgggaacgcatctatggatgcggtctgcacgtcgacgtcccctaccagaagcatggcaccaggagcagtgcatctgccacaacccgtgtcaacccgtagccaacacacccaacccactccggaaccaagcactgcaccttcaacctcgttccttctccctatgggcccatcccctcctgcagaggggtcaaccggggatgagcccaagtcctgtgataaaactcatacctgtcctccctgccctgcgcccgaattgctgggagggccatcagtgtttttgtttccccctaagccaaaagacacgctgatgatttcgaggacccctgaggtcacgtgcgtggtggtcgatgtgtcacatgaggatccagaagtaaagttcaattggtacgtagatggtgtggaagttcataatgcaaagactaagccccgcgaagaacagtacaactcgacctacagagttgtgtctgtgctgactgtcctccaccaggattggctgaacggcaaggaatacaaatgcaaggtgagcaataaggcacttccagctcccatcgaaaaaactatttcgaaagcaaaggggcaacctcgagaaccccaagtctacacccttccgccttcacgggaagagatgactaagaaccaagtgtccctgacctgtctggtcaaaggattttacccttcggacattgccgtggaatgggagtcgaacggacaaccggagaataactacaagaccaccccgcccgtcctcgactccgacggatcatttttcctgtactccaagctcactgtggataaaagcagatggcagcaagggaacgtctttagctgcagcgtcatgcacgaagccctgcataatcattacacccagaagtcccttagcctgtcgcccggaaag

SEQ ID NO: 15557 - DNA, 1467 bp, Artificial Sequence
  Description of Artificial Sequence: Synthetic coding sequence
atggcccccgtcgccgtgtgggcagccctggcggtgggactcgagctgtgggctgcagctcacgccctccccgcccaggtggcatttacgccctacgcccccgagcccggctcaacgtgtcgactgcgggagtattatgatcagaccgctcagatgtgctgctccaaatgctcccccggccagcacgccaaggtgttctgcacaaagacaagtgacactgtgtgtgactcttgtgaggactcaacgtacacgcagctgtggaactgggttcccgagtgcttgtcttgtgggtctcggtgtagtagtgaccaggtagagacccaggcatgtactagggagcaaaaccgcatttgtacctgcaggccaggttggtactgtgccctgagcaagcaggaaggctgcagactctgtgcccctctgcggaagtgccgaccaggatttggtgtggcaagaccgggaacggaaacaagtgacgtcgtgtgcaaaccttgcgccccgggcacattctctaatactactagctctactgacatatgtaggccgcaccagatctgtaacgtggtggccatcccgggcaatgcaagcatggatgccgtgtgtaccagtactagccccacgcgctccatggccccaggggccgtgcacctcccacagcccgtttccacacgaagccagcatacacaaccgacacccgagcccagcactgccccttccacatctttcctcttgccaatgggccccagtcccccagctgagggttctactggtgatgagcctaagagctgtgacaaaacacacacatgcccgccttgccccgcccctgagctcctgggaggtccatcagtattcctgttcccaccaaaacccaaggacacgctcatgatcagcagaacgcccgaggtcacctgcgtggttgttgacgtgagccatgaggaccctgaagtcaagtttaattggtatgtggacggagtggaagtgcacaacgcgaagactaaaccacgggaagagcagtacaacagtacctaccgcgtggtgtccgtgctgactgtattgcaccaggactggctgaacggtaaggagtacaagtgtaaggtaagcaacaaggccctccctgcaccgatagagaaaactatttcaaaggcgaaaggacaacccagagagccacaagtgtatacgctgccacccagtagggaggagatgaccaaaaaccaagtgtccttgacctgcctcgttaaggggttttatccttccgacattgctgtggagtgggagtctaatgggcaacctgagaacaactataagactacgccacctgtgctcgacagtgatggatcttttttcctgtacagtaagctgacagtcgacaaaagtagatggcagcaaggtaatgtcttctcctgcagtgttatgcatgaagcgctgcataaccactatacccagaagtccctgtctttgagccctgggaaa

SEQ ID NO: 15558 - DNA, 1467 bp, Artificial Sequence
  Description of Artificial Sequence: Synthetic coding sequence
atggcacccgtcgccgtctgggcagcactcgcagttgggctggaactgtgggcagcagcccatgcactccctgcacaggtggcatttaccccctacgcgcctgaacccggatcaacttgtaggctccgggagtactacgatcaaaccgcacagatgtgttgtagcaaatgttcaccagggcagcatgcaaaggtgttctgcaccaaaaccagcgatactgtgtgtgattcgtgtgaggattccacttacacccagctttggaactgggtgccagagtgtctgtcgtgtggatcgcgttgttcatcggatcaagtggaaactcaagcgtgcacccgcgaacagaaccggatttgcacgtgccggccagggtggtactgtgcactttcgaagcaggaaggatgtaggctttgcgcccctctgcgcaagtgtcggcctgggtttggagtggcccggccaggaaccgaaacctcggatgtagtctgcaagccttgtgcacctggaacgtttagcaacactacttcctcgaccgacatatgcagaccacaccaaatttgcaacgtggtggctatccctgggaatgcaagcatggatgcagtgtgtactagcacttcgccaactcgcagcatggcccctggagccgtccacctgccacaacccgtgagcacgagatcgcaacatacccagcctacccctgagccgtcgaccgccccatcgacctccttcctgctgcctatgggtccgtctccccctgcagaaggttccactggagacgaaccaaagtcgtgtgataagacccacacctgccccccttgtcccgcacctgaacttcttgggggcccatcggtgttcctttttccacctaagcctaaagatactcttatgattagcagaacccccgaagtcacttgtgtcgtcgtggatgtgtcacatgaggatccggaagtgaagttcaactggtacgtggatggtgtggaagtgcataatgcaaaaactaaacctagagaggagcagtacaactccacctaccgggtggtttcggtgcttaccgtcctgcatcaagattggctcaatggaaaggaatacaagtgcaaggtgtccaacaaagcactgccagcgcccatcgaaaaaactatttcaaaggcaaagggacaaccgcgcgagccacaagtctacaccctcccaccatcgagagaggaaatgactaagaaccaagtcagtcttacttgtctggtcaaggggttttacccttccgacatcgcagtggaatgggaatcaaacggacaaccagaaaacaactacaagactactcctcccgtactcgattccgacggatccttctttctgtactccaagctcaccgtggacaagtccagatggcaacagggaaatgtgttcagctgctccgtgatgcatgaagcccttcataaccactatactcaaaagtcactcagcctgtcacctggaaaa

SEQ ID NO: 15559 - DNA, 1467 bp, Artificial Sequence
  Description of Artificial Sequence: Synthetic coding sequence
atggcacctgttgcagtctgggctgccttggctgtaggactagagctttgggccgcagctcatgcccttccagcacaggttgcatttacaccctatgccccagagccaggatcaacgtgcagacttcgtgagtactacgatcagactgcacaaatgtgttgttctaagtgtagtccagggcagcatgctaaggttttttgtactaaaactagcgatactgtgtgcgatagttgtgaagactcaacttatactcaactgtggaactgggttccagagtgcctatcttgcggctcaagatgctctagtgaccaagtggagacccaggcttgcactcgtgagcagaacaggatctgcacctgtcgtccgggctggtactgcgctctgagtaagcaagagggttgtcgtttatgcgcgccattacgcaagtgtaggcctggatttggtgttgcaaggcctggtactgagacgtcagatgtcgtgtgcaaaccttgtgctcctggaacattcagtaatacaacatcttctacggatatatgtagacctcaccaaatatgcaatgttgtagctattcccgggaacgctagcatggatgctgtttgcacaagtacaagtcccacacgttctatggcaccaggggccgttcatctcccgcaaccagtttcaactaggtcccaacacacccagcccactccagaaccgtcaaccgctccttctacctcctttctacttcctatgggcccctcccctcccgccgagggttccacaggtgatgagcctaagtcttgtgataagacccatacttgcccgccctgtccagcccctgagcttttgggtggaccttcggttttcttgttccctcccaagcccaaggacaccctaatgatttcaaggacaccagaagttacatgtgttgttgtggatgtgtcccacgaagatcccgaagttaaatttaactggtatgtggatggagtggaggttcacaacgcaaaaacaaagcctcgagaagaacaatataattctacctatcgtgtcgtgtctgtgctgactgtgcttcatcaggattggcttaatggcaaagaatacaagtgcaaagtgtcaaacaaggcactcccagcgccaattgaaaagacaatctctaaggcaaaaggccagcctcgagagccacaagtgtatacgctaccacccagtagagaggaaatgaccaaaaatcaagtctcccttacctgcctagtcaaaggattctatccgtcagatatagctgtggagtgggagtcaaacggacagccagaaaataattacaagaccacaccaccagttctcgattcagacggttccttcttcttgtactcaaaacttacagtggataagtcccgatggcaacagggaaacgtgttcagttgcagtgttatgcacgaggcacttcataatcattacacccaaaagagtctcagtcttagccctggtaaa

SEQ ID NO: 15560 - DNA, 1467 bp, Artificial Sequence
  Description of Artificial Sequence: Synthetic coding sequence
atggccccggtggccgtctgggccgcgttggccgtgggactcgaactgtgggcagcggcacacgccctgccggcgcaggtggccttcactccttacgctccagagcccggttccacctgcaggctgcgcgaatactacgaccagactgcccagatgtgttgctcgaagtgctctcctggacaacatgccaaggtgttttgcactaagacttccgatactgtctgtgattcctgcgaggactcgacgtatactcagctgtggaactgggttcctgaatgccttagctgcggatcgagatgctcgtcagaccaggtggagactcaggcctgcacccgcgaacagaatcggatttgcacgtgccgcccaggctggtactgtgcgctttcgaagcaagaaggttgtcgcctctgcgcaccgcttaggaaatgcagaccgggatttggcgtggctcgcccgggcaccgagacgtcagacgtggtgtgcaagccatgcgcaccaggtacgttttcgaacaccacttcatctaccgacatctgcagaccgcaccagatctgtaacgtagttgccatccctggtaatgcatctatggacgctgtgtgcacgtccacgtcccccacccgctcgatggcgccaggagcagtgcatctgcctcaacctgtgtcgactcggtcccagcacactcagccaactcctgaaccatccaccgcaccaagcacttccttcctgctgccaatggggccgagccctccggccgaaggaagcactggggacgaacctaagagctgtgacaagacccatacgtgtcctccctgccccgctcctgagctgcttggcggaccatcagtgttcctcttcccgccgaagccgaaggacaccctcatgatctcgcggactcctgaggtcacgtgtgtcgtggtggatgtgagccacgaggacccagaggtaaagttcaattggtatgtggatggggtggaggttcataacgcaaagaccaagcctcgcgaagagcagtacaactccacctaccgagtggtgtccgtgcttactgtgctgcaccaagactggctgaacggaaaagaatacaagtgtaaggtcagcaacaaagctctcccggcccccatcgaaaaaaccatcagcaaggccaagggtcaaccgagagagccacaagtctacactctcccgccgagtcgcgaagaaatgaccaagaaccaggtgtcgctgacctgcctcgtgaagggattctacccatcggacattgcggtcgaatgggagagcaatggacagccagaaaacaactacaaaaccaccccgccagtcctcgattcggatggctcgttcttcctttactctaaactgaccgtagataaatcacgatggcaacaagggaatgtgttctcgtgcagcgtcatgcatgaggctctgcacaatcactacactcagaagtcactgagcctgtccccaggaaaa

SEQ ID NO: 15561 - DNA, 1467 bp, Artificial Sequence; identical to SEQ ID NO: 15525
  Description of Artificial Sequence: Synthetic coding sequence

SEQ ID NO: 15562 - DNA, 1467 bp, Artificial Sequence
  Description of Artificial Sequence: Synthetic coding sequence
atggcaccggtagcagtgtgggctgcactcgcagtcggactggagctgtgggctgcggcccacgcgctacctgcccaagtggccttcacaccatatgccccagagcctggctccacctgtagactgcgagaatactacgaccagacggcacaaatgtgttgcagcaagtgctctccaggacagcacgcaaaggtgttctgtaccaagactagcgatacggtttgtgactcctgtgaggattctacatacactcagctgtggaactgggtgcctgagtgtttaagctgcggcagcagatgttcatctgatcaggtggagacccaggcttgtactcgtgagcagaataggatctgtacttgcaggcctggttggtactgcgctttatccaagcaggagggctgccgcctgtgtgccccgctcaggaagtgccggccaggctttggggtggcaaggccaggcactgagacgtctgacgtggtctgtaagccttgtgctcccggaaccttctccaacaccacttcttcgaccgatatctgtagacctcaccagatctgtaacgttgtcgcgataccagggaacgcaagcatggacgcagtgtgtacctccacctcacctacaagaagtatggcaccgggcgccgtccacctgcctcagcctgtgtctactagatctcaacatactcaaccgactccagagcccagtactgcaccgtctacttccttccttctaccaatgggcccctctcccccggcggaaggatctactggagatgagccaaaatcctgcgacaaaacacacacatgtcccccttgccctgcgcccgagctgttagggggacctagcgtttttcttttcccccccaagccgaaggatacacttatgatatcaagaacacccgaggtaacgtgcgtggtggtcgatgtgagtcacgaggaccccgaagtcaaatttaactggtacgtagacggcgtggaggtgcacaacgccaaaacaaagccccgcgaagagcaatacaacagtacctaccgggtggtttcagtcctgaccgtgctgcaccaggattggctgaacggaaaagagtataagtgtaaagtgagtaataaagctctccccgctcctatcgaaaaaacgatttcaaaagctaagggccagccgagagaaccacaagtctatactttgccaccaagcagggaggagatgactaagaatcaagtttcactgacatgtcttgtgaagggcttttatcccagcgacatagcggtcgagtgggaatctaacggacagcccgagaataactataaaacaactccgcccgttttggactcagacggaagcttctttctctatagcaaactcacagttgacaaatcccgatggcagcagggtaatgtgttcagctgtagtgtgatgcacgaagccctgcacaatcactacactcagaagagcctgtcactttcccccgggaag

SEQ ID NO: 15563 - DNA, 1467 bp, Artificial Sequence
  Description of Artificial Sequence: Synthetic coding sequence
atggcacccgttgctgtttgggcagccctagccgtgggtctagagctgtgggcggccgcccacgcacttcccgcacaagtggctttcacaccctatgccccggagcccggcagtacttgtcggttgcgcgaatattatgatcagacagcacagatgtgctgctcaaaatgtagccctgggcagcatgccaaagtcttctgtactaaaacatctgatacagtgtgtgattcttgcgaagactcaacatacactcagttgtggaactgggttcctgaatgcctatcatgtggctcaagatgttcttcagaccaggtcgaaactcaggcatgtacccgggaacagaaccgcatatgcacatgccgccccgggtggtattgtgccttaagcaagcaggaaggctgtcgtctgtgcgcccccctgcgcaagtgtcgcccaggattcggcgtggcgcggccggggacggagacaagcgacgtagtttgtaagccctgcgctcctggcacattttcgaataccacttcctcgactgacatatgtcgaccccaccagatttgtaatgtcgtggcgatccctgggaatgcgtccatggatgcagtgtgtacctcaactagccccactcggtccatggcgcctggtgctgtgcacctcccacagccagtgtccactcggtcccagcacacacagcccacccccgagccctctacagctcccagtacttccttcctgcttccaatgggtccgagtccgcctgcagaagggtctaccggagacgaaccaaagtcctgcgacaaaacacacacatgcccgccctgccccgcccccgaactgctgggaggcccttccgtattcttgtttcccccgaagcccaaggatactctcatgatatccaggacacccgaggtgacgtgtgtggttgtcgacgtgtcccacgaagaccccgaggtcaagtttaactggtatgtcgacggggtagaagttcataacgcaaagacaaagccccgagaagagcagtacaattctacatatagggtggtctcagtcttaaccgtgttgcaccaggactggttgaatggcaaggagtacaagtgcaaagtttccaacaaggccctcccggccccgatcgaaaaaactatctcaaaggccaaggggcagcctcgtgagcctcaggtctataccctccctccctcccgagaagaaatgaccaaaaaccaggtttccctgacctgcctggtaaagggtttctatccgtcggacattgccgttgagtgggagtccaatggacaacccgaaaataattataaaaccacaccgcccgttttggatagtgacgggtccttctttctatattctaagctgaccgtggataagtcacggtggcaacagggcaacgttttttcgtgctccgtgatgcatgaagcacttcataaccactacacacagaagtccctgtccctgtctcctgggaaa

SEQ ID NO: 15564 - DNA, 1467 bp, Artificial Sequence
  Description of Artificial Sequence: Synthetic coding sequence
atggcacccgtcgcagtgtgggccgcacttgccgtggggctcgaactgtgggcggcggctcacgcactgccggctcaggtggcattcaccccgtacgcaccagaaccgggatcaacctgcagactgagggagtactacgaccaaaccgctcagatgtgctgctccaagtgctccccaggccagcacgctaaggtgttctgcactaagacttccgataccgtctgtgactcatgcgaggactcgacttacacgcagctctggaattgggtcccagagtgtttgtcttgcggatcaagatgctcctcggaccaggtcgaaacccaagcatgcacccgcgagcaaaaccggatctgtacttgcagaccggggtggtactgcgccttgtcaaaacaagaaggatgccgcctgtgtgcgccgttgagaaagtgcaggccaggatttggagttgccaggccagggactgaaactagcgacgtggtgtgtaaaccatgcgcgccgggcaccttcagcaacaccacgtcgagcacggatatctgcagaccgcaccagatctgtaacgtcgtggcaatcccgggaaacgcatccatggacgctgtctgcacgtcgacttccccgactcgcagcatggctcccggagcggtgcatctcccgcaacctgtgagtacgcgctcgcagcacactcaacccactcctgagccttccactgcgcctagcacctccttcctgcttccaatgggcccgtcaccgcccgccgaaggttccactggagacgaaccgaaatcgtgtgataaaacgcacacttgcccgccatgcccagccccagagctgctgggtggtcctagcgttttcctttttcctccaaagccaaaggataccctcatgatttcgcgcaccccggaggtgacctgcgttgtggtggatgtgagccacgaggatcctgaagtcaaattcaattggtacgtggacggggttgaggttcataatgcgaaaaccaagccgcgggaggaacagtataactcgacttaccgggtggtgagcgtgctgactgtcctgcatcaggactggctcaacggcaaagaatacaagtgtaaggtgtccaacaaggcattgcctgccccgatcgaaaagaccatctcaaaggcaaaaggacaaccgcgggaaccccaggtctacactctgccgccatcgagagaggagatgaccaagaaccaagtgtctttgacttgtctcgtcaagggcttctacccgtcggatatcgcggtggaatgggagtcaaacggacagccagagaacaactacaagactactccgccagtcctggattcagacggtagcttcttcctgtactcgaagctcaccgtcgacaagtcccggtggcagcagggaaatgtgttcagctgtagcgtgatgcatgaggcccttcacaatcattacactcagaagtcgctttcgctgtcgcccgggaaa

SEQ ID NO: 15565 - DNA, 1467 bp, Artificial Sequence
  Description of Artificial Sequence: Synthetic coding sequence
atggcccccgtagcagtctgggcggccctggccgttggccttgagctgtgggcagcagcccacgctctaccagctcaggtagcttttacaccgtacgctcccgaaccagggagcacatgccgcctccgggaatactatgaccaaacagcgcagatgtgctgctccaagtgctcaccggggcagcacgccaaagtcttttgcaccaaaacatccgataccgtctgtgattcctgtgaggactctacatacacacagctctggaattgggtccctgaatgcctgtcttgtgggagtcgttgctcaagcgaccaagttgagacccaggcgtgtaccagggaacagaataggatctgcacgtgtagaccaggctggtactgtgcgctgtccaagcaggaaggttgtcgcctgtgcgcccctctccgcaaatgccgacccggatttggagttgccagacctggaaccgaaaccagcgatgtggtctgcaagccttgcgcacctggaactttctcaaacacgacttcctctaccgacatctgccggcctcaccagatttgcaacgtagtcgccatcccaggaaacgccagtatggacgcagtgtgtacatccacctccccaacacggtcaatggctccaggcgccgtccatctgccccagccggtaagcacccgctctcagcacacacagcctacccctgaaccctccactgcccctagtacttcttttctgctgcctatggggccatctccacctgcagagggatcaacgggcgacgagccgaaatcttgtgacaagacgcatacctgtcccccatgccccgctcccgagctgctcggcggcccatccgtctttttattcccacccaagcctaaggacactcttatgatttcgaggacaccagaggtgacatgtgtggtggtggacgtgtctcacgaggaccccgaggttaagtttaattggtatgtggatggcgtggaggtacacaatgctaagactaaaccaagagaggaacagtataattccacatatagggtagttagcgttttgaccgtgctgcatcaggactggctaaacggaaaggaatacaagtgcaaggtgagcaataaggcattacccgctccaatcgaaaagacaataagcaaggccaaggggcaacctcgcgagccacaagtgtacactctgccgccctcgagggaggagatgaccaagaaccaggtgtccctaacgtgtctcgtcaagggcttttatcccagtgatattgccgtggagtgggagagtaacggccagcctgagaacaattataaaaccacgccaccggtactcgactcagacgggagtttcttcctgtatagtaagctgacagtagacaagtctcgctggcagcagggcaacgtattcagctgttcggtgatgcacgaagcactgcacaaccactatacccagaagtccctatccctatcccctgggaaa

SEQ ID NO: 15566 - DNA, 1149 bp, Artificial Sequence
  Description of Artificial Sequence: Synthetic coding sequence
atgggggtcctgctcacgcaaagaactctgctgtcactggtgctcgcgctgcttttcccatccatggcctcgatggccatgcatgtggcacagcctgccgtcgtgctggcgtcaagccggggcatcgcttccttcgtgtgcgagtacgcctcaccaggaaaggcaactgaggtgagagtcaccgtgctgcggcaagccgactcacaagtgactgaagtctgcgccgctacgtacatgatgggcaacgaactgaccttcctcgacgactccatctgcacgggaacttccagcggtaaccaggtgaacctgaccatccagggactccgcgccatggataccgggttgtacatctgcaaggtggaactgatgtatccacccccatactatctgggtatcggaaacggtacgcagatttacgtcattgatccggagccgtgccctgatagcgaccaggaaccgaagtcgtcggataagactcataccagcccaccgtcaccggcacccgagctcctcggaggctcttccgtgttcctgttccctccaaagccgaaagatactctgatgatctcgagaactccagaggttacctgcgttgtggtcgacgtcagccatgaggatcctgaagttaagttcaactggtacgtcgacggtgttgaggtccacaacgcaaaaaccaaacctcgcgaggaacaatacaattcaacctaccgggtggtgtcggtgctgactgtgctgcaccaggactggctcaacggaaaagagtacaagtgcaaggtgtcgaacaaggcgttgcccgcaccgatcgaaaagactatctccaaagctaagggacagcccagggaaccacaagtgtacactcttccgccgtcccgcgatgagttgaccaagaaccaagtgtcactcacttgcctggtgaaagggttctacccatcagacatcgctgtggagtgggagagcaacggccagcctgaaaacaactacaagaccaccccaccggtcctggatagtgacgggtcgttcttcctttacagcaaactgactgtcgacaagtcgcgctggcaacagggaaacgtgttctcctgctcagtaatgcatgaagccctgcataaccactacacccagaagtcactgtccctctcaccggggaag

SEQ ID NO: 15567 - DNA, 1149 bp, Artificial Sequence
  Description of Artificial Sequence: Synthetic coding sequence
atgggcgtgctccttactcagcgcacgcttctgtcgctggttcttgcgcttctgtttccgtctatggcaagcatggcaatgcacgtggcacaaccggcagtggtgctcgcctcgagccgggggatcgcctcgttcgtgtgtgaatacgcgagcccgggtaaggcgaccgaagtcagagtgactgtcttgcgacaagcggactcccaagtcactgaggtgtgcgccgccacctacatgatgggcaatgagctgaccttcctcgacgactccatctgcaccggaacttcctcgggaaatcaggtgaacctgaccatccaagggctgcgcgcaatggatacgggactgtatatctgcaaggtggagttgatgtacccacctccatattacctcggtatcgggaacggcactcagatttacgtgattgacccggaaccgtgccccgactcagatcaggaaccgaagagctcggataaaactcacactagcccgcccagcccagcccctgagctcctgggcggaagctccgtttttctcttcccgccgaagcctaaggatacgctcatgatctcgcgcaccccagaggtcacctgcgtcgtcgtggacgtgagccacgaggaccccgaagtcaaattcaattggtatgttgatggcgtggaggttcataatgctaaaactaagccgcgggaagaacagtacaactcaacctaccgcgtcgtgtcggtcctcactgtgctgcatcaggactggctgaacgggaaggagtacaagtgcaaagtcagcaataaggcgttgcccgcgcctatcgaaaaaacgatctcgaaggctaagggacagccgagagagccccaggtgtacactctcccaccatctcgtgacgaactcactaagaaccaggtgtcactgacttgtcttgtgaagggcttttacccttcagacattgctgtggagtgggagtcaaacggtcaaccagaaaacaactacaagactacgccgccggtgctcgattcggacgggtcatttttcctgtactcgaagctcacggtggataagtcccggtggcaacaaggcaatgtgttctcgtgctcggtcatgcatgaagccctgcacaaccattatactcagaaatccctgtccctgtccccggggaaa

SEQ ID NO: 15568 - DNA, 1149 bp, Artificial Sequence
  Description of Artificial Sequence: Synthetic coding sequence
atgggcgttctcctaactcagaggaccctgcttagcctagtgctggctctgttgttcccaagcatggcctctatggccatgcatgtagctcagcctgcggtagtgctggcgagctcacggggcatcgcttcttttgtgtgcgagtacgcctcacctggtaaagccacggaggttagggttaccgtgctgcggcaagcagacagtcaggtgacagaggtgtgtgctgcaacatacatgatgggtaatgagctcaccttcctcgacgactctatttgtaccgggaccagcagtggtaatcaggtaaatcttaccattcagggtctaagggctatggataccggcctgtacatttgcaaggttgaactgatgtatcctcccccttattacttgggcattggaaacggaacgcagatctacgtcattgaccccgagccatgccctgactcagaccaggagccaaagagttctgacaagactcacacctcaccaccatctccggcacctgagctcctcggagggtcctcagtgttcctatttccccccaagccaaaggacacactcatgattagccgaactcccgaggtaacctgcgtggtcgtggatgttagccacgaggatcccgaggttaaatttaactggtacgttgacggcgtggaagtgcacaacgccaaaaccaagccgagagaggaacaatacaattccacgtacagagtggtgtcggtgcttacagtattgcaccaggattggctgaatgggaaagagtacaagtgcaaagtttccaataaggcactgcctgcgccaatcgaaaagactatatcaaaggctaagggacaaccccgggagccccaggtgtacactctacccccctccagggatgaactcactaaaaatcaggttagcctgacctgtttggttaaaggcttctacccgtctgatatcgcggtggagtgggagtcaaatggccagccagagaacaattacaaaacgaccccaccagtcctggactctgatggaagtttcttcctttattcaaagcttaccgttgataaaagcagatggcagcaggggaacgtcttttcatgctctgtaatgcacgaggcccttcacaaccactatacacagaaatccctgagtttgtcgccaggaaaa

SEQ ID NO: 15569 - DNA, 1149 bp, Artificial Sequence
  Description of Artificial Sequence: Synthetic coding sequence
atgggcgtcctgctaactcagagaaccctgttgtccttggttttggcccttctcttccctagcatggcttctatggcgatgcacgtcgctcagccggccgtagtcctggcgtcctcacggggaatagcaagcttcgtttgcgagtatgcatcaccgggcaaggctacagaggtcagagttacagtgcttcgtcaggcagatagccaggttaccgaggtctgtgccgctacctatatgatgggcaacgagctgacctttctggatgattctatttgtactggtacgtcctccggtaaccaagttaatcttacaatccaggggctgagggcaatggacacaggcctgtatatttgtaaggtcgagctaatgtacccacctccgtattatctgggaatcggtaatgggacacagatctatgtgattgatcccgaaccatgccccgacagtgaccaggagcccaagagttccgataagacgcatacatcaccaccgagtccagcaccagaactgcttggaggttcatcggtgtttctatttccccccaaacccaaggatactctgatgatatcacggacaccggaagtgacttgcgtggtggtggatgtgagccacgaggatcctgaggttaaattcaattggtacgtcgacggcgtcgaggtgcacaacgcaaagaccaaaccaagggaggaacagtataactcgacatatcgcgtggtgtctgtcttgaccgttctgcatcaggactggttaaatggtaaggaatataagtgtaaggtgtctaacaaggccctgcctgctcccattgagaaaaccatcagcaaggccaaaggtcagcctcgcgaacctcaagtctatactttacctccttcccgggacgaactcacgaagaaccaagtttccttgacctgtctggtgaaaggattctatccctccgacatcgcagtggagtgggaatcaaacggacagccagagaacaattacaagaccacccctcccgtgctggatagcgatggaagctttttcctttactctaagctcacagtggacaaatcacgctggcagcaagggaacgtcttttcttgctctgtcatgcacgaggcacttcacaaccattacacccagaagtcactttccctcagtcctggtaag

SEQ ID NO: 15570 - DNA, 1149 bp, Artificial Sequence
  Description of Artificial Sequence: Synthetic coding sequence
atgggagtcctgttgactcagcggactctccttagcctggtcctcgccctccttttcccatcgatggcgtcgatggcgatgcacgtggcccaacccgcggttgtgctggcctcaagccgcggaatcgcctcgttcgtgtgcgaatacgcttccccgggaaaggccactgaagtccgcgtgaccgtcttgcgacaggctgactcacaagtgactgaagtgtgtgcggccacgtacatgatgggcaacgaactgacgttcctggacgattcgatttgcactgggacgtcctctggaaaccaggtgaacttgaccatccagggcctgcgcgcgatggacaccggtttgtacatctgtaaagttgagctgatgtacccgccaccctactacttgggaatcggcaacggtacccaaatctacgtgatcgaccccgagccgtgccccgattccgatcaagagcctaagtcgtcagacaagacgcacacctcgcctccatcgcctgcacctgaactgctggggggttcttcagtgttcctgttcccgccgaaaccaaaggacaccctcatgatctcccggactcctgaggtcacttgcgtggtggtggatgtgtcacatgaggacccggaggtcaagttcaactggtatgtcgatggggttgaagtgcacaatgcaaagacgaagccacgggaagagcagtacaattctacttacagagttgtcagcgtcctcacggtgcttcaccaggactggcttaacggaaaagagtacaagtgcaaggtgtcgaacaaggcacttccagcccctatcgagaaaaccattagcaaagctaagggacaaccgagggagccacaggtctacaccctcccgccgagcagagacgagctgactaagaatcaggtcagcctgacctgcctggtgaagggattttacccctccgacatcgccgtggagtgggaaagcaatggtcaacccgagaacaactacaaaaccacgccgccagtgcttgattcggatggcagcttctttctctatagcaagctgactgtcgataagtcacgttggcagcagggcaatgtcttttcttgttccgtgatgcacgaagctctgcataaccactacactcagaagtccctgtcgctctcgccaggcaaa

SEQ ID NO: 15571 - DNA, 1149 bp, Artificial Sequence
  Description of Artificial Sequence: Synthetic coding sequence
atgggagtcctgctgacgcagagaaccctgctctccttggtgcttgctctgctgttcccgtcgatggcaagcatggcaatgcatgtggcccagcctgcggtggtgcttgcgtccagccgaggcatcgcctcattcgtgtgcgagtacgcctcaccgggaaaggctaccgaggtgcgcgtgaccgtcctgaggcaagccgactcacaagtgaccgaagtttgcgcggccacttacatgatgggaaacgagctcaccttcctcgatgattcaatctgtactggaacgtcctcgggaaaccaggtgaatctcaccatccagggccttcgggcgatggacaccggactctacatctgtaaagtcgagctgatgtatcctcccccatactatctcggaatcggaaacgggacccagatctatgtgatcgacccggaaccatgtcctgattcggatcaggaaccaaagagctcggacaaaactcatactagccctccaagcccggcacctgaacttctcggaggctcctcagtgttccttttcccaccgaagccgaaggacaccctcatgatctcccggacgccagaagtgacgtgcgtcgtggtggatgtgtcccacgaagatccggaagtgaagtttaactggtacgtcgacggagtcgaagtgcacaacgccaagactaagccgcgagaagagcaatacaactccacgtaccgggtcgtgtcagtgctcaccgtgctgcatcaagactggctcaacggaaaggaatacaagtgcaaggtgtccaataaagcactgccggcccctatcgaaaagactatctcgaaggccaagggacaaccgcgcgaaccccaggtgtacaccctcccgccctcgagggatgagctcaccaaaaaccaagtttcccttacttgtctggtcaagggattctacccgtccgacatcgcggtggaatgggagagcaatggacaacctgaaaacaattacaaaactactcctcctgtgctggactcagatgggtcgttctttctgtacagcaagctgaccgtggataagagccgctggcagcagggtaacgtcttttcgtgcagcgtgatgcacgaagctctgcacaatcattacacgcagaagtcgctctccttgtccccaggaaag

SEQ ID NO: 15572 - DNA, 1149 bp, Artificial Sequence
  Description of Artificial Sequence: Synthetic coding sequence
atgggagtcctgctgactcagagaacccttctgtcgctcgtcctcgctctgctgttcccatccatggcatcaatggccatgcacgtcgcacaacctgccgttgtcctggcatcctcacgcgggattgcaagttttgtctgcgagtacgcgagccccggtaaggcgactgaagtccgcgttactgtgctgaggcaggccgacagccaggtgaccgaggtctgtgcagcaacgtacatgatgggcaacgaactcactttcctcgacgactccatttgtactggaacctcatcagggaatcaggtcaacctgactatccaagggttgcgagcaatggatacggggctctacatctgtaaagtggaacttatgtaccctccgccctattacttggggattggaaacgggacgcaaatctacgtgattgaccccgagccttgtcctgattcggaccaagaacctaagtcgtctgataaaactcatacctccccgccctcgcctgcgcctgagctcctcggcggttcaagcgtgtttcttttccctcccaagcctaaggatactctgatgatttcacgaaccccagaagtgacttgcgtggtcgtggatgtctcgcatgaagatcctgaagttaagttcaattggtacgtcgatggtgtggaagtgcataacgcaaaaactaagccaagggaggaacaatacaattcgacttaccgtgtcgtgtcggtgctcaccgtgttgcatcaggattggctcaatggtaaagaatacaaatgtaaagtgtcgaataaagcattgcccgcaccaattgaaaagaccatatcgaaagcaaagggacaaccacgggaaccgcaggtctacacgcttccaccctcaagggatgaacttacgaagaaccaggtcagcctgacctgtctcgtgaaaggattctacccatcagatattgcagtcgagtgggaatcgaacggtcagccggaaaacaattacaagaccaccccacctgtgcttgatagcgatggcagcttttttctgtacagcaagctcaccgtggataagagccgctggcaacagggtaacgtttttagctgctccgtcatgcatgaggcactgcataatcattacacccagaaatcgttgtcgctctcccctggaaag

SEQ ID NO: 15573 - DNA, 1149 bp, Artificial Sequence
  Description of Artificial Sequence: Synthetic coding sequence
atgggtgtgttgctgacccagaggaccctgttgagcttggtgctggcactgctctttccctccatggccagtatggctatgcacgttgctcagcccgctgttgtccttgctagctcccgcggtatcgcttcttttgtatgcgaatacgcctcccctggaaaagccacagaagtgagagtcactgttctccgccaagccgactctcaggtaactgaggtgtgcgctgcaacctatatgatgggtaacgaattgaccttcctcgatgacagtatctgcaccggcacaagctccggcaaccaggtcaacctgactatccagggtcttcgcgcaatggacaccggcctctacatatgcaaggtcgagctgatgtaccctcccccctattatttgggaatcggcaatggcactcaaatctacgtaatagaccctgaaccctgccccgacagcgaccaagagcctaagagctccgacaaaacacatactagtcctccatcacctgcccccgagcttctgggtggctcttctgtgttcctgttcccccccaagcctaaggataccttgatgatctctcgcactcctgaggtgacctgcgtcgtggtggatgtttctcacgaagaccccgaggtaaagtttaactggtacgtcgacggtgttgaagtgcacaatgccaagactaagccccgtgaggagcaatataattctacttaccgcgtggttagcgtcttgactgttctgcaccaggactggttgaacggaaaagagtataaatgtaaggtaagcaacaaagccttgccagcacctattgaaaagactattagtaaagctaaaggccaacctcgcgagcctcaggtgtataccctccccccttcccgcgacgagttgaccaaaaatcaggtctctctgacctgtctcgtaaagggtttttatccaagtgacatcgcagtggagtgggagtctaacggtcagcctgaaaataactataagactactccccccgtgctggatagcgacggaagctttttcctgtacagcaaattgactgtggacaagtcaaggtggcagcaaggcaacgtgttcagttgctccgttatgcatgaggccttgcataaccattatacccaaaagtctctgtcactgagtcctggaaaa

SEQ ID NO: 15574 - DNA, 1149 bp, Artificial Sequence
  Description of Artificial Sequence: Synthetic coding sequence
atgggagtgctgctcactcaacgaacccttctctccctcgtcctggccttgctcttcccatcaatggcgtctatggcaatgcatgtggcacagccagccgtggtccttgcctcgtcgcgcggaattgcatccttcgtgtgcgaatacgcctcacccggaaaggcgaccgaagtcagagtgactgtgctccgccaagcggactcccaagtgaccgaggtgtgcgccgccacgtacatgatgggaaacgaactcacttttctggatgattccatttgcaccggtacttctagcggaaaccaggtgaacctgactatccaggggctgcgcgctatggatactggcctctacatctgcaaggtggagcttatgtacccaccgccttactacctgggcattgggaacggaactcagatttatgtgatcgacccggaaccttgtccggactcagaccaggagccgaagtcctccgacaagactcacacttcgcctcctagcccggcgcccgaactcttgggcggtagctccgtgttcctgttcccgcccaagccgaaagacactctgatgatctcgcgtaccccggaggtcacctgtgtcgtggttgacgtctctcacgaggacccggaggtgaaattcaattggtacgtcgacggggtggaagtgcacaacgcgaaaactaagccccgcgaagaacagtacaattccacgtaccgcgtggtttcagtgctcaccgtgctgcatcaggattggctgaacgggaaggaatacaagtgtaaagtgtctaataaggcactcccggctcctatagaaaaaacgatctcaaaggccaaggggcagccaagagaaccgcaggtctacacgcttccgccgtcacgcgatgagctcaccaagaatcaggtgtctctgacctgcttggtcaagggcttctacccctcggacatcgctgtggagtgggaaagcaacggccaacccgagaacaactacaagacgactcccccggtcctggattcggatggatcgttcttcctgtatagcaaactgactgtggataaaagccgctggcagcagggaaacgtatttagctgcagcgtcatgcatgaggctctgcacaatcactacacccaaaaatccctgtcgctgtcgccgggtaaa

SEQ ID NO: 15575 - DNA, 1149 bp, Artificial Sequence
  Description of Artificial Sequence: Synthetic coding sequence
atgggagttctcctgacccaacgcacactccttagcctcgtgctcgccctcttgtttccgtctatggcgagcatggccatgcacgtggcccaaccagccgtcgtgctggcaagctcaagagggatcgcttcttttgtgtgcgagtacgctagtcccggaaaagccacagaagtgcgagtcacggtcctgcgccaagctgattctcaggtcaccgaagtgtgtgctgccacatatatgatgggcaatgagcttacattcctggatgacagtatttgcacaggaacaagctctggaaatcaggttaacctcaccatacagggattgcgggccatggatactggcttgtatatttgcaaagtggagctgatgtatccccctccttactacctgggcattgggaacggtacccagatctacgtgatcgacccagaaccctgccccgattcagatcaggaaccaaaatcttccgacaagacccacacgtcccccccttctccagcgcctgaactgcttgggggctccagcgtgttcttgttccctccgaagcccaaagacaccttgatgatctcaaggactccagaagttacttgcgtggtagtcgatgtctcccacgaggatccagaggtcaagttcaactggtacgtagatggagtggaggttcacaatgccaagactaagcctcgcgaggagcagtacaattctacttatagagtagttagcgtgctcactgtcctgcaccaggactggctgaacggaaaggaatacaagtgtaaagtgagtaacaaggccctgccggcacccattgagaagaccatcagcaaggccaagggccagccaagggagccccaggtctataccctcccccccagtcgggatgagttgacaaagaaccaagtttctttgacctgcctcgtcaagggcttctatccctctgacattgcggtggaatgggagagtaacggacagcctgaaaataattataagaccacaccgcctgtgctggattccgacggctctttcttcctgtatagcaaactcactgtggacaagagtagatggcagcagggcaatgtgttttcttgttctgtgatgcacgaggcgctgcataatcactatacacagaagagtctctcactctcacctggaaaa

SEQ ID NO: 15576 - DNA, 1149 bp, Artificial Sequence
  Description of Artificial Sequence: Synthetic coding sequence
atgggggtgctcctgacccaaagaaccctcctttcactggtgctggcgttgctgttccccagcatggcgagcatggcgatgcacgtcgcccagcctgctgtggtgctggcctcatcccggggcatcgcctcgttcgtttgcgagtacgcgtcgccaggcaaggcaacggaagtgcgcgtcaccgttctgagacaagccgattcgcaggtgacggaagtctgtgctgccacctacatgatgggaaatgaactcacgttcttggacgatagcatttgtactggaacctcgagcgggaatcaagtcaatcttactatccagggattgcgcgccatggacaccggactgtacatttgcaaggtggagcttatgtacccacccccatactacctgggaatcggcaacggtacccagatctatgtgatcgacccagaaccgtgcccagacagcgatcaggagccgaagtcctcggacaaaactcacacttcgcctccctcccctgcgccagaactcctgggtggatcgtccgtattcctcttcccgcccaagcccaaggacaccttgatgatttcaaggacccccgaggtgacttgcgtagtggtggacgtctcacacgaggacccggaggtaaagtttaactggtacgtcgatggagtggaagtccataacgcgaaaaccaaacctcgggaagaacagtacaattccacttatagagtggtttcggtgctgaccgtgctgcatcaagattggctgaacggcaaagaatacaagtgtaaggtgtctaacaaagcactcccggctccaatcgaaaagaccatctccaaggcaaaggggcaaccgcgggagccgcaggtctacaccctccccccatcacgcgatgaactcactaagaaccaggtgtcgctgacttgcttggtgaaaggattttacccgagcgacatcgccgtggaatgggaatccaacggacagcccgagaataactacaagacgactcccccggtgctggactccgatggatcattctttctgtactccaagctcaccgtcgacaaatcaaggtggcaacaagggaacgtgttctcttgcagcgttatgcatgaggccctgcataatcattacacgcagaagtcactgagtctgagcccaggaaag

SEQ ID NO: 15577 - DNA, 1149 bp, Artificial Sequence
  Description of Artificial Sequence: Synthetic coding sequence
atgggcgtgctcctgactcagagaactctgctgtccttggttctcgcacttctttttccttcgatggcatccatggctatgcatgttgcacagccagccgtggtgcttgcatcatcgagaggtattgcatcatttgtctgtgagtacgcctcgccgggcaaagcaacggaggtgcgcgtgactgtcctccgccaggcagactcgcaagtcactgaagtttgcgcagcgacgtacatgatggggaatgaactgaccttcctggacgactccatctgcaccggtacttcatcaggtaaccaagtgaaccttaccattcagggactgcgggctatggacactggactgtacatttgtaaggtggagctcatgtaccccccaccctactaccttggcatcggaaacggcactcagatttatgtcattgatccagagccttgtccagattccgatcaagaacccaagagcagcgacaaaacccacactagcccaccaagccccgcaccagaactgctgggagggagctcggtgtttctttttccccccaagcctaaggataccctgatgatctcaaggactccagaagtgacgtgtgtcgtggtcgatgtctcacatgaagatcctgaagtcaaattcaactggtacgtggatggagtcgaggtgcacaacgcaaagactaagccccgggaagaacagtacaacagcacttaccgggtggtgtcagtgttgactgtgcttcaccaagactggctgaatggaaaagaatacaagtgcaaggtgtctaacaaggcactgcctgcccctatagaaaagactatttcaaaggctaagggtcaaccccgggagccacaggtgtacacccttcctccttctcgcgacgaacttaccaagaatcaagtctcgctcacctgcctcgtgaagggtttttacccttcggatatcgcagtggaatgggaatccaatggacagcctgaaaacaattacaaaactaccccaccggtgcttgactcagatggctcgtttttcttgtactctaagctcactgtcgataagtcaagatggcaacaaggaaatgtctttagctgctcggtcatgcatgaagccctccataatcactacacccagaagagcctgtccctttcgcctggtaaa

SEQ ID NO: 15578 - DNA, 1149 bp, Artificial Sequence
  Description of Artificial Sequence: Synthetic coding sequence
atgggggtgcttctcactcaacgcactctgttgagcttggttctggcgctcttgtttccctccatggcctctatggctatgcacgttgcccagcctgcggtggtgctggcaagcagtagagggatcgcttcattcgtgtgcgagtatgcgtcccccggcaaggctacggaggtaagagtgaccgtgctgcggcaggccgactctcaggtgactgaagtgtgcgcagcaacttatatgatgggcaacgaactgacattcctggatgatagcatctgcaccggcacctcgagcggcaaccaggtcaacctaaccattcaggggcttagagcgatggatactgggttgtacatctgcaaggttgagctgatgtatccccctccctactatctgggtatcggcaacggcacgcaaatttacgttatagaccctgaaccctgcccagacagcgaccaagagccaaagagttcagacaaaacccacacctctcccccttcccctgctcccgaactcctcgggggatccagcgtgtttttattcccccctaaacctaaggacactctgatgatttctaggacccccgaagtgacatgtgtcgtagtggatgtttcgcacgaggatccggaagtgaaattcaattggtatgtggatggcgtcgaagtgcacaacgctaaaacaaaacccagagaggagcaatataactctacctaccgtgtggtttcagttcttactgtgctgcaccaggactggctcaatggcaaagagtataaatgtaaggtcagtaacaaagccctgcccgctccaatagagaaaacaattagtaaagcaaaaggccagcccagagagccccaggtctacaccttgcctccaagtcgcgacgaactgacaaagaatcaggtctccctgacctgcctggtcaaggggttttatccttcggatatcgctgtggagtgggaatctaatggccagcctgaaaacaattacaagaccacgccacccgtgctggactcggatggttccttttttctatactcaaagttgaccgtagataaatctcgatggcagcagggtaatgtgttttcttgtagcgtcatgcatgaggcattacacaaccattatacacagaaatctttgagcctgtcccctggcaaa

SEQ ID NO: 15579 - DNA, 1149 bp, Artificial Sequence
  Description of Artificial Sequence: Synthetic coding sequence
atgggcgtgcttctgacccagagaacccttctgtcccttgtcctggccttgctcttcccatccatggcaagcatggccatgcacgtggcacaacccgcagtggtattggctagcagtcggggaatcgcctcctttgtctgcgagtacgcgtctcctggaaaggctacagaggtaagggtgacggtcctccgacaagcggattcccaagtgacagaggtgtgcgcagccacttatatgatggggaacgagctgaccttcctggatgactctatctgcaccgggacgtctagcgggaatcaggtcaacctgacgatacagggacttcgggcgatggatacagggttgtatatctgcaaagtggaactcatgtatccacccccatactatctgggtataggcaatggcacacaaatctacgtgattgatccggagccttgcccagactcagatcaagagccgaagtccagcgacaaaacacacacttcccctcctagcccagctccagagctcctcggaggatcatcagtgttcctgttccctccaaaacccaaggacacattgatgatcagtcgaacgccagaggtgacctgtgtggtggtcgatgtcagccatgaggacccggaggtgaagttcaactggtacgttgacggggtggaggtacataatgctaaaactaaaccgcgggaggagcaatacaactctacttacagggtggtgtccgttttaacggtcctgcaccaggactggttgaacggcaaggagtataagtgcaaggtttcgaacaaggcattgccagctccaatagagaaaacgatttcaaaagccaaggggcagccaagggagccccaggtatataccctccctccatctcgcgacgagctgacaaagaatcaggtcagtcttacgtgtttagtaaaggggttttacccctcagacatcgccgtggaatgggagagcaacggtcagcccgaaaacaattataagaccaccccccctgtactcgatagtgacggctcattcttcctctactccaagttgacagttgacaaatctcgctggcagcagggaaacgtcttttcgtgtagcgtaatgcacgaagccttacataatcactacacccagaaatcactgagcctgagtccggggaag

SEQ ID NO: 15580 - DNA, 1149 bp, Artificial Sequence
  Description of Artificial Sequence: Synthetic coding sequence
atgggtgtgctgcttactcaacgaactcttctctcattggtgcttgccctgctgtttccttctatggcatcgatggccatgcatgtggcccaaccagcagtggtgttggccagcagcagaggaattgcatcctttgtgtgtgaatacgcttcccccggaaaggccactgaggtgcgcgtgacggtcctccggcaagcagattcccaagtgactgaagtctgtgcagcaacttacatgatggggaacgaattgacctttctggacgattccatctgtaccggcacgtcgagcgggaatcaagtcaaccttaccatccaaggccttagagcaatggataccggtctgtacatatgtaaggtcgaactgatgtaccctccgccttactatctgggaataggtaatgggactcagatatacgtcattgatccagaaccttgtccagatagcgatcaggaaccaaaatcatcggataagacgcacacctcacctcccagcccggccccggaactcctcggaggctcatcggtgtttctgtttcctcctaaacccaaggacactttgatgatctcccggaccccggaggtgacttgtgtggtggtggatgtgtcccatgaggaccccgaagtgaagtttaactggtatgtggacggagtcgaagtgcacaacgcgaaaaccaagccacgagaagagcagtacaactcgacctatagagtggtgtcggtgttgaccgtgctccaccaggattggctgaatggcaaagaatacaagtgtaaagtctccaacaaagctctgcctgcaccaatcgaaaagactatttcaaaggcaaagggtcagcccagagagcctcaggtgtacactctccccccttcccgtgatgaactgacgaagaaccaagtgtcactgacttgccttgtgaagggattctacccttcagacattgcagtcgagtgggaatccaacggacagccggagaacaactacaagaccaccccaccagtccttgactcagacggatcattcttcctttactcaaagttgaccgtcgataagtccaggtggcaacaaggaaacgttttttcgtgtagcgtcatgcatgaggcccttcacaaccactacacccagaaaagcctctcgctcagccccggtaag

SEQ ID NO: 15581 - DNA, 1149 bp, Artificial Sequence
  Description of Artificial Sequence: Synthetic coding sequence
atgggggtacttctcacccaaagaaccctgcttagtctggtcctggcgctactcttccctagcatggcaagcatggcaatgcacgtcgcccagcccgctgtggtcctggccagcagcagaggaatcgcttcttttgtatgcgaatacgcctcacccgggaaagctactgaggtgagagtgaccgtccttaggcaagcagattcgcaggtaactgaagtatgcgctgctacctacatgatggggaacgaactcacattcctcgatgattccatctgcaccggaacctcatctggaaaccaggttaacctgaccattcagggccttcgggctatggacaccggcttgtacatctgtaaagtggaactgatgtaccctcctccttactacttgggaatcgggaacggaacgcagatttatgttattgaccccgaaccctgtcctgactctgaccaggaaccaaagagtagcgacaagactcacaccagccccccctcccctgctcctgaactcttggggggaagttccgtgttcctttttcctcctaaaccgaaggatacccttatgatcagccgcactccagaggtgacatgcgtagtcgttgacgtgagccacgaagaccccgaagtcaagttcaactggtacgtcgatggcgtggaagttcataatgccaaaaccaagccaagggaagagcagtataactcaacttatcgggtagtcagtgttctgaccgttctccatcaggactggctgaacggaaaagagtataaatgtaaagtctcaaacaaggcactcccagctccaatagagaagacgatctccaaggcaaaaggacagcccagagaaccccaagtgtataccctaccccctagcagggacgagctaaccaaaaaccaagtgagcctgacctgtcttgtaaaaggcttctacccgtcagatatcgctgtggaatgggaatcaaatggccagccagaaaacaactacaaaaccacaccgcccgtgctcgatagcgatgggagcttcttcttgtactcgaaactcacagtcgataagagcaggtggcagcaaggcaacgtctttagttgtagcgtgatgcacgaggccttgcataaccactacacacaaaagtcgctgagtttgtcacctggaaaa

SEQ ID NO: 15582 - DNA, 1149 bp, Artificial Sequence
  Description of Artificial Sequence: Synthetic coding sequence
atgggagtgctccttacccaaagaaccctcttgagcttggtcctggctctccttttccctagcatggcaagcatggcaatgcatgtcgcacaacccgccgtggttctggcatctagccgagggattgcatcgttcgtctgcgagtacgcgagccctggcaaagcaaccgaggtgagggtgactgtgcttcgccaggccgattcacaagttaccgaagtatgtgcagctacgtacatgatgggtaatgaactgacctttttggacgatagcatctgcacgggaactagttctggtaaccaggtgaatcttaccattcaaggactgcgcgcaatggataccggcttgtacatttgcaaggtagagcttatgtacccacctccatattacctcgggataggaaatgggacccaaatctacgttatcgatccagagccgtgccccgattcggaccaggaacctaaatcgtctgacaagacccatacctcgccaccatcgcctgcaccagaactgctgggcgggtccagcgtgtttctgtttccacccaagcctaaggatacgctcatgatctcgcgcaccccagaggtcacgtgtgtggtcgtggacgtctcccatgaggatccagaagtgaaattcaattggtacgtggatggagtggaagtgcacaacgcaaagactaagcctcgtgaagagcagtacaactccacctaccgggtggtgtcggtccttaccgtgcttcaccaggactggcttaatggtaaggaatacaagtgtaaggtgtccaataaagccctgcccgccccgatcgaaaagacgataagcaaagcaaagggacaacctcgggaaccccaggtttacactctgccaccttcacgcgatgagctgactaaaaaccaggtgtcccttacttgtcttgtgaagggcttttacccttcagacatcgcggtggagtgggaaagcaacggacagccggaaaacaattacaaaaccaccccgcccgttctggacagcgatgggagctttttcctgtactcgaagctcaccgtcgacaagtcacggtggcaacaaggcaacgtcttttcctgctccgtgatgcatgaggccctgcataatcactacacccaaaagtcgctctcactttctcctggtaaa

SEQ ID NO: 15583 - DNA, 1149 bp, Artificial Sequence
  Description of Artificial Sequence: Synthetic coding sequence
atgggcgtactactaacacaacggacactgctatccctggttctagcactcctgtttcccagtatggcttcaatggccatgcatgttgctcagcccgccgtggtgctagctagttctcggggtatagcgagctttgtctgtgaatacgcttccccaggcaaggccacagaagtgcgcgtcacagttctgagacaggccgattctcaggttacagaggtgtgcgcagcaacctatatgatggggaacgaactgacgtttctcgatgatagcatctgcacgggaacctcatccggcaaccaagttaacttgacgatccagggcctgcgcgctatggatacagggctatatatctgcaaggtagaattgatgtatccaccaccttactatctgggtatcggcaacggcacacagatttacgtgattgatcccgagccatgccctgactccgaccaggagccaaaaagctccgacaaaactcacacatcccctccatcccccgctccggaactgctggggggtagctctgttttcctgttccccccaaaaccgaaagacacattaatgatctcacgaaccccagaagtcacctgcgtcgttgtagacgtatcacatgaagacccggaagtaaagttcaattggtatgtagacggtgtcgaagtccacaacgctaagacaaaaccacgagaggagcagtataactctacataccgggtcgtgtctgttctgacagtgctgcatcaggactggttaaacggtaaggagtataaatgtaaggttagcaataaagcactccctgcccccatagaaaagacaattagcaaagctaagggccagccacgagagccacaagtctacacactgcctccttcaagagatgaattgaccaagaaccaggtgtccctcacatgtctcgtgaaggggttttaccctagtgatatagcagtggagtgggaatccaacggacagcctgagaataactataagacaacaccaccagtgctggattccgacggatcgttttttctttacagcaaactgacggttgataagtccagatggcagcaaggcaatgtgtttagttgtagtgtgatgcacgaagctctgcataaccactatacacagaaatccttgagcctgtccccgggaaag

SEQ ID NO: 15584 - DNA, 1149 bp, Artificial Sequence
  Description of Artificial Sequence: Synthetic coding sequence
atgggagtgctactcactcagcggactctgttatctctagtgttggctctcttattcccttctatggcctcaatggccatgcatgtggcccagcctgctgttgtcttggcaagtagtagggggatcgcgtcattcgtttgtgaatatgcatctcccggaaaggccactgaggtcagggtaacggtgctgagacaggccgactcacaggtgacggaggtctgcgcggccacatacatgatgggaaatgaactgactttcctcgacgactctatatgcacagggacttcttccgggaatcaggtgaacttaactatacaggggctgcgagcaatggatactggactgtacatatgcaaagtagaactgatgtatccacctccctattacttggggataggaaatggaacacagatctatgtgatcgatcccgagccatgtcctgattcagatcaggaaccaaagtcgtccgataaaactcatacatcccctccttctcctgcacccgagcttctcggggggagttctgtttttcttttcccacccaagccaaaagatactcttatgatttcaagaacaccggaagtaacatgtgtggtagtcgatgtttctcacgaagatcctgaagtgaaatttaattggtatgtggatggagtggaagtgcataatgccaaaacaaaacctagagaagaacagtataatagtacatatcgcgtggtgagtgtgttaactgtccttcaccaggactggctcaatgggaaagaatacaagtgtaaagtttccaacaaggcacttcctgcccccatcgaaaaaactatttcaaaagctaagggacagcctcgggaaccccaggtatacactctgcccccatccagagatgaactgactaaaaatcaggtttccctgacatgtcttgtgaaagggttttatccttccgatatagccgtcgaatgggaatccaatgggcagcctgaaaacaactataaaacaacacccccagtactggacagtgatggatcctttttcctatattccaagctgactgtagataaaagtaggtggcagcagggaaacgtattctcctgctctgtgatgcacgaagctttacataaccattatacacagaagagtctgtctctctccccagggaaa

SEQ ID NO: 15585 - DNA, 1149 bp, Artificial Sequence
  Description of Artificial Sequence: Synthetic coding sequence
atgggagtgctgctgacccagcgcaccctgctgtcactcgttctggctcttctcttcccgtccatggcctccatggccatgcacgtggcccagcctgccgtcgttctggcttcatccaggggtatcgcctcgttcgtctgtgaatacgcaagcccgggtaaagctactgaggtgcgcgtgaccgtgttgagacaagctgacagccaggtgaccgaggtgtgcgccgcaacttacatgatgggaaatgaattgaccttcctcgacgactcgatctgcaccggaactagctctggcaaccaggtgaacctgactatccaagggctgcgggctatggacaccggtctgtacatctgcaaagtggaacttatgtacccgcccccttattacctggggattggcaatggcactcagatctacgtgatcgatcctgagccctgtccagactccgatcaggaacctaaaagctcagataagactcatactagccccccgtcgcctgcccccgaattgctgggtggatccagcgtctttttgttcccgcctaaaccgaaagacactcttatgatcagcagaactccagaggtgacttgcgtggtcgtggacgtctcgcacgaggacccggaagtcaagttcaactggtacgtcgatggggtggaggtccataacgccaagaccaagccaagggaggaacaatacaactccacttaccgggtggtgtccgtgctgaccgtgctgcatcaagactggctgaacgggaaagagtacaaatgcaaagtgtcgaacaaggcattgccagcgccaatcgaaaagaccatctcgaaagcaaaaggccaaccgagagaaccgcaagtgtacaccctgcccccaagccgcgacgaactcaccaagaaccaggtttcgctcacttgcttggtgaagggattctacccgtccgatattgcggtggagtgggagtcgaacggacagcctgaaaacaattacaagactaccccaccggtgctcgactctgacggctccttcttcctgtactcgaagctgactgtggacaagtcgcgctggcagcaaggaaacgtgttctcgtgctcggtgatgcacgaggccctccacaatcattatacccagaagtcactctcgctgagccctgggaag

SEQ ID NO: 15586 - DNA, 1149 bp, Artificial Sequence
  Description of Artificial Sequence: Synthetic coding sequence
atgggcgtgttgctgacccaacgtaccctgctgagcctggtcctggcactgctctttccgagcatggccagcatggccatgcacgtggctcaaccggccgtggtgttggcgagtagcagaggaatcgcctcgttcgtctgtgaatacgctagccctggtaaagcaaccgaggtgcgtgttacggtcctgcgccaggctgattcccaggtcaccgaagtatgtgccgcaacctacatgatgggcaatgaactgacctttctggatgattctatctgcaccggtaccagttccggtaaccaagtcaacctgacgattcaaggtctgcgcgccatggacactgggttatacatatgcaaagtcgagctgatgtaccctccgccctattacttgggtatcggtaatggcacgcagatctacgtcatcgatccggagccgtgccctgactccgaccaggagcccaagagcagcgataaaactcacacaagcccaccgagccctgctcccgagctgctgggtggcagctctgtgttcctgtttccgcctaagcctaaggatactctgatgattagcaggactcctgaggtaacgtgcgtggttgtggatgttagccacgaagatcctgaggttaaattcaattggtacgtggatggggtcgaagtccataacgcgaaaactaagccacgcgaggagcagtacaatagtacctatcgggtggtgagcgtcctgactgtgctgcaccaggattggctcaacggtaaggaatacaagtgcaaggtgtcaaataaggccctaccggccccgattgaaaagaccatcagcaaggctaaaggccagccacgcgagccacaggtgtatactctcccgccaagtagagacgagttgaccaagaaccaggtctcgctgacctgtctggtgaaaggattttatccgtctgatatagccgtggaatgggagagcaatggtcaaccagagaataactacaaaactactcctcctgttctggacagcgacggtagcttttttttgtactctaagctgacagtggacaagtcgcggtggcagcaaggcaatgttttttcatgtagcgtcatgcacgaggcgttgcataatcactacacccagaaaagcctgagcctgtctcctggtaag

SEQ ID NO: 15587 - DNA, 1149 bp, Artificial Sequence
  Description of Artificial Sequence: Synthetic coding sequence
atgggggtgctgttgacgcagagaacgctgttgtcgcttgttcttgccctgctgttcccgtcgatggcctcgatggccatgcacgtggcccagccggcggttgtgttggcaagctcgcgcggaatcgccagcttcgtctgcgaatacgcgtccccagggaaggctactgaggtgagagtgactgtgctcagacaggcggattcccaagtgactgaagtgtgcgccgctacttacatgatggggaacgagctgactttcctcgacgactcgatctgtactggaacctcatccggcaatcaagtgaacctcaccatccaaggactgcgggccatggacactggtctttacatttgtaaggtcgaactgatgtacccgccgccctactacctgggaatcgggaacggaacccagatctacgtcatcgatcctgagccctgcccggatagcgaccaagaaccaaaatcttccgacaaaacgcacacttcgcctccttcgcctgcccctgaactgctgggaggaagcagcgtgttcctttttccacccaagccaaaggatactttgatgatctccaggactccagaagtgacttgcgtggtggtggatgtctcgcacgaggatccggaagtcaagttcaactggtacgtggacggagtggaagtgcacaatgcaaagaccaagccgagggaagagcagtataactcgacctaccgggtggtgtccgtccttaccgtcctgcaccaggactggctgaatggcaaggaatacaaatgcaaggtatcgaacaaagcactgccagctcctatcgaaaagactatctcgaaagctaagggacaaccccgcgagcctcaggtgtacaccctgccgccatcgagagacgagctcaccaagaatcaggtgtcactgacttgcttggtgaaaggcttttacccatcggacatcgccgtcgaatgggagtcgaatggccaaccagagaataactacaagaccacgcctccggtgctggattcggatggctccttctttctctactcaaagttgactgtggacaagagcagatggcaacaaggaaatgtgttctcatgttcggtgatgcatgaagcccttcacaatcattacacccaaaagagcctcagcctgtcaccgggaaag

SEQ ID NO: 15588 - DNA, 1149 bp, Artificial Sequence
  Description of Artificial Sequence: Synthetic coding sequence
atgggagtgctgttgacgcagcggacattgctttctctagtgctggctctgttattccctagcatggcaagcatggccatgcatgtcgctcagccggcggtggtcctggccagcagtaggggaatcgcaagtttcgtatgtgaatacgcatcccctgggaaagcaaccgaagtccgggtgaccgtgttacgacaggccgactcccaagttaccgaggtatgtgcagccacctacatgatggggaatgagctaactttcctagacgactctatttgcactggaacgagctccggcaaccaggtgaatctgacaatacagggtttgagggcaatggataccggtctatacatctgcaaggttgagctgatgtatccccctccttactacctcggaatcggaaacgggactcaaatctacgtaattgaccctgagccttgtccggactcggatcaggaaccaaagagctcagataagacccatacttcacctcccagtcccgcgcctgagctcctcggaggctcatcagtgttccttttcccccccaaacccaaagataccctgatgatttcccgtacgcctgaagtaacctgcgtcgtagtcgacgtgagtcatgaagaccctgaggttaagtttaactggtatgttgatggcgtcgaggtacacaacgctaaaaccaagccaagagaagagcagtataactccacctatcgcgtggtgtccgtcctgacagtgcttcaccaggactggctcaatgggaaagaatacaaatgtaaggtatccaataaagccttgccagcccccatagaaaagacaatttcaaaggccaaagggcagccccgcgaaccccaggtgtataccctgcctccatcacgtgatgagctcactaaaaatcaggtgtccttaacatgcctcgttaaaggtttctatccctcagacattgcggtggagtgggaaagcaacggacagcctgaaaataactacaagaccacacctcccgtgctcgattccgacggctccttctttttgtacagtaaactgacagtagacaagtcaaggtggcagcaaggcaatgtgttttcctgttccgtgatgcacgaggccctgcacaaccactatacccagaaatccttgtctttgagtcccggcaag

SEQ ID NO: 15589 - DNA, 1149 bp, Artificial Sequence
  Description of Artificial Sequence: Synthetic coding sequence
atgggggtgcttcttacgcaacgcaccctcctgtcgttggtgcttgcacttctcttcccatcgatggcgtcgatggctatgcatgtggcgcaacctgcagtcgtgcttgcatcatcgcgtggcatagcatcatttgtgtgtgaatatgcatccccgggaaaggccactgaggtcagagtgacggtgctccgtcaagctgattcacaggtgactgaggtgtgcgcggccacctatatgatgggtaacgaactgactttcttggatgatagcatctgtaccgggaccagctctggtaaccaagtgaacctgactattcaaggtctgcgtgccatggatactggtctgtacatctgcaaagtggaactgatgtacccgccaccttactaccttggaatcggtaacggtactcagatatacgtgatcgatccagagccatgtcctgactcggaccaagaaccaaagagctcagataagacccataccagcccgccttcgccagcaccagaactgctcggaggatcgtccgtctttctgttcccccctaagccaaaggatacccttatgatttccagaactccggaagtgacgtgtgtggtcgtggatgtgtcccatgaagatcccgaagtcaagtttaactggtacgtggatggtgtcgaagttcacaatgccaagactaagccccgggaggagcagtacaacagcacttacagagtcgtgtccgtgctgactgtcctccatcaggattggctcaatggtaaggagtacaagtgtaaggtcagcaataaggcactgcctgcaccaattgaaaagaccatctcgaaggcaaaaggccagcctagagaaccgcaagtgtacactctgcccccaagcagagacgaactcaccaagaaccaggtgtcccttacttgccttgtcaagggtttttacccatcggatattgcggtggaatgggagtcgaatggtcagcccgagaataactataagaccactcctcctgtgcttgattccgacggatcgttttttctgtacagcaagctgaccgtcgacaagtctcgctggcagcaaggcaacgtgttttcgtgcagcgtgatgcatgaagcactgcataatcactacactcagaagtctctgagcctttcccccggtaaa

SEQ ID NO: 15590 - DNA, 1149 bp, Artificial Sequence
  Description of Artificial Sequence: Synthetic coding sequence
atgggagtgctgttgacccagcgtaccctgcttagcctggtgctggcactgctgtttccaagcatggcatcaatggccatgcatgtggcgcagcccgcggttgtgctggcaagctcgcggggaatagcgagctttgtttgtgaatacgcctcacccggaaaagccacggaggtgagggtgactgtcctccgacaagccgattcccaagtgaccgaagtgtgtgcggccacttacatgatgggtaacgaactgacttttctggatgactcgatttgcacgggtacgtcctccgggaaccaagtgaacttgactatccagggattgagggcaatggatactggtctttacatctgtaaggtggaattgatgtaccctccaccctactatcttgggatcggcaacggaacccagatttacgtcattgatcccgaaccttgccccgattcggatcaagaaccaaagtcctcagacaagacccataccagcccacccagccccgccccagaattgctgggaggctcctccgtgtttctgttcccacctaagccgaaggataccctgatgatttcccggacgcctgaagtcacctgtgtggtcgtggatgtgtcccatgaagatcctgaggtgaagtttaactggtacgtggatggcgtggaggtccataacgccaagaccaaacctagagaggaacagtacaacagcacctatagagtggtgagcgtgctgactgtgcttcatcaagattggctgaatggaaaagaatacaaatgtaaagtctcgaacaaggctcttccagctccaattgaaaagaccatctccaaggcaaagggtcagccaagagaaccgcaagtctacaccctgcctccatcccgggacgaacttaccaagaatcaagtctccttgacttgtctggtcaagggtttctacccttccgatatcgcagttgaatgggagtcaaacgggcagcctgaaaacaattacaagactacccctcctgtgcttgattcagacggttcattctttctttactcgaaactgacggtggataagtctaggtggcaacaaggaaacgtgttctcgtgtagcgtgatgcatgaggcgctgcataatcattacacccaaaaatcactctccctctccccaggaaag

SEQ ID NO: 15591 - DNA, 1149 bp, Artificial Sequence
  Description of Artificial Sequence: Synthetic coding sequence
atgggggtgctgctcacacagagaaccctgttatctctggtcctggccctcttgtttcctagcatggcctccatggcaatgcatgtggctcaaccggctgtcgtgctggcttccagtcgaggcatcgcctcttttgtgtgcgagtatgcctctccgggcaaggctactgaagtgcgggtaaccgttcttaggcaggccgactcccaggttacagaggtgtgcgccgctacgtatatgatgggaaacgagctgacattcctagatgactcgatctgcactggaacctcaagtggaaatcaggtgaacctgactatccagggcctccgagccatggataccgggctgtacatctgcaaggtagagctcatgtatcctccaccatactacctgggaatcggcaatggaacgcagatttacgtcatcgatccggagccctgcccggattccgatcaggagccaaaatccagcgacaagacacacactagccctccaagccccgcgcccgagttgctcggaggctcgagtgtttttctgttcccccccaaacccaaagatactctaatgattagcagaacccccgaagtcacatgcgtcgttgtcgacgtgagtcatgaggacccggaggttaaatttaactggtacgtggatggcgtagaggtgcataacgctaaaaccaaaccacgggaagagcagtataactctacctaccgagtggtgtccgtcctgaccgtgcttcaccaagactggttgaacggaaaagaatacaaatgtaaagtgtctaataaagctttgccagctcctatcgaaaagacaatctcaaaagcgaagggacaaccacgggagccacaggtctacaccctgccacccagtcgagacgagctgacaaaaaatcaggtgtcactcacatgcttggtcaaaggcttctacccatccgacatcgccgttgagtgggaatctaatgggcaaccggagaataactacaagaccaccccacctgtgctggactctgacggctctttcttcttgtactccaagctgacagttgataagagcaggtggcaacagggcaatgtgttctcgtgcagcgtcatgcacgaagctttgcacaaccactatacacagaagtctctgtctctcagtcctggcaag

SEQ ID NO: 15592 - DNA, 1149 bp, Artificial Sequence
  Description of Artificial Sequence: Synthetic coding sequence
atgggggtcctgttgacgcagcggacgttgctatccctggtcttggccctcctattcccctccatggcttccatggcgatgcacgtggcgcagcctgctgtcgttttggctagttctagaggcatcgcttcctttgtgtgtgagtatgctagcccaggaaaggccaccgaggtgcgagtgactgtcctccggcaagcggattctcaggtaacagaggtgtgcgccgcgacgtatatgatggggaacgagttgacatttctcgacgactccatctgtacagggaccagctcagggaaccaggtgaaccttaccatccagggcttgagagccatggacaccggactgtatatttgcaaggtcgagctgatgtatcctcctccttattatctgggcattggaaacggtacacagatctacgtgatagaccccgagccctgcccagattcggatcaggagcctaagtcttctgataaaacccacacctcgccaccatctcccgcccctgagctactgggcggcagttcagtctttctgttcccccctaagcccaaggatacgctcatgattagcagaactcctgaggttacctgtgttgtcgtagacgtctcccacgaagatcccgaggttaagtttaactggtacgtcgacggagtggaggtacataacgcaaaaacgaaaccgagggaagagcagtataattcaacttatagagtggtgtcggtgcttacggtgcttcaccaggactggctgaatgggaaagagtacaagtgtaaagtgagcaacaaggccttgcctgcccctatcgagaaaacgatcagcaaagcgaaaggccagccaagggaaccccaagtgtacacacttcccccaagccgggacgagttgaccaagaaccaggtgtctctgacatgcctggtcaagggcttctatccttcagatattgctgttgagtgggaatctaacggacagcctgagaacaactataagacaactccccccgtgctagatagcgacggaagctttttcctctattccaagctgacagttgataagagcagatggcagcagggaaacgtgttcagctgcagtgtgatgcacgaagcgcttcataaccattatacccagaaatcgctcagtctgtcgcctggcaag

SEQ ID NO: 15593 - DNA, 1149 bp, Artificial Sequence
  Description of Artificial Sequence: Synthetic coding sequence
atgggagttttgcttacccagagaactctgctgtcactagtgttggcgctgctatttccttctatggccagtatggcgatgcacgtggcccagcctgccgtagtactggcatcttccagaggcatcgccagttttgtctgtgaatacgcctcccctgggaaggctaccgaggttcgagtgacagtcctgcgtcaggccgattcacaagtgacggaggtgtgtgcggctacctatatgatgggcaacgagctgacgttccttgatgatagtatctgcaccggaacttcttcagggaatcaggtcaaccttacaatacaaggcctgcgtgctatggatacaggcctgtacatctgtaaagtcgagctaatgtatcctcctccctactacctcgggatcggaaacggaactcaaatctacgtgattgatccagaaccctgccctgattccgaccaagagccaaaaagtagcgataagacacatacctcccctcctagccctgcccccgaactacttggggggagttcagtgttcctgtttccccccaaacccaaggacactctcatgattagtcgcacacctgaggtgacctgtgtggtggttgacgtgtctcatgaggaccccgaggtgaagttcaattggtatgtggatggagtggaggtccataatgcaaagacaaagcctagagaagaacaatacaactccacttatcgggttgtgtctgtgctgaccgtgttgcaccaggattggcttaatggtaaggaatataagtgtaaagtctccaacaaagccttacccgcccctatcgaaaagactatctccaaggctaaagggcaaccacgggaaccgcaggtctacaccctcccaccatcccgcgatgaactgacgaaaaaccaggtgtccctaacgtgtctcgtgaaggggttttaccctagcgatatcgctgtcgaatgggaatcaaatgggcagcccgaaaacaattacaaaactactcctcccgtcctggatagcgacggctcttttttcttgtacagtaaactgactgttgacaagtcccggtggcagcagggcaacgtgtttagttgtagcgtgatgcacgaggccctccataaccattatacacagaagagcctctctctgagcccaggcaag

SEQ ID NO: 15594 - DNA, 1149 bp, Artificial Sequence
  Description of Artificial Sequence: Synthetic coding sequence
atgggggtcctcctaacgcagcgtactttgctgtccctggttctcgctttgctctttccttctatggcgtcaatggcgatgcacgtcgcccagcccgcagtagtacttgcctcaagtagagggatcgccagtttcgtatgtgaatatgccagtcccggaaaagcaacagaggttagagttaccgtgctgagacaggccgattctcaagtgacagaggtatgcgccgccacctacatgatgggcaacgagctcacattcttggatgattccatttgtacaggaacctccagcggtaaccaggtcaaccttaccatccaggggctgcgcgccatggacacaggcctttatatttgcaaggtcgagttgatgtatccaccaccatattatctgggcatcggtaatggcacccagatctacgtgatagaccctgagccctgccccgactctgaccaggaacccaaatcatccgataaaactcataccagcccaccatcgccagcgcccgagctgttggggggctcctcggtgttcctgtttcctccgaagcccaaggacactctaatgatctcgcggacccccgaagtgacctgcgtcgtggtggatgtctctcatgaggacccggaagtcaaatttaattggtatgtcgatggggttgaggttcacaatgccaaaactaaaccccgggaggaacagtataacagtacctatcgagtggttagcgttctgaccgttctccaccaggattggctgaatggcaaggagtacaagtgcaaagtgtcaaacaaagcgctacctgcccccattgaaaagacgatctccaaggccaagggccagccgagggagccacaggtgtacactttacccccaagccgcgacgaactgactaaaaaccaggtgtcactgacatgtctcgtgaagggattctatcccagcgatattgccgtggaatgggagtcaaacgggcaacccgagaacaattacaagaccacacctccagtgctggattccgacggctccttcttcctctattccaaactgaccgtggacaagagcaggtggcagcagggcaatgtcttcagctgctctgtgatgcacgaggcattacacaatcattacactcagaagtcactatctttgagccctgggaaa

SEQ ID NO: 15595 - DNA, 1149 bp, Artificial Sequence
  Description of Artificial Sequence: Synthetic coding sequence
atgggcgtgctgttgactcagcgaacattgctcagtcttgtgctcgcactgctctttccaagtatggcgtctatggcaatgcacgtggcccagccagccgtggtactggcctcctcccgaggtatcgcctccttcgtctgcgaatatgcatcccctgggaaggctactgaagtacgagttacagtcttgcgtcaggctgatagtcaggttactgaagtttgcgcagctacctatatgatgggaaatgaactgacgttcttggacgatagtatatgcaccggcacatcatctgggaaccaagtgaatctaacgattcagggcctcagagcaatggacaccgggctgtacatatgcaaggtggagttgatgtatccgccaccgtactatctgggaattggtaatggcacccagatatacgtgatcgatcccgagccgtgtccggatagtgatcaggaaccgaagagttctgacaaaacccacaccagtcccccctcccctgcccctgagctcctgggcggcagttctgtcttccttttccccccgaagcctaaggatacactcatgatcagccgaacaccagaagttacttgtgtggtggtcgatgtctcacatgaggatcccgaggttaagtttaactggtacgtggatggcgtggaggtgcataacgctaaaacaaaaccgcgagaagagcaatacaattctacctatagggtggtgtcagtgctgaccgtgctgcaccaggattggcttaatggaaaggagtacaagtgtaaagtttcaaataaggctctaccggccccaatagagaagaccatttccaaagccaaagggcagcccagggagccgcaggtttacactttgcccccttcacgcgatgagttgaccaagaaccaagtttccctgacctgccttgtgaaggggttttacccatctgatattgcagtcgaatgggagtcaaacgggcaacccgagaacaactataagaccacaccccccgtcctggactcagatgggtcattcttcctgtacagcaaactcaccgtggataagagtcgatggcagcagggcaacgtcttcagctgctccgtgatgcacgaggccctgcacaaccactacacacaaaaatcactctcactttctccagggaag

SEQ ID NO: 15596 - DNA, 1149 bp, Artificial Sequence
  Description of Artificial Sequence: Synthetic coding sequence
atgggtgtgctgttaacgcaaaggacactgttgtctctagtcttggccctcctctttcctagcatggcatcaatggctatgcacgttgcacagccggctgttgttcttgcatcgtctagagggattgcaagctttgtgtgcgaatacgcttcgccaggaaaagccacagaggtccgcgttactgtactacgtcaagcggatagtcaagtcactgaggtgtgtgctgcaacatatatgatgggaaacgaactcacatttcttgacgacagcatttgtactggaaccagttcaggaaaccaagttaatttaactatccaaggactgagagcaatggatacaggactgtatatttgcaaagtagagttgatgtatcctccaccatactaccttggaatcggaaatggaacacagatctatgtaatcgatcctgaaccatgtccagatagcgaccaagaaccaaaatcgtctgataaaacacatacctcgccccccagtccggcaccagagttgctgggcggatcatcagtgtttttattccccccaaaaccaaaagatacacttatgattagtagaacaccagaggtgacgtgcgtggtcgttgacgtatcacacgaagacccagaagtcaagttcaactggtatgttgatggagtcgaggttcataatgccaagacaaaaccacgcgaagagcagtataactcaacgtatagagttgtttctgtcctcacagttctgcatcaggattggttaaacggtaaagaatataaatgcaaagtcagcaacaaagcattgcctgctccaattgaaaagactatttctaaggcaaagggtcaaccacgtgagccacaggtttatacactcccaccatcacgcgatgagcttacgaaaaatcaggtttcgcttacatgcttggtgaaaggattttatccgtctgacatcgccgtggaatgggaaagtaacggacagccagagaataattataagacgactccaccagtgctcgattctgatggatcttttttcttatattcgaagcttactgtcgacaaatccagatggcaacaaggaaacgttttttcctgctcagtcatgcatgaagctctccacaatcattacactcaaaaatccctcagtttgtctcccgggaag

SEQ ID NO: 15597 - DNA, 1149 bp, Artificial Sequence
  Description of Artificial Sequence: Synthetic coding sequence
atgggagtattgctgacacagagaacacttctaagtctcgtgttggcccttctatttcctagtatggccagtatggcaatgcatgttgcacagccagcagtcgtcctggcctcatcaagaggaatcgcttcttttgtgtgcgaatatgcaagtccaggaaaagctactgaagtacgggtaactgtccttaggcaggctgattcccaggtcacagaagtgtgtgccgcaacatacatgatggggaacgaactcacattcctcgatgattcgatatgtactggaacgtcgtcagggaaccaagtcaatttaactatccaggggctccgggctatggatactgggctctatatatgcaaagtcgaactcatgtatccaccaccctactacctggggatagggaacggaacacagatctatgtaattgatccagaaccctgccccgattcagatcaggaacccaaatcatccgacaagacacatacgtctccaccttcccccgcaccagaacttctgggagggtcgtccgtctttctctttcctcctaaacccaaagatacattgatgatctccaggacacctgaagttacatgtgtggtcgtggatgtatcacatgaagatcccgaagtaaaatttaattggtatgtagatggagtcgaagttcacaacgccaagacaaaacctcgggaagagcagtataattctacttatagagtagtgagtgtgctaacagttttacatcaggattggctgaatggaaaagaatataaatgtaaagtaagtaacaaggctctccctgctcctattgagaaaacaatctcaaaagccaagggacagccacgcgaaccccaggtctatacactgccaccatcgagggatgaactcacaaaaaatcaggtgtctttaacttgcctcgtaaaagggttttacccctctgatatagcagtagaatgggaatcaaatgggcagccagaaaacaattataaaactacaccccccgttttagactctgatggatcattttttctgtatagtaagctaacagttgataagtcccggtggcagcaggggaacgtgttttcctgttctgttatgcacgaagctctccataatcattatactcagaagtcccttagtctatcacccggaaaa

SEQ ID NO: 15598 - DNA, 1149 bp, Artificial Sequence
  Description of Artificial Sequence: Synthetic coding sequence
atgggcgtgctgctcacgcagaggactcttctgtcactggttctggcccttctgtttccatctatggcttccatggcaatgcacgtggctcagccggcggtcgtgcttgcatcctccaggggaatcgcgtccttcgtgtgcgagtacgctagccctggaaaggccaccgaggtgagagtcactgtgctgaggcaagcggacagccaggtgacggaggtctgcgcggcaacctacatgatgggcaacgaactgacgtttttggacgactccatctgtaccggcacttcgtcggggaatcaggtcaacctcactatccaaggactgagagccatggataccggactgtacatttgcaaagtcgaacttatgtatcctccaccttattacctcggaattggaaatggaactcagatctacgtcatcgacccggagccatgcccagattctgaccaagagccgaagtctagcgacaaaacccacacttcgccaccgtcaccggcaccggagctcctcggaggttcgagcgttttcctgttcccgccgaagccgaaggacacccttatgatctcccgtactccggaagtgacctgcgtcgtggtggacgtgagccatgaagatccggaagtgaaattcaactggtacgtggacggtgtggaagtgcacaatgcaaagactaagccaagagaggaacaatacaactcaacgtaccgcgtggtgagcgtgctcactgtcctccatcaggactggcttaacggaaaggaatacaaatgtaaggtgtcgaataaggccctgccagccccgattgaaaagaccatctcaaaagccaagggccaaccgcgcgaaccccaggtctacactcttcctccgagccgcgatgaactgactaagaaccaggtatcactgacctgcctcgtcaaaggcttttacccaagcgatatagccgtggagtgggagtcgaacgggcagcctgagaataactacaagactactccgccggtcctggatagcgacggatcgttcttcctgtactcaaagttgaccgtggataagtcgagatggcaacaaggtaacgtgttcagctgctctgtgatgcacgaggcgctgcataaccactacactcagaaaagcctgtcgctgagcccgggcaag

SEQ ID NO: 15599 - DNA, 1149 bp, Artificial Sequence
  Description of Artificial Sequence: Synthetic coding sequence
atgggtgttcttcttacccaacgaaccctcctctccctggtccttgccctgctgttcccttcgatggcgtcaatggctatgcatgtggcccaacccgccgtggtcctggcaagcagccgaggaatagcatcgtttgtctgtgaatacgcttccccaggaaaggcaaccgaggtgcgggtcactgttcttcgccaagcggacagccaggtcactgaagtgtgcgcggccacgtacatgatgggaaacgagctcaccttcctggatgactcaatatgtaccggtacgagctcgggcaatcaggtaaaccttaccatccaaggacttagggcaatggataccggcctttacatttgtaaggtcgagctgatgtaccctccaccctactatctgggaatcggtaacggaactcaaatctacgtgattgatccagaaccctgtcctgattcggatcaggaaccgaaaagttcagacaagactcacacctcgccacctagcccagcacctgaactgctggggggctcaagcgtgttcctttttcctccaaaaccaaaggacacccttatgatcagtagaacccctgaggtgacgtgcgtcgtggtggacgtctcccacgaggaccccgaagtcaagttcaactggtacgtggatggcgtggaagtgcataacgcaaagactaagccaagagaggaacagtacaattccacgtatagagtggtcagtgtcctgactgtcctccatcaagactggctcaacggaaaggagtataagtgtaaggtgagcaataaagcacttccagcaccgatcgagaaaactatttcaaaggcaaaagggcagcccagggaaccgcaagtgtacactcttcccccctcacgagatgaactcactaagaaccaggtgtcgctgacttgtctggtgaagggattctatccttcagatattgcggtggagtgggaatccaacggtcagccagaaaacaattacaagacgacccctcctgtgctcgacagcgatggttcgtttttcctctactccaaacttactgttgataaatcccggtggcaacagggtaatgtgttttcctgctctgtcatgcacgaggcactccataatcattatactcaaaagtcgttgtcattgtcccctggcaag

SEQ ID NO: 15600 - DNA, 1149 bp, Artificial Sequence
  Description of Artificial Sequence: Synthetic coding sequence
atgggagttctcctgactcagaggaccctgctctccttagtcctggccctgctgttcccctccatggcatcaatggctatgcacgtggcgcagcccgccgtcgtcctggcttccagcagggggatcgcaagcttcgtttgtgagtacgcctcgccaggcaaggcgaccgaggtgagggtgacagtcctacgccaggcggacagccaggtgaccgaggtatgtgccgctacttacatgatgggaaacgagctgacctttctggatgattctatctgcaccggaacgtcctccggcaaccaggtcaatctaactatacaaggtttgagggccatggacacaggactgtacatatgcaaggtggagctaatgtatccgccaccatactacctggggataggcaacggaacccagatttatgtgattgatcccgaaccatgcccagacagtgatcaggagcccaagagcagcgataaaactcacacctctcccccctcacccgcccccgagctcctgggagggagttccgtgttcctcttccccccaaagccgaaggacacgctcatgatctcccgaacccctgaagtcacctgcgtcgtggtggatgtgagtcacgaggatccagaggttaaattcaactggtatgtcgacggagtggaggtccacaatgctaaaacgaagcctcgggaggaacaatacaactcaacgtatcgggtagtgtccgtgcttacggtcctacatcaggattggctaaacggaaaagagtataagtgtaaagtctcaaacaaggcactaccagctcccatcgaaaagactatctccaaggcaaagggccagcctcgcgagcctcaggtgtatacactgccgccctcacgagatgaacttactaagaaccaggtgtcactgacatgccttgtgaaaggattttatccatccgatattgcagtggaatgggagagcaacggccagcctgagaacaattacaaaaccacacccccagtgctggatagcgatggatctttttttttgtactcaaagctaaccgtggacaagagtcggtggcaacaaggcaatgtgttcagttgtagcgtaatgcatgaggccctgcacaatcactacactcagaaaagtctctctttgagtccagggaaa

SEQ ID NO: 15601 - DNA, 1149 bp, Artificial Sequence
  Description of Artificial Sequence: Synthetic coding sequence
atgggagtgcttcttactcagcgaacgcttctctcgttggtactggcacttctcttcccaagcatggcctccatggcaatgcacgttgcgcaaccagctgtcgtgctcgcatcgtcgcggggaattgcgtcctttgtttgcgaatacgccagccccggaaaagcaacggaagtgcgggtcactgtgctccgtcaagcagattcgcaagtcacggaagtgtgtgcagccacctacatgatgggtaacgagcttacttttctggatgattccatctgcaccggcacttcgtccggcaatcaggtgaaccttactatccaaggtctgcgcgccatggataccggactgtacatttgtaaggtcgaactcatgtacccaccaccttactaccttgggatcggaaacggaacgcaaatctacgtgatcgaccctgagccatgtcccgattcagaccaggaaccaaagtcgtctgataagacccatacctcacctccatcaccggcaccagagctgcttggtggctcctcagtctttctttttccaccaaagcctaaggataccctcatgatcagcagaaccccagaggttacgtgcgtggtggtcgatgtgtctcacgaggacccagaggtgaagttcaactggtacgtggatggtgtggaagtgcataatgctaagaccaaacccagggaggaacagtacaactcaacctaccgcgtggtttccgtgctgaccgtgcttcaccaggattggctcaatggcaaggaatacaagtgcaaggttagcaacaaagccctgccggcacccattgaaaagactatttccaaggcaaaaggtcaacctagggagccccaagtgtacacccttccccctagccgcgatgagctgaccaagaaccaagtgtcgcttacctgccttgtgaagggattttacccgagcgacattgcggtcgaatgggaatcaaacggtcagcctgagaataactacaagactacgcccccggtgctcgatagcgatggctccttttttctgtactcaaaacttactgtggataaaagccggtggcagcaaggtaacgtgttttcctgctcggtgatgcatgaggcattgcataatcattacacccagaaaagcctttccctgtcccccggaaag

SEQ ID NO: 15602 - DNA, 1149 bp, Artificial Sequence
  Description of Artificial Sequence: Synthetic coding sequence
atgggtgtgctgcttacacagaggacactactatctctagtcctagctttgctgttcccttcgatggctagtatggctatgcatgttgctcagcctgcagttgttctggctagttccaggggcattgcaagttttgtttgtgaatacgcctcccctggtaaggccaccgaggtgcgtgtgaccgttttgcgacaagccgacagccaagtgactgaagtttgcgctgcgacatacatgatggggaatgaactaacttttttggacgatagcatatgcactggtacaagctctggtaaccaagtaaacttaaccatacaaggcttgagagctatggatacgggcctatacatatgcaaggttgaattgatgtacccaccaccatattatctaggtatcggaaatggaacacagatctacgtgattgacccagagccttgtcctgactctgatcaggaacctaagagttctgacaaaacacatacttctcccccatctcccgctcccgagctccttggaggttcatccgtcttccttttccctcctaagccaaaggatacattgatgattagtagaacgccggaagttacctgtgttgtggttgacgtaagccacgaggatcctgaagttaagtttaattggtatgtggatggtgtggaagttcataatgctaagaccaaacctagggaagaacaatacaacagtacatatagggtcgttagcgttctcacagtcttgcatcaggactggctcaatgggaaggaatacaagtgcaaggtcagtaataaggcattacccgcgcctattgagaaaactatttcgaaggccaaagggcagccaagggagccccaagtttatacattgccaccaagccgtgatgagctgacgaaaaaccaagtttctctgacctgcttggttaagggtttttatcccagtgacatcgctgtcgaatgggagagcaacggacagccagaaaacaattacaaaactacaccaccagttttggattctgatggctccttcttcctctattctaagctgacagtcgacaaatcacgttggcaacaaggtaatgtgttctcttgtagtgtcatgcatgaggcacttcataatcattacacgcaaaagtctttgtccttgtcacctggaaaa

SEQ ID NO: 15603 - DNA, 1149 bp, Artificial Sequence
  Description of Artificial Sequence: Synthetic coding sequence
atgggagttctgctgacgcaacgaacgctgctgtcgctggtgttagcactgttattcccatctatggcttccatggccatgcatgtcgcacagcccgccgtggtacttgcctcgagccgaggaatcgctagctttgtgtgcgagtacgctagcccagggaaagccactgaagtgcgagtgacagtgcttcgacaggccgattctcaggtcactgaggtttgcgctgcaacctacatgatgggcaatgagttgacgttcctagacgactcaatctgtacgggtacaagtagcgggaaccaggtcaacctcacaatacaaggactccgtgccatggatacaggcctttatatctgtaaggtagaattgatgtatccacccccttattatctgggtataggcaatggaacgcagatttatgtcatcgaccccgagccttgccccgactcagatcaggaaccaaaaagttccgacaagactcataccagtccaccatcccccgcccctgagttgctggggggttctagcgtgttcctcttcccgccgaaacctaaggatacactgatgatttcccgaacacccgaagtcacttgtgttgtggttgacgtttcacacgaggacccagaggtcaagtttaactggtacgtagacggggtggaggtgcataacgcaaagacaaagcccagggaagaacagtacaactctacttacagggtggtgtctgtgctgaccgttctgcaccaagattggctgaacggcaaagagtacaagtgcaaggtatcaaacaaagccttgcccgcacccatagagaagacgatttcaaaggcgaagggtcagcccagagaacctcaagtatacacactacctccgagcagggatgagctaacgaaaaatcaggtgagtctgacttgcttggtcaaaggcttttacccctccgacattgcagtagaatgggagtctaatggacaacccgaaaacaactacaaaacaactcccccggttctggactcagatggctccttttttttgtactccaaattaacagtggataagtctcgctggcagcagggtaatgtgttctcgtgttcggtcatgcacgaagccctgcataatcattacactcagaagtctctttctttgtcccccggtaag

SEQ ID NO: 15604 - DNA, 1149 bp, Artificial Sequence
  Description of Artificial Sequence: Synthetic coding sequence
atgggcgttcttttgacccaaagaaccttgctctccctggtgctggcattgctttttccttcaatggcctccatggccatgcacgtagcccaaccggccgtggtgttggcatcatcacgcggtatcgcttccttcgtatgtgagtacgcatcaccgggtaaggccacggaagtcagagtgaccgtactcagacaggctgattctcaagttaccgaagtatgcgctgccacgtacatgatgggcaatgaactgacctttctggacgacagcatatgcaccggtaccagttccggtaaccaagtaaacctgaccatacaaggactcagagccatggataccggtttgtatatatgcaaggtagagctgatgtaccccccgccctactatcttggaatcggtaatggcactcagatttacgtgattgacccagagccatgcccagattctgatcaggagcccaagtcatctgataaaacacacacctcacccccctcaccagctccagaattgctgggcggctcctcagtattcctcttccctcccaagccgaaagacacactcatgatatctagaaccccagaggtcacctgtgttgtggtggacgttagccatgaagacccagaggtgaagttcaattggtacgtagacggagtcgaggttcataacgcgaagacaaaacccagagaagagcagtacaactccacatacagggtggtgtccgtccttacagtgctgcaccaggactggctgaatggaaaagagtacaaatgtaaggtttcaaacaaagctcttcctgcgcccatcgaaaagaccattagtaaggcaaagggccagccgagggagccccaggtgtatactttgcctccatcccgcgacgagctgacaaagaatcaagtttcactgacgtgcctcgtaaagggcttttatcccagcgatatcgcagtcgaatgggaaagcaacggtcagccggagaacaattataagaccacgcccccggtcctggattcagacggtagtttcttcctgtactcaaaactgacagtggacaagtccagatggcagcagggaaacgtcttctcctgtagcgtgatgcacgaggcactgcataatcattacacccagaaatctctgtctctgtcccccggaaag

SEQ ID NO: 15605 - DNA, 1149 bp, Artificial Sequence
  Description of Artificial Sequence: Synthetic coding sequence
atgggagtgctgcttactcaacgaacccttctgtccctggtcctcgccctgttgtttccatcaatggcttcgatggccatgcatgtggcacaacccgcagtggtgctggcgtcaagccgtggtatagcatccttcgtgtgtgagtacgcctcgccaggcaaggcgactgaagtgagagtcacggtcttgcgtcaggcagattcgcaggtgaccgaggtctgtgcagccacttatatgatgggtaatgaactgacttttctggatgactccatttgcaccggcacgagctccgggaaccaggtgaatcttactattcagggccttagagcaatggatactggcctttacatttgtaaggtggagcttatgtacccccctccgtactatctcggaataggtaacggaactcaaatctacgtgatcgatcctgagccttgccctgatagcgatcaagaacctaagtcatccgataagacgcataccagtcctccctcaccagcgccagagctcttgggaggatcttcagtttttctgttcccaccaaagccgaaggacaccctgatgatttcgcggaccccagaggttacttgtgtggttgtggatgtgtcgcatgaagatcccgaggtgaaattcaactggtacgtggacggggtggaagtgcacaatgcaaaaactaaacccagagaggagcagtacaattctacctaccgcgtggtgagtgtgttgaccgttcttcatcaagactggttgaacggaaaggaatacaaatgcaaggtgtcaaacaaggctttgccagccccaatcgaaaagactatttcgaaagcaaagggccagcctcgcgaaccgcaagtgtatacccttcctccttcgcgggacgagttgaccaagaatcaagtgagccttacctgtttggtgaaagggttctacccctcggacatcgctgtagaatgggagtccaacgggcagcccgaaaacaactacaagaccactcctcctgtcctggactcagatggttccttttttctctactccaagctgaccgtggataagagccgctggcaacaaggcaatgtattctcctgtagcgttatgcatgaagcacttcataaccactacacccaaaaatccctctcgctctcgccaggaaag

SEQ ID NO: 15606 - DNA, 1149 bp, Artificial Sequence
  Description of Artificial Sequence: Synthetic coding sequence
atgggagtgctgcttactcaacggactcttctgtcgctcgtgttggccttgctgtttccatcaatggccagcatggcaatgcatgtggcacaaccggcagtggtcctggcatcgagcagagggattgctagcttcgtgtgtgaatatgcgtccccgggaaaggcaactgaggtgcgcgtgactgtccttagacaagcggactcccaagtgaccgaggtgtgtgcggcgacgtacatgatgggaaacgagcttaccttccttgatgactccatatgcactggaactagcagcgggaaccaagtgaacttgaccattcaaggactccgtgcaatggacactggactgtacatctgtaaagtggagctcatgtacccacccccatactaccttggaatcggaaacggcacgcagatatacgtcattgatcccgaaccctgtcccgactccgaccaggaacctaagagcagcgacaagacccatacttcccctccttcgccggccccagaacttctgggaggctcgtcagtgttcctgtttcctcctaagccaaaggatactttgatgatctcccgtaccccagaagttacctgcgtggtcgtggatgtctctcacgaagatcccgaagtgaaattcaactggtatgtcgatggtgtggaggtgcataacgccaagacgaagcctcgggaagaacaatacaactcaacgtacagagtcgtctcggtccttaccgtgctgcatcaggactggctcaacgggaaggagtacaagtgcaaggtgtccaataaggctctccctgcaccaattgaaaaaactatctccaaagcaaagggacaaccacgagaaccacaagtgtacacccttccaccttcgagggacgaacttactaaaaaccaagtcagcctgacttgtctcgtgaaaggcttttacccgtccgatatcgcagtggagtgggaatccaatggacagccagagaataactacaagactacccctcccgtgcttgacagcgacggatcgttttttctgtactcgaaactgactgtggataagtcgaggtggcaacaaggaaacgtgttttcatgtagcgtcatgcatgaggcactgcataaccattacacccagaagagcctgtccctttcacctggtaaa

SEQ ID NO: 15607 - DNA, 1149 bp, Artificial Sequence
  Description of Artificial Sequence: Synthetic coding sequence
atgggcgtgcttcttacccagcgaaccctactttccttagtattggccctgctgtttccttcaatggctagtatggcaatgcacgtggcacaacctgccgtagtcttggccagttctcgaggtatcgccagtttcgtctgtgaatatgccagccccggaaaagctacggaagtccgagtgactgttcttagacaggctgacagtcaggtgacagaggtatgcgccgccacctatatgatgggaaacgaactcaccttcttggacgactctatttgcaccgggacttcaagcggaaatcaggtcaacctgaccattcagggcttgcgcgccatggataccggactctacatctgcaaagtggaactgatgtacccgcccccttactacctgggcataggcaacggcacgcagatctacgtgattgatccggagccatgccccgattctgaccaggaaccgaaatctagcgacaaaactcacacctccccaccatcgcccgctccggaactattggggggatcttccgtgttcctgttcccgcctaaaccaaaggataccctgatgatttcacgaacgcccgaggtcacctgtgtggtagtggatgtgtcacacgaggacccagaggttaagttcaattggtacgtcgatggagtagaggtacacaacgccaagacaaagcctagagaggagcagtataactccacataccgggttgtcagcgtgctcaccgtgctccaccaggattggcttaatggtaaagaatacaagtgtaaggtatccaataaggcgctccccgcacctatcgagaagactatcagcaaagccaaaggacaaccccgtgaacctcaggtgtatacactgcctccttccagagatgagctcaccaaaaaccaagtgagtttgacttgcctcgttaagggcttctacccatccgacatcgctgtggagtgggaaagtaatgggcagccagagaacaattacaagaccacccctccagtcctggattctgatgggtccttctttctgtattccaaactgacggtggataagtcaagatggcagcaaggaaatgtcttcagctgttctgttatgcacgaggccctgcacaaccactatacacaaaagtctttatcgttaagtcctggcaaa

SEQ ID NO: 15608 - DNA, 1149 bp, Artificial Sequence
  Description of Artificial Sequence: Synthetic coding sequence
atgggggttctgctgacacagagaacattattatctcttgttctcgctctactgtttccctccatggcatcaatggccatgcacgttgcccagcctgctgttgtgctggccagttctcggggcatcgcttcatttgtgtgcgagtatgccagtcccgggaaagccacagaggtgagggtgaccgtgctacgccaagccgattcccaggtgaccgaggtgtgcgctgctacatacatgatgggcaacgaactgaccttcctggacgacagcatctgcactggtacttcttctggaaaccaagtgaatctcactatccagggtctgcgcgcaatggatactggcctgtacatttgtaaggttgaactgatgtaccccccaccctactatctcgggattgggaacgggacccaaatctatgtgattgaccccgaaccgtgtccagactcagatcaggagcccaagtcttccgataagacacacaccagccctcccagtccagcccctgagctgctaggcggaagctctgtgtttctgtttccacctaaacctaaggacacactgatgatcagtcgcacccccgaggtgacctgcgtcgtggtagatgtatcccatgaggatcctgaggttaaattcaactggtacgtagatggcgttgaggtgcacaacgctaaaacaaagccaagagaagagcagtacaattccacataccgcgtggttagcgttctgaccgttctgcatcaggactggttaaacggaaaggagtacaagtgcaaggtctccaataaagcactgccagcacctattgaaaagacaataagcaaagcaaaaggccagccacgagaacctcaggtttatactctccctccttcaagagacgaactcacaaaaaatcaggtgagcctcacatgtctggttaaaggattctacccttccgatatcgctgtcgagtgggagtctaacgggcagccagagaacaattataagactaccccccccgttttagactccgacggctcatttttcctctattccaaactcaccgttgacaaatcccgctggcagcaaggcaacgtcttctcctgttccgtcatgcatgaagcactgcacaaccattatacccagaaaagcctgtctctgtcaccaggcaag

SEQ ID NO: 15609 - DNA, 1149 bp, Artificial Sequence
  Description of Artificial Sequence: Synthetic coding sequence
atgggggttctgctgacccaacggactctcctgtccctcgtcctggcgctcttgttcccttcgatggcctcaatggcgatgcacgtcgcccagcctgcggtggtcctggcctcgtcgcgcggaatcgcatctttcgtgtgcgaatacgcctccccgggaaaagccaccgaagtgcgcgtaaccgtgctcagacaggccgacagccaggtgaccgaggtctgcgccgccacttacatgatggggaacgagctgactttcctggacgacagcatctgtaccggaacgtcgtcgggaaaccaggtcaacctgactatccaggggctgcgggccatggacactggcctgtacatctgcaaggtggaactgatgtacccgccaccgtactacttgggaatcggaaacgggacccaaatctatgtgatcgaccctgagccatgtccggattcggaccaggagccaaagagctcggataagactcacacttccccgccgtcgccggccccggagctgctgggaggaagctcggtgtttctgtttccaccgaagccaaaggacactctgatgatttcccgcactcctgaagtcacttgtgtggtggtcgacgtgtcgcacgaggacccggaggtgaaattcaactggtacgtggacggtgtcgaggtgcacaacgctaaaaccaagccaagagaggagcaatacaactcgacgtaccgcgtcgtgagcgtgctgaccgtgctccaccaggattggctgaacggtaaggaatacaagtgcaaggtgtccaataaggcccttcctgcgccgattgaaaagactatttcgaaggcgaagggacagccgcgggagccgcaggtgtacaccctccctccgtccagggatgagctcacgaagaaccaggtcagcctcacctgcctggtgaagggtttctacccctcagacatcgcagtcgaatgggaatccaatggacagccggagaataactacaaaactaccccacccgtgctcgactccgacggatccttctttctctactcgaaactcaccgtggataagtcaagatggcaacagggcaacgtgttctcatgctcggtcatgcatgaggccctgcataaccattacactcaaaagtcgctgagcctgtcaccaggaaag

SEQ ID NO: 15610 - DNA, 1149 bp, Artificial Sequence
  Description of Artificial Sequence: Synthetic coding sequence
atgggtgtattactcacccaaagaactttgctttccctcgtcctggccttactttttcctagtatggcctctatggcaatgcacgtggctcaaccagcagtggtacttgctagctctcgggggattgcctctttcgtctgcgagtatgcttcacctggaaaagcaaccgaagttagggtgaccgtattgagacaagctgactcccaagttacagaggtttgtgctgcaacctacatgatgggaaatgagcttacatttctagatgacagcatatgcaccgggaccagcagcggaaaccaagtgaacctgaccatccaaggattgagggccatggacacaggactctatatttgtaaggtggaacttatgtacccacccccttactatctgggaatcggcaacgggacccagatctatgtcatcgaccctgaaccatgccctgattccgaccaagaaccaaagagcagcgacaagacgcacactagcccccctagcccagcacccgagttacttggaggatcgagtgtgtttttgtttccacccaagcccaaagatactctgatgatttcaaggacccccgaagttacttgcgtcgtagtcgatgtgagccatgaggatccagaagtgaagttcaactggtacgtcgatggtgtggaagtgcacaatgcaaaaactaaacctcgcgaagagcagtataatagcacatacagagtagtctccgtgcttactgtgctgcaccaagattggcttaacggcaaagagtataaatgtaaagtctcgaacaaagccctcccagctccaatcgaaaagaccatctctaaggccaaaggccagcccagggaacctcaggtgtatactttaccaccaagcagagacgagttgacaaagaatcaggtatcacttacttgcctggttaaaggtttctatccaagcgacatcgcggtggagtgggaaagcaacgggcaacctgagaacaactacaaaactacaccaccagtcctggacagcgatggttctttctttctgtacagcaagttgaccgtggataaaagcaggtggcagcaaggaaacgttttcagttgcagcgtgatgcatgaggcactgcacaaccactacacacagaagagcctctcccttagtcctgggaaa

SEQ ID NO: 15611 - DNA, 1149 bp, Artificial Sequence
  Description of Artificial Sequence: Synthetic coding sequence
atgggggtcctgctgacccagcgcacacttctgagcctggtgttagcgctgctgttcccgagcatggcgtcaatggcaatgcacgtggcgcagccagctgtcgtgctggctagttccagaggcatcgcttcgtttgtttgcgaatacgcatcccccggaaaggcgaccgaagtgcgagtaacagtgctgagacaggccgactcacaggtcaccgaagtttgcgctgctacctacatgatgggcaatgagcttaccttcttggacgacagtatttgtacaggaacatccagtggcaaccaggtcaatttgactatccagggtctgagggctatggataccgggctgtacatctgcaaggtggagctgatgtacccccctccatattacctcggtatcgggaatggcacacagatttatgtgatcgatcccgagccttgtcctgatagtgaccaggagcccaagtcgagcgacaagacacacaccagtccacctagcccagctccagaactgttgggcggctcttctgtgttcctcttcccccccaaaccgaaagatacgctgatgatctcccggacaccagaggtgacatgcgtcgtcgttgacgtcagccacgaagacccggaggttaaattcaattggtacgttgatggagttgaggtgcacaacgcgaaaacaaaacctagggaggaacagtacaactctacataccgagtggtgtccgtgctgaccgtcctgcaccaggattggctgaacgggaaggaatataagtgtaaggtgtcgaataaggctttgcccgctccaatcgaaaaaactatttcaaaggccaaagggcagccaagagaacctcaagtttataccttgccaccttcacgagacgagctgactaagaaccaggtaagcttgacatgcctggtcaagggattctacccatctgatattgctgtggaatgggagtctaacggtcagcccgagaacaattataaaaccacccccccggtgctagatagtgatggcagtttttttttgtactctaagctcaccgtcgacaagtcaaggtggcagcagggtaatgtattctcctgtagcgtgatgcatgaagctcttcacaaccactacacccagaaatccttgtctctgtctcccggaaag

SEQ ID NO: 15612 - DNA, 1149 bp, Artificial Sequence
  Description of Artificial Sequence: Synthetic coding sequence
atgggcgttctgctcactcagcggacgctgctgtcacttgtactggctctgctctttccatcgatggcgtctatggcgatgcacgtagcgcaaccggccgtagtgttggccagcagtcggggcatcgcctcattcgtgtgcgagtatgcctcgccgggcaaagccactgaagtgagagtcaccgtgctgagacaggctgactcacaggtgactgaagtttgtgcagccacctatatgatgggcaacgaactgacatttttggatgacagcatctgtaccgggaccagctccgggaatcaggtgaaccttactatccaggggctgcgggccatggatacaggcctctatatttgtaaagttgagttgatgtacccacccccttactacctcgggattggaaatggtacacagatttatgtgatcgatccggaaccctgccccgactccgatcaggagccgaagagctccgacaagacccacacaagcccccccagccccgcccccgagctgttgggtggttctagtgtgttcctgttcccccccaagccgaaggacacgcttatgatctcccgcactcctgaagttacatgtgttgttgtggacgtgtcccacgaagacccagaggtcaagttcaattggtacgtggacggggttgaagtgcacaatgccaaaaccaaaccacgcgaggaacaatataacagcacgtaccgggtggtcagcgttctcacggtcttgcatcaggactggctgaacgggaaagaatacaagtgcaaagtttctaataaggcactgcctgcgccgatcgagaaaacaatttctaaggccaaaggacagccaagagaacctcaggtttacaccttgcctccatccagggacgaactgaccaaaaaccaagtatctctcacttgcttagtgaaaggattctatccctcagacattgctgttgagtgggagtctaacggacagcccgaaaacaattacaaaaccacccccccagtcttagactctgacggcagcttcttcttatattcaaagctgacagtcgataaaagcaggtggcagcagggtaatgtcttttcatgttcggttatgcacgaggccctgcacaaccattatacccagaaaagtctgagcttatccccgggtaag

SEQ ID NO: 15613 - DNA, 1149 bp, Artificial Sequence
  Description of Artificial Sequence: Synthetic coding sequence
atgggcgtgttgctgactcagagaaccctgttgagtctggtgctggcccttctttttcctagcatggcaagtatggccatgcacgttgcacagcctgctgtggtgctggctagctcaaggggaatcgcttccttcgtctgcgaatacgcatctcctgggaaggccaccgaggtccgcgtaacagtgctgcgacaggcagactctcaggtcacggaggtgtgcgccgccacttatatgatgggcaatgaactgacttttctggacgattctatctgtaccggaacttctagtggaaatcaggtgaacttgaccattcagggcctccgggcaatggacacggggctctatatttgcaaggtggaactgatgtaccccccaccctattacttgggcattggcaatggcacacagatttatgtcatcgaccccgaaccctgccctgattcagaccaagagccaaaatctagcgataagacacacacgagtccccccagtcccgctccagagcttctgggggggagcagcgtctttttgttccccccgaaacctaaggatacactgatgatcagcagaactccggaggtgacttgtgtggttgtcgatgtgtctcatgaggatccagaggtcaagttcaactggtatgtcgatggagtagaggtgcacaacgctaagaccaagcccagagaggagcaatacaactccacataccgagtagtctctgtgttgaccgtgctccatcaggactggcttaacgggaaagagtataagtgcaaggttagtaacaaggctcttccagctcctattgaaaaaaccatctctaaagcaaaaggtcaacctagagagccgcaggtctacacactccctcccagtcgggatgagctcaccaaaaatcaggtcagtcttacttgtctggttaaaggcttttacccgtccgacattgccgttgagtgggaatctaatggtcaaccggagaataattacaagaccactcctccagtcctcgactcagacgggtcctttttcctgtacagcaagttgactgtagataaaagccgatggcagcaaggtaacgtattcagctgctccgttatgcacgaggcccttcacaaccattatactcagaaatctctgtcactgtcaccaggtaaa

SEQ ID NO: 15614 - DNA, 1149 bp, Artificial Sequence
  Description of Artificial Sequence: Synthetic coding sequence
atgggtgtcttgcttactcaacgtacgcttttgtctctcgttctggcgttactgtttcctagcatggctagcatggctatgcatgttgcgcaacctgcagttgtcttagcgtccagccgtggtatcgcatcgtttgtctgtgaatatgcgtcgcccggcaaagccacagaggtgagggtcacggttctgcgccaagctgattcccaagttactgaagtgtgtgcagcgacatatatgatgggaaatgagctgacgtttttagatgacagcatctgcaccggtacatcctccggcaatcaggttaatctaacgattcaaggtcttagagcgatggatacaggcctgtatatctgcaaagtcgaactcatgtacccgccgccttattatcttggtatcggcaatggcacacaaatctacgtgatagatccggaaccatgccctgacagcgatcaagaacctaaaagtagtgataagacacatacaagccccccgtcaccagcgccagaattgcttggcggctctagcgtgtttcttttcccacctaaaccgaaagatacattgatgatctcgcgcacacccgaagttacatgcgtagttgttgacgtgtctcatgaagatccagaagtaaagttcaattggtacgttgatggcgtagaagtccataacgctaaaacgaaaccaagagaagaacaatataattcaacttacagagttgttagcgtgctcacagtgctgcatcaggattggctgaatggtaaagaatacaagtgcaaagtctcaaacaaagctcttcctgctcccattgaaaaaacgatttcgaaggccaaaggccaaccccgtgagccgcaagtatacacactcccgccatctagagatgaactgacaaaaaaccaagtaagcctgacctgtttagtgaaaggattttacccgtcagatattgcagtggaatgggaaagcaatggccaaccggagaacaactataaaacaactccgcctgtgttggattcggatggaagcttttttttgtattctaagttaacggtcgataaaagcagatggcaacaaggtaatgttttttcctgttctgtgatgcacgaggcactacataatcattatacacaaaaaagtctgtcgctgtcgccgggtaaa

SEQ ID NO: 15615 - DNA, 1149 bp, Artificial Sequence
  Description of Artificial Sequence: Synthetic coding sequence
atgggagtcttgctcactcagaggaccctcctgtcgctggtcctcgctcttctctttccgtctatggcaagcatggcaatgcatgtcgcccaaccggcagtagtgttggcaagctccagaggcatcgcctcgtttgtttgcgaatacgcatcgccaggcaaggccactgaagtgagagtgacggtgctccgccaagccgacagccaggtgactgaagtgtgcgccgcgacctacatgatggggaacgaattgaccttcctggatgacagcatctgtaccggaacgtcgtccgggaaccaggtcaatctgaccatccagggacttcgcgccatggataccgggctctacatttgcaaagtggagctgatgtaccctccaccatactacctgggcatcggaaacggaacccaaatctacgtgattgatccggagccctgcccagattcagatcaagaaccgaagagctctgataagactcatacctccccgccctccccagcgccggaactgctgggaggctcgtccgtgtttctgttcccaccgaagccgaaggataccctcatgatctcccgcactccagaggtgacttgtgtggtcgtggatgtctcccacgaagatccggaagtcaaattcaattggtacgtggacggggtcgaagtccacaacgccaaaaccaagccgagagaggagcagtacaactcgacctacagggtcgtgtccgtgttgaccgtgctgcatcaggactggctgaacggcaaagagtacaagtgtaaggtatccaacaaggccctgccagccccgatcgaaaagactatcagcaaagcgaagggtcagccgcgggaaccccaggtgtacactctgccaccttcgcgggacgaactgactaagaatcaagtctccctgacctgtctggtgaaggggttctaccctagcgatatcgccgtggagtgggagtcgaatggccagccagagaataactacaagaccacccctcctgtcctggactcagatggcagcttcttcctctactcaaagctgaccgtcgacaagagccgctggcaacagggaaacgttttcagctgctcagtcatgcacgaagcgctgcataaccattacacccagaagtcgctctcgctttcgccgggtaag

SEQ ID NO: 15616 - DNA, 1149 bp, Artificial Sequence
  Description of Artificial Sequence: Synthetic coding sequence
atgggtgtgctgctaacccagaggaccctgctctccctggtgctggcactcctctttccaagcatggcatccatggcaatgcatgtagcccagcctgcagtagtcctggctagcagcaggggaatagcttcattcgtttgcgagtatgccagtccaggtaaggcaaccgaagttagagtgactgtgctgagacaggctgactcacaggtgacggaagtgtgtgccgctacatacatgatgggcaatgagttgacgtttctggacgatagtatctgcacagggacatcatccggcaatcaggtgaacctcactatacagggtctgagagccatggataccggtttgtatatttgtaaggtggaactcatgtatccccccccttactatctggggattggtaacgggactcagatctatgttatcgatcccgagccttgccccgattcggatcaggaaccaaaatcttcggacaaaacccatacctctcccccctctcccgcacctgaactgctcggcggcagcagcgtattcctctttccccctaagcctaaagatactctgatgatcagccggactcccgaggtgacttgcgttgtggtggatgtatcccatgaggaccccgaggtaaaattcaactggtatgtcgacggggtggaggtgcacaacgccaaaacgaagccacgggaggaacagtacaacagcacttaccgggtggtttcggtgctcactgtcctgcatcaggattggctaaacgggaaagaatacaaatgtaaggtgagtaataaggcactccctgcgcctattgagaagaccatctccaaggccaagggccaaccacgcgagcctcaggtgtacactctgcctccaagccgcgacgagctaaccaaaaatcaagtgtcgctgacatgcttggttaaaggattctatccgtccgacatagcagtcgagtgggaaagcaacggtcagcctgaaaacaattacaagaccacccctccagtgctggatagtgacggaagtttctttctgtacagcaagttaacggttgacaaaagccgatggcagcaggggaacgtgttttcctgtagtgtgatgcacgaagccttgcataatcattatacccaaaagtctctgtcactgagtccagggaag

SEQ ID NO: 15617 - DNA, 1149 bp, Artificial Sequence
  Description of Artificial Sequence: Synthetic coding sequence
atgggagtgctgctgactcaaaggacgcttcttagcctggtcctggcgcttctctttccctcgatggcctccatggctatgcatgtggcccagcctgcggtggtgcttgcctcctcgaggggcattgcatcatttgtctgcgagtacgcatcgcctggaaaggcaaccgaagtgcgggtcacggtgctcagacaggcggactcgcaggtcactgaagtgtgcgcagcaacctacatgatgggtaatgaattgactttcctggatgattcaatctgtactggtacctcgagcggaaatcaagtgaatcttaccatccagggactgagagccatggataccggtctgtacatttgtaaagttgaacttatgtacccacctccctactacttgggtattggcaatggaactcaaatctacgtgatcgacccagaaccttgcccagacagcgatcaagagcccaagtcctcagataagacccatacttccccaccatcgccagccccggaactgctgggaggttcctcagtgttcttgtttcctccaaagcctaaggacacccttatgatttcacgcactcctgaagtcacctgtgtggtggtggacgtcagccatgaagatcctgaagtgaagtttaactggtacgtggacggagtggaagtgcacaacgcaaagaccaagcctagggaggagcagtacaactcgacgtacagagtggtgtcggtgcttaccgtgcttcaccaggactggctcaacggaaaggaatacaaatgtaaggtcagtaataaggccctcccagcccctatcgagaaaactatctccaaggcgaaaggccagcctcgcgagccacaagtgtacaccctcccaccctcgagagatgaactgactaagaatcaggtatcccttacgtgcctggtcaaaggattttacccctccgacatcgcagtcgagtgggagtctaacgggcagccggagaataactacaagactacgcccccagtgctggattcggacggctcattctttctctatagcaagctgactgtcgacaagagccgctggcaacagggaaacgtgttctcctgctctgtgatgcatgaagcacttcataaccattacactcagaaatcgctttcactttcccctggcaag

SEQ ID NO: 15618 - DNA, 1149 bp, Artificial Sequence
  Description of Artificial Sequence: Synthetic coding sequence
atgggagttctgctcacccagcgcacactgctgagcctcgtcctggccctgctgttcccatctatggcatcgatggccatgcacgtagcgcaaccggctgtcgtgctggcctcctcgaggggtatcgcctcttttgtgtgcgaatacgcatcacctgggaaagccacagaggtgcgggtcaccgtccttcggcaagcggattcacaagtgaccgaggtctgcgccgccacatacatgatgggaaacgaacttaccttcctcgacgattccatctgcactggaacaagtagtgggaaccaggtgaacctgacaatacagggtctgcgggcgatggatacgggcctctacatatgtaaggttgagctgatgtaccccccaccctattacctaggtatcggaaatgggacacaaatatacgtcattgatccagagccttgtccagactcagatcaggaacctaagtcctccgacaaaacccacactagccccccttcccctgctccagagcttctgggggggtcctccgtgtttttgttcccccctaagccgaaggatacactcatgatctctcggacgcccgaagtgacatgtgtcgtggtagacgtgagccacgaggatccagaggtaaagttcaactggtacgtggatggggtggaagtacataatgctaagacaaaaccaagggaggaacagtacaacagcacataccgagtggtctcggtcctgacagtgctccaccaagattggctgaatggcaaggagtacaagtgcaaagtgtctaacaaagctcttcccgccccaattgagaagaccatttctaaagcgaagggacagccgcgagagcctcaggtctacaccttaccaccatctcgagatgagctgaccaagaaccaagtctcccttacctgtctcgtgaagggattttacccaagtgacattgcagttgagtgggaaagtaatgggcagcccgagaacaattacaaaaccactcccccagtgctggattccgatggtagtttcttcctgtactcgaagttgaccgtggataagtctcggtggcagcaaggaaacgtgtttagttgttctgtcatgcacgaagctctccataaccattacacacagaagagcctgagccttagccccgggaag

SEQ ID NO: 15619 - DNA, 1149 bp, Artificial Sequence
  Description of Artificial Sequence: Synthetic coding sequence
atgggtgtgctgctgacccagaggaccctcctgtccctcgtgctcgctttgctgtttcctagtatggcttctatggcgatgcatgtggcccaacccgcagtggttctcgcctcaagccgagggattgcctcttttgtgtgtgagtatgcctctccgggtaaggctactgaggtgagagttaccgtactgcggcaggccgattcccaggtgacagaagtttgtgcagctacttacatgatgggaaacgaattgacttttttggacgactctatttgtaccggcacatcttccgggaaccaggtgaacctcacaatacagggcctgagggcaatggatacaggtctgtacatctgtaaagtcgagctaatgtaccctccgccctactaccttggcattggaaatggcacccagatttacgtaatcgacccagaaccatgcccagatagcgatcaggaaccaaagagctctgataaaacccacacttctcccccaagcccagcgcctgagttgctaggtggaagctcagtctttctcttcccgcccaagcccaaggacacactaatgatttcaaggacaccagaagttacatgtgtagtcgttgacgtgtcccacgaggatcccgaagttaagtttaactggtatgtcgacggggttgaagtccataatgccaagacgaaaccacgagaggagcagtacaacagcacgtatcgggtcgtgtccgtgctcactgtcctgcaccaggattggctcaacgggaaggagtataaatgtaaagtatccaataaggccctccctgccccaatcgagaagaccatttccaaagctaaaggtcagccccgtgagcctcaggtctacacccttccgccatcaagggacgaactgacaaagaatcaggtttcccttacatgcctagtaaaaggcttctaccccagcgatatcgccgttgagtgggagtccaacggtcagcccgaaaacaattacaagacaacccctcctgtgctagactccgacgggagctttttcctgtacagtaaactgaccgttgataaaagccggtggcagcagggcaatgtcttttcctgctcagttatgcacgaggctctgcacaaccactacacccagaagtcgctttctctgtctcccggcaaa

SEQ ID NO: 15620 - DNA, 1149 bp, Artificial Sequence
  Description of Artificial Sequence: Synthetic coding sequence
atgggagtactgttgacacagcgaacgttgctttctctggtattagccctcctatttccttcaatggcatcaatggctatgcatgtcgcgcagcccgccgtggtcctggctagcagccgcgggattgcgtccttcgtgtgtgagtacgctagtcccggcaaagccaccgaagtgcgggtaaccgtccttcggcaagcggattcccaggtgactgaggtctgtgctgctacttacatgatgggcaatgagctcaccttcctcgacgattcaatttgtactgggaccagttcgggtaaccaagtgaacctaactattcagggcctgcgcgctatggatacagggctttatatttgcaaggtagagctgatgtaccctcccccgtattacctggggatcggaaatggcacacagatttacgtgatagatccggagccttgtcccgatagtgatcaagaacccaagagttcggacaaaacacatacttcaccaccttcgcccgcccccgaactccttggcggcagttcagtattcctgttcccacctaagcctaaggatacacttatgataagcaggacgcctgaggtgacctgtgtcgtggttgatgtgagtcacgaggatccagaggtcaaatttaattggtacgttgatggcgtggaagtacataacgcaaaaacaaaacccagagaggagcagtacaacagcacatatcgcgtagtgagcgtgttgacggtactgcaccaggattggctgaacggcaaggagtacaagtgtaaggtgtccaataaggcattgcccgcccccatcgaaaaaacaatttccaaagctaaggggcagccacgagaacctcaagtgtacaccctgccgccttcccgggatgagctgaccaaaaaccaggtgagcctgacgtgcctggtgaagggcttttatccctctgacatcgcagtcgagtgggagagtaatggacagccagagaacaactacaagacaacccccccagtgctggacagtgatggctctttcttcctttactccaagctcaccgtcgataagtcaaggtggcagcagggaaacgtgtttagttgctcagtcatgcacgaggctctgcataaccattacacccagaaaagcctctctctcagtccaggaaag

SEQ ID NO: 15621 - DNA, 1149 bp, Artificial Sequence
  Description of Artificial Sequence: Synthetic coding sequence
atgggcgtactgctgacacagaggaccctcctctccctggttctagcgcttcttttcccttccatggcttccatggcaatgcacgtcgcccagcccgcagtcgtgctggccagttcacgtgggatagctagttttgtgtgcgaatacgcttcccccggtaaggctaccgaagtgagggtgaccgtgctgcgccaggccgactctcaagtaacggaggtctgcgcagcaacttatatgatgggaaacgagctcacattcctggatgatagtatttgcaccgggacatcgtccgggaaccaagtgaacttgaccatacagggactgcgcgcaatggacacaggcctctacatttgtaaggtggagctaatgtaccccccaccttattatctggggatcggcaatggcacgcagatttatgtaatcgaccctgagccgtgcccggactctgaccaggaaccgaagagctccgataagacccatacctcccctccctccccagccccagaacttctgggcggctcgtcagttttcctgttcccgccaaagcctaaagacacattaatgatctctagaacccccgaggtgacgtgcgtcgtagtggatgtctctcacgaggaccccgaggtgaaattcaattggtacgtggatggcgtggaggtccacaatgccaagaccaaacctcgcgaggaacagtacaatagtacctatcgagtggtttccgtgttaaccgtcttgcaccaggactggttaaacggtaaggaatacaagtgcaaggtttccaataaggctttgccagcaccgattgaaaagacgatttcaaaggcaaagggccagccccgcgagcctcaggtgtacacactgccacccagccgcgatgaactcaccaaaaaccaagtcagcctgacatgtcttgtcaagggtttctatccaagcgatatcgccgtggagtgggaatccaacgggcagcctgaaaacaactataagaccactccacctgtactggattctgacggctcattcttcttgtactctaaactcacagttgacaaatcacggtggcagcaaggcaatgtattttcctgtagcgtgatgcatgaggcattgcacaatcattacacccagaagtcattgtctctgtcgccggggaag

SEQ ID NO: 15622 - DNA, 1149 bp, Artificial Sequence
  Description of Artificial Sequence: Synthetic coding sequence
atgggcgtgcttcttactcaacggacgcttctgtcacttgttctggcactgcttttcccgtccatggcatccatggcaatgcatgttgcacagcctgccgtggtgttggcctcatcacgaggcattgcctccttcgtgtgtgaatacgcttcgcctggcaaggcaactgaagtgagggtgaccgtgcttagacaagcagattcccaagtgacggaagtctgtgcggcaacttacatgatgggcaatgaacttacgtttctggatgacagcatctgtactggtacgtcatcgggcaaccaggtgaatcttaccattcagggactcagggcgatggataccggtctgtacatatgcaaggtggaacttatgtacccaccgccatactacctggggattgggaacggtactcagatttatgtgatagacccagagccttgccccgattctgatcaagaacctaagagcagcgacaagactcacacctcgccccctagccccgcccctgagctccttggaggttccagcgtgttcctttttcctccaaaacccaaggataccctgatgataagcagaacgccagaggtcacctgtgtggtggtggacgtgtcccatgaggacccagaagtcaagttcaactggtacgttgacggtgtggaagtgcacaacgcgaaaaccaagcctagagaggaacagtacaactctacctaccgcgtggtgagtgtgctgaccgtgcttcatcaagattggctcaacgggaaggaatacaagtgcaaggtgagcaacaaggcccttccagcacccattgagaaaactatctcgaaagcaaagggacagccacgcgaacctcaagtttatactctccctccttcgcgcgacgaacttacgaaaaaccaagtgtcactgacttgcctggtgaagggtttctacccttcggatatagcagttgaatgggaaagcaatggacagcctgaaaacaactacaagaccactcctccagtgctggattcggatgggagcttttttctgtactccaagctgactgtggacaagtcgcgttggcaacaaggaaatgtgttttcgtgttcggtgatgcacgaagcactccataatcattacacccaaaagtccctcagcctgtccccgggaaag

SEQ ID NO: 15623 - DNA, 1149 bp, Artificial Sequence
  Description of Artificial Sequence: Synthetic coding sequence
atgggagtgctgctgacccaacgaactctgctcagtctggtgctggccctgctgtttccatcaatggccagcatggcgatgcacgtcgctcagccagcggtcgttctcgctagctctcgcggcatcgctagcttcgtctgcgagtatgcctcaccgggaaaggcgacggaggtgcgggtcactgtgctgaggcaagccgactcgcaagtgaccgaagtttgcgcggccacctacatgatgggtaatgagctcactttcctcgacgattccatttgcactggcacttcgagcgggaaccaggtgaatctcactatccagggacttcgggcaatggataccgggctgtacatctgcaaggtggaactgatgtacccccctccttactacctcggaatcggaaatggcactcagatctacgtgatcgaccctgagccatgtccagattcagatcaagagccaaagtcatcggacaagacccacaccagcccgccgtcgcctgcgccggaactgctgggcggctcatcagtctttctgttcccaccgaagccgaaggacactctgatgatttcgagaaccccggaggtgacttgtgtggtggtggacgtgtcccacgaagatccagaagtgaaattcaactggtatgtggatggtgtggaagtgcacaatgccaagacgaagccacgggaagaacaatacaattcgacctatcgcgtcgtgagcgtgttgaccgtgcttcaccaggactggctgaatggcaaagaatacaagtgcaaagtgtccaataaggccctgccagctccaatcgagaaaaccatctccaaagctaagggccaaccgcgggagccacaggtgtataccctcccgccttcgcgggacgagctgaccaagaatcaagtctccctgacttgtctggtgaagggattctacccgtccgacattgctgttgagtgggaatcgaacggacaaccagagaacaactacaaaactactccgccggtgctggattcagacggatcgttcttcctttactccaaactgaccgtcgataaatcgagatggcagcagggcaacgtgttctcctgttcggtgatgcacgaagcactgcataatcattacacccaaaagagcctttcgctctcgccgggcaag

SEQ ID NO: 15624 - DNA, 1149 bp, Artificial Sequence
  Description of Artificial Sequence: Synthetic coding sequence
atgggagtgctcctcactcagcgtaccctcctttcgttagttctggcacttcttttcccctccatggccagcatggctatgcacgtcgctcagccagcggttgtgctggcgagtagtagggggattgctagcttcgtttgcgagtatgcatctcctggcaaggcgaccgaagtgcgggtcaccgttcttcggcaagctgactctcaagtgactgaagtatgcgcagccacatatatgatgggaaacgagttgacctttctagatgacagcatctgcacagggaccagctccggcaaccaggtcaatctgaccattcaaggacttcgagccatggatacaggcctgtacatctgtaaggtggaattgatgtatcctcccccatactatttaggaatcggaaatgggacccaaatatacgtcatcgatccggaaccatgccctgacagcgatcaggagcctaagtcctcagacaaaacacatacttctccaccctcgcctgcaccagaactgctcggaggttcctcggtctttctcttcccccccaaacctaaggatacgctgatgatatctcgcacccctgaggtcacctgcgtggtcgtagatgtctcccacgaggatcccgaagtcaaattcaactggtatgtggacggggtggaagtgcacaatgccaaaacgaaaccgcgtgaggagcagtacaattccacatatagagttgtgtccgtgttgaccgtgcttcatcaagactggctcaacggaaaggaatacaaatgcaaggtcagcaacaaagcattaccggccccaatcgagaaaaccatctccaaggcaaaagggcagcccagagaacctcaggtttataccctcccacctagcagggacgagttaacgaaaaaccaggtatcgctgacttgtctggtcaagggtttctaccccagtgatatagctgttgagtgggaatctaacggccagcccgaaaataattacaagaccacaccccctgttctcgattcagatggaagtttcttcctctactccaaactgactgtggataaatctcggtggcagcaggggaatgtgttcagctgctcagtcatgcatgaggcgctgcacaatcattacacccagaagtctctgtcccttagccctgggaag

SEQ ID NO: 15625 - DNA, 1149 bp, Artificial Sequence
  Description of Artificial Sequence: Synthetic coding sequence
atgggggtcctccttactcaacggacgctgttgtccctcgtgcttgcgctcctttttccatctatggcatccatggcaatgcacgtggcacaacctgctgtcgtcctggcgtcctcacgtgggatcgcatcctttgtctgcgagtatgcctcccctgggaaagcaaccgaggtcagagtgaccgtgcttaggcaggctgattcgcaagtgacggaagtgtgtgcggcgacctacatgatgggaaacgaacttactttccttgatgatagcatttgtaccggaacttcatcgggtaaccaagtgaacctcaccatccagggcctgagggcaatggataccggactttacatctgtaaggtcgaattgatgtaccccccaccttactatctgggcattggaaacggtactcagatttacgtcattgatcccgagccatgtcccgattcagatcaagaacctaaatccagcgataagacccatacgtcccctccttccccagccccagaattgcttggtggctcgagcgtgttcctcttcccgcccaagcccaaggacaccctgatgatcagccgtacgcctgaggtgacctgtgtggtggtggacgtgagccacgaagatccagaggtgaagttcaattggtacgtggatggagtggaggttcacaatgcaaagaccaagccaagagaggagcagtataactcaacgtacagagtggtgtcggtcctgactgtgcttcatcaagattggctcaacggaaaggaatacaaatgcaaagtgtcaaacaaggcgctgcctgcgcctatagaaaagaccatttcaaaggcaaagggacagccaagggaacctcaagtctacactctgcctccttccagagatgaactgaccaaaaatcaagtgagcttgacctgtctcgtcaagggcttttacccttccgatatcgcagtggaatgggaatcgaatggtcaacccgagaacaactacaaaactaccccaccggtcctcgactcagatggatcgttttttctctactcaaaacttaccgtcgataaatcaagatggcaacagggcaacgtattctcatgttcggtgatgcatgaggcccttcataatcattacacgcaaaagtcgttgtccctttccccaggaaag

SEQ ID NO: 15626 - DNA, 1149 bp, Artificial Sequence
  Description of Artificial Sequence: Synthetic coding sequence
atgggggtcctgctgacccagagaaccctcctttccctggtgctcgcgttgctgtttccatccatggcgtccatggccatgcacgtcgcacagcctgccgtggtcctcgcctcgtcccgcgggattgcctcgtttgtgtgtgaatacgcttcacctggcaaggcaaccgaagtgcgggttactgtgctccggcaagccgattcgcaagtcaccgaagtctgcgctgctacttacatgatgggaaatgaactgaccttcctggacgattctatttgcacgggtacctcgtcaggaaaccaagtcaaccttaccatccaggggcttcgggcaatggacaccggtctttacatttgcaaggtggaactgatgtacccacctccttactaccttggaattggtaacggtacgcaaatctacgtgattgatcctgaaccttgcccagattccgaccaagaaccgaagtctagcgataaaacccacaccagccctccatccccagcgccagaactgctcggagggagctccgtgttcctgttccctccgaagcctaaagacaccctgatgataagccggacccctgaagtgacgtgtgtggtggtggatgtctcgcatgaggaccccgaagtgaaattcaattggtacgtggatggggtggaagtgcataacgccaaaaccaagcctagagaggagcaatacaactcaacctacagagtcgtctcagtgctcacggtgctccatcaagattggttgaatggaaaggaatacaaatgcaaagtctcaaacaaggcacttcccgctcctattgaaaagacgatttccaaagcaaagggtcaaccaagagagcctcaagtgtacactcttcccccatcgagagatgaattgactaaaaaccaagttagtcttacctgcctcgttaaaggtttttacccatcagacatcgccgtggagtgggaatcgaacggccagcccgaaaacaattacaagactaccccgcccgtgctcgattcggatggatccttctttctctattcaaaacttactgtggataaaagcaggtggcaacaggggaatgtgttttcgtgttcggtgatgcatgaggcactccataatcattacacccaaaagtccctttcgctgtcaccaggaaag

SEQ ID NO: 15627 - DNA, 1149 bp, Artificial Sequence
  Description of Artificial Sequence: Synthetic coding sequence
atgggcgtgctcctgacacagcgtaccttgttgagcctggtgctggcactgctatttccgagtatggcttccatggcaatgcatgtggcccagccagcagtggtgttggcaagctcgcggggcatcgcgtcgtttgtgtgtgagtacgcttccccaggaaaggccaccgaagtacgagtaaccgtgctgcgacaggctgactcgcaagtgaccgaagtgtgtgccgctacgtacatgatgggaaatgagttgacctttcttgacgactcgatctgcactggtacctctagcggtaaccaagtgaatctgactatccagggtctacgtgcaatggatacgggtctgtacatctgcaaggtggaactcatgtatcccccaccatattacctgggaatagggaatggaacccagatttacgtcattgaccccgagccctgcccggattcggaccaggagcccaagagtagcgacaagacgcataccagcccaccatcgcccgccccagaattgctgggcggcagtagtgtgttcctgtttcctccgaaacccaaggataccttgatgatctcccgcacccccgaagtgacgtgcgtggtagtggatgttagtcatgaggatccggaggtgaaattcaactggtacgtcgatggcgtggaggtgcacaacgcaaagacgaagccacgagaggaacaatataattccacatacagggtggtgtcagtgctgaccgttttacaccaggattggctcaacggcaaagagtataaatgcaaggtcagcaacaaggcactgccagcccctatcgagaagacgatctcgaaggcaaagggtcaaccacgagaaccgcaggtctacacactaccaccgtcacgagacgaactgacaaagaatcaggtgagccttacctgtttggtgaagggcttttatcctagcgacatcgccgtggagtgggagagcaacggccagcccgagaacaactataagacaacaccgcctgttctcgattcggacggctcgttcttcttgtattccaaattgaccgtggacaagagcaggtggcaacaagggaatgtcttttcgtgctcggttatgcacgaggccctccataaccactacacccaaaagtctttgtcccttagccccggaaag

SEQ ID NO: 15628 - DNA, 1149 bp, Artificial Sequence
  Description of Artificial Sequence: Synthetic coding sequence
atgggtgttttgctaacacagcggacgctattgtctctggtgctcgctttgctgttcccctctatggccagcatggctatgcacgtagcccagcccgcggttgtgctagcttctagtagggggattgcttcattcgtgtgtgaatatgcatcacccggcaaagccaccgaggttcgagtcaccgtacttcgccaagctgactcacaagtgaccgaagtgtgtgccgccacctacatgatggggaatgaactgacattcttggacgatagtatctgtactgggacaagctcagggaaccaagtgaatttgaccattcaagggctcagggcaatggacacaggtctgtatatttgtaaggtagagctgatgtatcctcctccgtactacctcggtatcggaaacggaacacaaatatacgttattgatcctgagccatgccctgactcagatcaggagcccaagtctagtgataagacgcatacctcaccaccttcgcccgctccagagcttctcggcggcagttctgtttttctgttccctcccaaaccgaaggatactctaatgatcagccggactccagaggtgacttgtgtggtggttgatgtcagtcacgaagacccagaagtaaagttcaattggtacgtggacggcgtggaagtgcataatgcgaagacgaaacctcgcgaggagcagtataacagcacataccgcgtggtctcggtgctgaccgtgctgcaccaggactggctgaatggcaaagaatataagtgcaaggtgtctaacaaagcgctgccagctcctatagagaaaaccataagcaaggcaaaagggcagccaagagagccacaggtttacactcttcctccaagcagagatgaactgaccaagaatcaggtgtcacttacctgcctggttaagggtttctacccatctgacatcgccgtagaatgggagagcaatggtcagcccgagaataattacaagactactccccccgtgctggactcagatgggtcattttttctgtattccaagctgaccgtggacaaatctcggtggcagcaggggaatgtgttctcgtgttctgttatgcatgaggcactgcacaaccattacactcagaaatcgctatccttgtctcctgggaag

SEQ ID NO: 15629 - DNA, 1149 bp, Artificial Sequence
  Description of Artificial Sequence: Synthetic coding sequence
atgggtgtgctcctcacacaacgcacacttctttccctggtcctagccttgctgtttcctagcatggcttctatggcaatgcacgttgcgcagccagccgtagtgctcgcctcctcgaggggtatcgcttcgttcgtgtgcgaatatgccagtcctgggaaagcaaccgaggtgcgggtgacagtactcagacaggccgactctcaagtcacggaggtgtgcgccgccacctacatgatgggcaacgagctgacatttctggacgactctatttgtactggtacaagctcgggtaatcaggtcaacttaacaatccagggacttcgagccatggacaccggcctgtatatttgcaaggtcgagttgatgtatccgccaccatattacctggggatagggaatggcactcaaatatatgtgattgatccagaaccgtgtcccgactccgaccaggagcctaaatcctctgataaaacccacacctccccaccttcgccagcccccgaattgttagggggcagttctgtgtttttgtttccccccaaacctaaggacactctgatgatttcgcgcacaccagaggtgacatgtgttgtggtggacgtgagccacgaggatccagaggtcaagtttaattggtacgtggatggagtggaagtgcataacgccaaaactaaacccagagaggagcagtataactccacttaccgggtggtcagcgtcctgactgtgctgcaccaggactggctgaatgggaaggagtacaaatgtaaggtaagcaataaggctttacccgcccccatcgagaagacgataagtaaggccaaggggcagccacgagaaccccaggtatacacactccccccaagtagagacgaactgacgaaaaaccaggtctcactgacctgcctggtcaagggcttttatccaagcgacatcgccgtcgagtgggagagtaacggccagcccgagaataactataaaacaactccacctgttctggatagtgacggctccttcttcctgtactcaaagctgactgtagataagtcccggtggcagcagggcaatgtgttcagttgctctgttatgcacgaggcgctgcacaatcattatacccagaagagcctgtcactctcccccggcaag

SEQ ID NO: 15630 - DNA, 1149 bp, Artificial Sequence
  Description of Artificial Sequence: Synthetic coding sequence
atgggcgtgctgctgacccagcgcacactgttgtcactggtcctggccttactgttccctagtatggccagtatggccatgcacgtagcacaacccgctgtcgtactggcatcttcacgtggtatagcctcttttgtatgtgagtacgcgagtccagggaaggctaccgaggtacgcgtaacagtgctgcgtcaggccgactcccaggtaaccgaagtctgcgccgccacgtacatgatgggtaatgaactaactttcctcgatgattccatctgtacaggcacaagttctggcaatcaggtgaacctgactatacaggggcttcgcgctatggatactggcctctatatttgtaaggtcgagctgatgtaccctcctccttactacctggggatcggcaacggaacacaaatctatgtgatcgatccggaaccctgccctgattccgatcaagaacccaaatcaagtgacaagacacacacctctccccccagccctgccccggaactgctgggcggtagctctgtcttcctgttcccgcctaagcccaaagacaccctgatgatttccaggacgcccgaggtgacctgcgtggttgtggacgtctcacacgaagatccggaggttaagtttaactggtacgtcgacggcgtcgaggtgcataacgcaaagactaaacccagagaggagcagtacaacagcacgtatagggtggtttctgtgctgactgtgttgcaccaggactggcttaacggtaaagaatataaatgcaaagtcagcaataaggcccttccagcccctattgaaaagaccatttccaaggctaaggggcagccaagggaacctcaagtgtataccctgcctcctagtcgcgacgagctcactaagaatcaagttagtctgacttgcctagtgaaagggttctatccaagtgatatcgccgtggagtgggagtccaacggccagcctgagaataactataagacaaccccccccgtgttggactccgatggatccttttttctgtactccaagctgactgtcgacaagtctagatggcagcagggcaatgtgttttcttgctctgtcatgcacgaggccctgcataaccactatacgcagaaatcattatcattgtcccccggcaag

SEQ ID NO: 15631 - DNA, 1149 bp, Artificial Sequence
  Description of Artificial Sequence: Synthetic coding sequence
atgggagtgctgctgacccaaagaactctgctcagcctcgtgttggcacttctcttccccagcatggcatcgatggcgatgcacgtcgctcaaccggcggtcgtcctcgcctcgtccagagggatcgcatcctttgtgtgcgaatacgcgagcccgggaaaggccaccgaagttcgcgttacggtcctgcggcaggccgattcgcaagtaactgaggtctgcgcggccacctacatgatgggcaatgagctgaccttccttgatgacagcatctgcaccggaacgtcgtccggaaatcaggtgaacctgaccatccaagggctgagggccatggatactggattgtacatttgcaaagtggagcttatgtacccgcctccatactacctgggcattggtaacggaacccagatctacgtgatcgatccagagccatgtccagactccgaccaggaaccgaagtcatcagataagacccatacttctccgccgtcgccggccccagagcttctgggagggtcgtcagtgttcctcttcccaccaaagcctaaagacaccctgatgatctcaagaactccggaagtgacctgcgtggttgtggatgtatctcatgaggacccggaagtcaagttcaattggtatgtcgacggagttgaggtgcataatgccaaaactaagccgagggaagagcaatacaactctacctatcgggtggtatccgtgctcactgtgctgcaccaggactggctgaacggaaaggaatacaaatgcaaagtgtccaataaggcgctgccggcgccaatcgagaaaactatctcgaaagcaaaggggcagccgcgcgaaccacaggtctacactttgcccccatcccgggacgagctcactaaaaaccaggtgagcctcacctgtctggtgaagggattctacccttctgatatcgctgtggaatgggagagcaatgggcagcctgagaacaattacaagacgaccccacccgtcctcgactccgacggctcgttcttcctctattcaaagctcaccgtggacaagagccggtggcaacagggcaacgtcttttcgtgctcggtgatgcacgaagcgctgcacaatcactacacgcaaaagtcactttcgctgagcccgggtaag

SEQ ID NO: 15632 - DNA, 1149 bp, Artificial Sequence
  Description of Artificial Sequence: Synthetic coding sequence
atgggagtcctcctgactcagcggacgctgttgtcgctggtgctcgcgctgctgtttccgtccatggcatccatggcgatgcacgtggcccagccagccgtggtcctggcatcctcgcggggcatcgcctcctttgtctgcgaatacgcgagccctggaaaggcgaccgaggtgcgggtcactgtcctccgccaggccgacagccaagtcaccgaggtctgcgcggccacttatatgatgggaaatgaactcactttccttgacgactcgatctgtactgggacttcatccgggaaccaggtgaacctgacgatccaaggtttgagggccatggacaccggcctctacatctgcaaggtggaactcatgtacccgccaccgtactacctcggtatcggaaacggtacccagatctacgtcatcgatcccgaaccttgccctgacagtgatcaggaaccgaaatcatcggataagacccatacgtcccctccttctccagcccccgagcttctcggtggatcctcggtgtttttgttcccgccgaaacccaaagacactctgatgatttcacggaccccggaagtgacttgcgtggtcgtcgacgtgagccacgaagatccggaggtcaagtttaattggtacgtggacggggtggaagtgcataatgccaaaactaaacccagagaggaacagtacaattcaacgtaccgggtggtttcagtcttgaccgtcctgcaccaggattggcttaacggaaaagagtacaagtgtaaagtgtcgaacaaggctcttccagcaccaattgagaagactatctccaaggcaaagggccaacctagagagccgcaagtttacaccctcccaccgagccgggatgaactgaccaaaaaccaagtctccctgacttgcctggtgaagggattctacccttcggacatcgccgtggaatgggagtcgaatggtcaaccggagaacaattacaaaaccaccccgccagtcttggactccgatggatccttcttcctctactcaaaattgaccgtggacaaatcacgctggcagcagggaaacgtgtttagctgttcagtgatgcacgaggcacttcataatcactatacccaaaaatcgctctccctgagccccggaaaa

SEQ ID NO: 15633 - DNA, 1149 bp, Artificial Sequence
  Description of Artificial Sequence: Synthetic coding sequence
atgggtgtcctcttaacccagcggaccctgctttccttggtcctggctttgctgttccctagcatggccagtatggctatgcatgtggctcagccggctgtggtgttggccagcagtcgtggaatcgcatcattcgtgtgcgagtacgcatccccaggcaaagccacagaagtgagggttaccgtactacgtcaagccgattcacaagtaaccgaggtctgtgccgcgacttacatgatgggcaatgaactgacttttctggatgattcgatttgtacgggtacctccagtggaaaccaagtaaacttgacaatacagggcctgagagcgatggatactggtctctacatttgtaaagttgagctgatgtaccccccgccttattacctcggaatcggcaacggaacacagatctacgtgattgaccctgagccctgtccagatagcgatcaggagccaaagagtagcgataagacacacaccagtcccccttctccggcccccgagttactaggtggaagctccgtgttcctgtttccacccaagcccaaagatacactgatgatttctcgaacccccgaggtgacatgtgttgttgtcgatgtgtcccatgaagaccccgaggtaaagttcaactggtatgtcgacggtgtggaagtccataacgccaaaaccaaacctcgggaagaacaatacaattccacgtaccgcgtggtgagcgtcttgaccgtcttgcatcaggattggctcaacgggaaggaatataaatgcaaagtatctaataaggcacttccagcaccgattgagaaaacaatctctaaggccaagggtcagccacgagagcctcaggtgtatactcttcccccctctcgggatgaactgactaagaaccaggtgtcgctcacttgtcttgtgaaaggattttacccatccgatatcgccgtggagtgggaatctaatggccagccggaaaacaattacaaaactacgccccccgttctcgactccgacggcagttttttcctgtattcaaaactgaccgtagataaatccagatggcaacagggaaatgtgttttcctgtagtgtgatgcatgaggccctgcataaccattatacacagaagagcctcagcctgtctcccgggaag

SEQ ID NO: 15634 - DNA, 1149 bp, Artificial Sequence
  Description of Artificial Sequence: Synthetic coding sequence
atgggtgtgctgctgactcaacggactctcctgtcactcgtcctcgccctcctgtttccatcaatggcgtcgatggccatgcatgtggctcagcctgcagtggttctggcgagctcccgcggcatcgcatccttcgtgtgcgaatacgcttccccgggaaaggccaccgaagtccgcgtgactgtcttgaggcaggcggattcacaggtgactgaagtctgtgccgctacctacatgatgggaaatgagctgaccttcctggatgattcaatctgtaccggcacttcatcggggaaccaagtgaacctcaccattcagggactccgagcgatggacactggactctacatctgcaaggtggagcttatgtatccaccgccttactacctgggcatcgggaatggcactcagatctacgtcatcgacccggagccgtgccccgatagcgaccaggaaccgaaatcctcggacaagacccacacctcgccgccatctccggcccccgagcttctgggagggagctccgtgtttctgttccctcctaagcccaaggataccttgatgatctcaagaacgccggaggtcacgtgcgtggtcgtggacgtgtcccacgaggaccctgaggtgaaattcaattggtacgtcgatggagtggaggtccacaacgcgaaaactaagccgagagaagaacagtacaactcgacttaccgggtggtgtcagtgctcaccgtgctgcaccaagactggctgaatggaaaggaatacaagtgcaaggtgtccaacaaagccttgccggcaccgatcgaaaagaccatttcgaaagccaaaggtcaacctcgggagccacaagtctatactctcccaccaagccgcgacgaactgaccaagaaccaggtgtcgctgacttgtctggtgaagggcttctacccaagcgacatcgccgttgaatgggagtccaatggacagccggaaaacaactacaagacgacgccgcccgtgctggactcggatggatccttcttcctgtactccaagttgaccgtggacaagtcgcgctggcagcaaggtaatgtctttagctgctcggtaatgcatgaagcacttcataaccactacacccagaaaagtctcagccttagcccaggaaag

SEQ ID NO: 15635 - DNA, 1149 bp, Artificial Sequence
  Description of Artificial Sequence: Synthetic coding sequence
atgggtgtcttgctcactcagcgtactttgctgtcactcgttttggccctgctgttccccagcatggcttcaatggccatgcatgtcgcccaaccagctgtcgtcctcgcgtcaagccggggcatcgcctcgttcgtttgtgaatacgcaagtcctggcaaggcaacagaagttcgagtgactgtcctccgacaggccgactcccaggtcaccgaggtctgtgcggcaacctacatgatgggaaacgagcttaccttcctcgatgattccatatgtaccgggacctcgtcgggcaaccaggtcaacctgacgatccagggtttgcgtgctatggacacaggactgtacatttgcaaggtcgaacttatgtatccccccccatactacctgggtatcggtaacggcactcagatctatgtaatcgatcccgagccttgccccgattccgaccaagaaccgaaatcgtccgacaagacgcacactagccctccttctcctgcgcccgaattgttgggtgggtcttcggtcttcctcttcccgcctaagcctaaggataccctgatgatctctcgtacgccagaggtcacatgcgtcgtcgtagacgtgtctcacgaggaccctgaggtgaagttcaactggtacgtagacggcgtcgaggtacataacgccaagaccaagccgcgcgaggagcagtataactctacttaccgtgtcgtttcggtgttgacggttctccaccaggattggcttaacggcaaggagtacaagtgtaaggtctccaataaggccctgccggcgcctatcgagaagactatctctaaagccaaagggcagcctcgtgagcctcaggtctacactctgcccccgagtcgcgatgagctgaccaagaaccaagtgtcgctaacctgtttggtgaagggtttctacccgtcggacatcgctgtggaatgggagtctaacggacaacctgagaacaattataagaccacccccccggtcctggattccgatggcagcttcttcttatactcaaagcttaccgtcgacaagagccggtggcaacagggtaacgtattctcgtgttcagtcatgcatgaggcactgcacaaccactacacccagaagtcactctcgctgtcccctggcaag

SEQ ID NO: 15636 - DNA, 1149 bp, Artificial Sequence
  Description of Artificial Sequence: Synthetic coding sequence
atgggtgttctgcttacccaacgcaccctgcttagcctcgtgctggcgctgttgtttccttcaatggcatcaatggcgatgcatgtggcgcaaccagccgtggtgcttgcgtcctcgcgtggtatagcatcgttcgtttgtgaatacgcatcgccaggtaaggcgacggaagtgagagtgacggtgctgagacaggccgattcacaggtcaccgaggtgtgtgccgcaacttacatgatggggaacgagctgacctttttggatgattctatctgcaccggaacgagctcgggaaaccaggtcaatcttaccattcagggactgcgggcgatggacaccgggctgtatatctgcaaggtagagctgatgtacccacctccttactatctcggcataggaaacggcacccaaatctatgtgattgatccagagccatgtcctgactccgaccaagaacctaagtcatcggacaagacccatacctcgccaccgtctcccgccccagaactgctcggtggttcctcggtctttctttttcctccaaaacctaaggatactcttatgattagccgcacccctgaagtgacttgtgtcgtcgtggatgtctcgcatgaagatccggaagtgaaattcaattggtacgtggatggggttgaagtccacaatgcgaaaacgaaaccaagagaggaacaatacaattccacctacagagtggtgtcggtgctcactgtgctgcatcaggattggctcaacggcaaggaatacaaatgcaaggtcagtaacaaggcacttcctgcacctatcgaaaagacgattagcaaggctaagggacaacctcgggaacctcaagtgtacactcttcccccatcaagagatgagctgacgaaaaatcaagtgagccttacctgtcttgtcaagggattctacccttctgatattgcagtggagtgggaatcgaacggtcagccagagaacaactacaagactacccctcccgtgctggattcggacgggtccttctttctttactcaaaactgaccgtcgacaagtcaagatggcaacagggcaatgtcttttcatgttcggtgatgcatgaagcacttcataatcattatacccagaagtccctcagcctttcgcctggtaag

SEQ ID NO: 15637 - DNA, 1149 bp, Artificial Sequence
  Description of Artificial Sequence: Synthetic coding sequence
atgggcgtgcttttgacgcagcggactttgctgtcacttgtgttggccctcctttttccttcgatggccagcatggccatgcacgttgcgcaacctgctgtcgtccttgcctctagtaggggaatcgcctctttcgtgtgcgaatacgcaagcccaggtaaggcaacagaagtccgggttactgttctgagacaagcggatagccaagttaccgaggtgtgtgcagcaacgtatatgatggggaacgagctcacctttttggatgactccatctgcactggaacgtctagtgggaaccaggtaaatttgaccatacagggtcttcgtgctatggacaccggactatacatctgcaaggttgaactcatgtacccacccccgtactatcttggtattggcaacggcacacaaatctacgtgatcgacccagaaccgtgccccgattcggaccaggagcctaaatcctcggataaaacccatacttccccaccatccccggctcctgaactgctgggagggtcgtccgtgttcttgtttccgccgaagcctaaagacacgttgatgatctcgcgtaccccggaagtcacttgcgttgtcgtcgacgtctcccacgaggatccagaagtgaagttcaactggtatgttgacggcgtcgaagtacacaacgccaaaacgaagccgcgggaagagcagtataattccacttatagggtagtttcagtgcttactgtcttgcatcaggactggctaaatgggaaagaatacaagtgcaaggtctcaaacaaggctctgcctgctccgatcgagaagactatcagcaaggcaaagggtcagcctcgcgaaccgcaagtttacacgctcccaccttctagagacgagctcactaagaatcaggtttcacttacatgcttggtcaagggattttatcccagtgacatcgctgtggaatgggaatcgaacggacagcccgagaacaactacaagaccacgccccccgtcctcgattctgatggatcattctttctatatagcaagttgaccgtggataagtctcgttggcagcaaggtaatgtgttctcttgttccgttatgcatgaagcacttcacaaccattacacccaaaaaagtctgtcactttcgccaggaaag

SEQ ID NO: 15638 - DNA, 1149 bp, Artificial Sequence
  Description of Artificial Sequence: Synthetic coding sequence
atgggggtcctgctgacgcagcgcaccctcctgtcactggtcctggccctcctgttcccttcgatggcgtccatggccatgcatgtggcacagcccgcggtggtcctggcctcgtccagggggatcgcctcctttgtgtgtgagtacgcctccccaggaaaggccactgaggtgcgcgtcactgtcctgagacaggcagattctcaagtgaccgaagtctgtgccgcgacttatatgatgggaaacgagctgaccttcctcgacgatagcatctgcactggcacttcctcaggaaaccaagtgaatctcaccatccaaggcctcagggccatggataccggtctgtacatttgcaaggtcgaattgatgtacccaccgccgtactacctgggcattggaaatggaacccagatttatgtgatcgatcctgaaccctgcccggattcagaccaggagccgaaatcctcggacaaaacgcacacctcgccgccttcgccggcgcctgaactgcttggtggaagctccgttttcctgttcccgccgaagccaaaggacaccctgatgatctcgcggacgcccgaggtcacttgcgttgtggtggacgtgtcccacgaggaccctgaggttaagtttaactggtacgtggatggagtggaggtgcataacgctaagaccaaaccaagagaggaacagtacaattccacttaccgcgtggtcagcgtgctcactgtgctgcatcaagactggctcaacggtaaggaatacaaatgcaaggtgtcaaacaaggcactccctgctccgattgaaaaaaccattagcaaagctaaaggccagccacgggaacctcaagtctacaccctcccaccgtcgcgggatgaattgaccaaaaaccaggtgtccctgacttgtctggtgaagggtttctatccatcggacatcgccgtcgaatgggaatcaaacggccagccggagaacaactacaaaactactccgccggtcttggatagcgatggctcgttctttctctacagcaaacttaccgtggacaagtcccggtggcagcaggggaatgtgttcagctgctccgtcatgcatgaggctctgcacaaccattacacgcaaaagagcctgtccctgagcccgggaaaa

SEQ ID NO: 15639 - DNA, 1149 bp, Artificial Sequence
  Description of Artificial Sequence: Synthetic coding sequence
atgggtgtgcttcttacccaaaggactcttctctccctggtgctcgcccttctgtttccctccatggcctccatggcgatgcatgtcgcgcagccagcagtggtgcttgcatcgtcccgcggaattgcatcgtttgtgtgtgagtacgcatcgcctggtaaagcaaccgaggtgcgggtgaccgtgcttcggcaagcagatagccaagtgaccgaagtctgcgccgcaacttacatgatgggcaacgaactgacctttctggacgattcaatttgtaccggaacttcgtccggaaaccaggtgaatttgactatccaggggcttcgtgcgatggatactggcttgtatatctgcaaggtggaactcatgtaccccccaccatactacctgggaataggaaatggaacccagatttacgtgatagaccccgaaccttgtcccgactccgatcaagaaccaaagtccagcgacaagacccatacttctcccccaagcccagcacccgaactgcttggtgggtcgagcgtgttcctttttcctccaaaaccaaaggataccctgatgatctcgaggacccctgaagtcacgtgtgtggttgtggacgtctcccatgaggatccggaagtgaagtttaactggtacgtggacggagtggaggtccataacgcaaagaccaaaccacgagaggagcagtacaactcaacctaccgtgtcgtttcagtcctcacggtccttcatcaagattggcttaacggtaaggaatacaaatgtaaagtctcgaacaaggctcttcctgcgccaattgagaaaaccatctccaaggctaaggggcaacctagagagccacaagtctacaccctccctccttccagggatgagcttaccaagaatcaagtgtcgcttacttgcctggtgaaaggcttctacccgagcgatatcgcggtcgaatgggaatcgaacggtcagccagaaaacaactacaagaccaccccacctgtactggattcagacggtagcttttttctttactctaaactgacggtggataaatctaggtggcaacaaggtaacgttttctcttgttccgtcatgcatgaagctctgcataatcactacacccagaagagcctgtccctttcccctggaaag

SEQ ID NO: 15640 - DNA, 1149 bp, Artificial Sequence
  Description of Artificial Sequence: Synthetic coding sequence
atgggcgtgctcctgactcaacggacgttgctgagcctcgtgttggccctgcttttcccgtcgatggcgtcaatggctatgcatgtcgcccaaccggccgtggtgctcgccagctcgcgcggcatcgcgtcgtttgtgtgcgagtacgcctcgcctgggaaggccactgaagtgagagtgacggtgttgaggcaggcggacagccaagtgactgaggtgtgcgcagcaacctacatgatgggaaatgagcttaccttcctggacgactccatctgcacgggtacttccagcggcaatcaggtcaacctgactatccagggattgcgcgctatggacaccggcctgtacatctgcaaagtggagctgatgtacccgcctccttactacctgggcatcgggaacggcacccagatctacgtgatcgatcctgaaccttgcccagattcggaccaagagcccaaatcctccgataaaactcataccagcccaccatccccggccccagagctgctgggcggcagctcggtgttcctgttccctccaaagccgaaggacaccctcatgatatcgagaacccctgaggtgacctgcgtggtggtggatgtctcacacgaggacccggaggtgaagttcaactggtacgtggacggggtggaagtgcataacgccaaaaccaagccgagagaagagcagtacaacagcacttacagagtcgtgagcgtgcttaccgtgctgcatcaggattggttgaacggaaaggaatacaagtgtaaggtcagcaacaaagctctcccagcccctatcgaaaaaactatttcgaaagctaagggacagccgcgcgaaccgcaggtgtatactttgcccccctcgcgggacgagctcaccaagaaccaggtgagcctgacttgcctggtgaaaggattctacccgtcggatattgcggttgaatgggagtccaatggacaaccagagaataactacaagactactccaccggtcctcgactctgatggttctttctttctctacagcaagctcactgtggacaaatctcggtggcagcaaggaaatgtcttttcgtgctcagtgatgcacgaggccctccacaaccactacactcagaagtcgctctcactgtcacctggaaag

SEQ ID NO: 15641 - DNA, 1149 bp, Artificial Sequence
  Description of Artificial Sequence: Synthetic coding sequence
atgggagttctgcttacacaacgcactctgctaagcttggtcttggccttgttatttccatctatggcctccatggcgatgcacgtcgctcaacctgctgtcgttttggcatcgtcacggggcatcgcctcttttgtttgtgagtacgccagtcccggcaaagccacagaggtgcgtgtcaccgtgctgcgacaggcagattcccaggtcaccgaagtttgcgccgccacctatatgatgggcaatgagctgaccttccttgatgactcaatctgtacaggaacttctagcgggaatcaggttaacttgaccatccaagggctgagggcaatggatacaggactctatatttgtaaggtggagctcatgtaccctccaccatattatctgggcattggcaatggaactcagatctatgtgatcgatcccgagccctgcccagatagtgaccaagaacctaaatcctctgacaagactcacacatctcctccctctcccgcgcccgagttgctaggaggttcgtctgttttcttattccctccaaagccaaaggataccctgatgatcagtcgcacacctgaggtgacgtgtgtggttgtcgacgtcagtcatgaagacccagaagtgaagttcaattggtacgtagacggcgttgaagtgcataatgccaagacgaagccccgggaggagcaatacaactcaacttaccgagtggtgagtgtgctgactgtgttgcaccaagattggctgaatggtaaagagtataagtgtaaggtgagcaataaagcactgcccgctcctattgagaaaacaattagcaaagcaaaggggcagccacgggaaccacaggtgtacacattgccaccgtcccgggatgaacttacaaaaaaccaagtgagtcttacatgccttgttaaaggtttttacccatctgatatcgccgtggaatgggagagtaatggacagccggagaacaattataagacaaccccgcccgtccttgatagcgatggatcattttttttgtattccaaactcaccgttgacaaatccagatggcagcagggtaacgtgttctcatgtagcgtgatgcacgaagcccttcataaccattatacccagaagtccttgtctttgagtcccggaaaa

SEQ ID NO: 15642 - DNA, 1149 bp, Artificial Sequence
  Description of Artificial Sequence: Synthetic coding sequence
atgggagtcttgctgacacagaggaccctgctcagtcttgtgctggccctgcttttcccgtctatggcgtccatggcgatgcacgttgcccagcccgctgttgtcttggcttctagccgcgggattgcctcattcgtgtgtgaatacgcctccccaggtaaagctacagaagtcagagtcacggtgcttcgccaggccgacagccaggtaaccgaggtttgtgccgcaacatatatgatggggaatgagttgacattcctcgacgactccatctgtaccggcacaagctccgggaaccaggtgaacctgactattcaggggctgcgcgcaatggatactggcctctacatatgcaaagtggaactcatgtatcctccaccctactacttgggcattggaaatggtactcagatctatgtcattgaccccgagccatgcccagacagcgatcaggagccgaagagttccgacaaaactcacactagtccaccttcaccggctcccgagctcctggggggctcttctgtgttcttgttccccccaaaacccaaggacacccttatgatctccagaacaccagaagtcacctgcgtagtggtggacgtatctcacgaggatcctgaggtcaagttcaattggtatgtggacggcgtggaagtccacaacgccaagacgaagccacgagaagagcagtacaatagcacctatagggttgtgtctgtattgaccgttcttcatcaggactggcttaatggtaaggaatacaagtgtaaggtctctaacaaggcccttccggcgcccattgagaaaaccatctccaaggctaaggggcagcccagggaaccacaggtgtacacccttccacccagccgggacgagctgaccaagaatcaggtatccctgacttgccttgtgaagggcttctatccctcagacatcgcagtcgaatgggagtccaatgggcagcctgagaataattacaaaaccacgccacctgtccttgacagcgacggctccttttttctgtattccaagctgacggtggacaaaagccggtggcaacagggcaatgtgttttcttgctctgtgatgcacgaagccctgcacaatcactacacacagaagagtttgtcactgagccccgggaaa

SEQ ID NO: 15643 - DNA, 1149 bp, Artificial Sequence; identical to SEQ ID NO: 15621
  Description of Artificial Sequence: Synthetic coding sequence

SEQ ID NO: 15644 - DNA, 1149 bp, Artificial Sequence
  Description of Artificial Sequence: Synthetic coding sequence
atgggcgtgcttctgacacagaggacgcttttgagtctcgtgttggctctcctgttcccttctatggccagtatggccatgcacgtcgcccagccagctgttgtactggccagctcacgcggcattgccagctttgtatgtgaatatgcctcccccgggaaggcgacagaagtgagagtcaccgtgctgcgccaggcagattcgcaggtcaccgaggtgtgtgccgccacttacatgatgggtaacgagctgaccttcttggatgattccatatgcactgggacttccagtggcaaccaagttaatctcaccattcaggggctgcgggcaatggataccgggctgtatatctgcaaggttgaattgatgtacccacccccctattatctaggtataggcaacggaacacaaatatacgtgatcgatcctgagccatgtccagattcagaccaagaaccgaagagttcagacaagacccatacctcacccccgtctcccgctccagaactcctgggcggctctagcgtatttctctttccacctaagcccaaggacacacttatgatctcccggactcccgaggtgacttgtgtggttgttgatgtgagccacgaggaccctgaagtcaaatttaattggtatgtggatggcgtcgaggtgcacaacgccaaaacaaagcctcgagaagaacagtacaactcaacttatagagtggtgagtgtgttgaccgtgctccatcaggactggcttaacggaaaggaatataagtgcaaagtgagcaacaaagctctgcctgctcccatcgaaaagacgatcagtaaagccaaaggccaaccacgagagccccaggtgtatacgctgcccccgtcccgggacgagctgaccaaaaaccaggtgtcattgacctgtctcgtgaaggggttttatcccagcgatatcgccgtcgaatgggaaagcaatggacagccggaaaacaattacaagactacgcctcccgtgctagattcagacggctcattctttctgtactcaaaactgactgtagacaaatcgcggtggcaacagggcaatgtgttcagctgcagtgtaatgcacgaggccctccataatcactacacccaaaagtctttgtctttgagtccagggaag

SEQ ID NO: 15645 - DNA, 1149 bp, Artificial Sequence
  Description of Artificial Sequence: Synthetic coding sequence
atgggtgtactcctgactcaaaggactctgcttagcctggtgctcgccctgctttttccgtccatggcaagcatggcgatgcacgtggcacagccagccgtggtccttgcatcttctaggggaatagcttcattcgtctgcgaatatgcatcccccggaaaggccaccgaggttcgggtgactgtcctcagacaggctgattctcaggtgacggaggtttgtgcagctacatacatgatggggaatgagctgaccttcctcgacgatagcatttgcactgggacaagctccgggaaccaagtgaacctgaccattcagggcctgagagccatggacaccggactgtatatctgtaaggtcgagctgatgtaccctccgccgtattacctgggaattgggaacggtacacagatatacgtcatcgaccccgagccttgcccggatagcgatcaggaaccaaaatcttccgataagacacatacatcaccgccaagccctgctccagaactactgggaggatcatcggtcttcctattccctccgaaacctaaggatacgcttatgatttccagaactccagaggtgacgtgtgtggtagtcgatgtgagtcacgaagaccctgaggtcaaattcaattggtacgtggatggcgtggaggtccacaacgcgaaaactaaaccccgcgaggagcaatataactccacctatcgggtcgtcagcgtactcaccgtgttgcatcaggattggcttaacgggaaggagtataagtgcaaggtgtccaacaaggcactcccagcccctatcgagaagaccataagtaaagcaaaggggcaaccaagagagccacaggtttacacgttacctccctcacgggacgagctgaccaaaaaccaagtgagcttgacctgcttggtaaagggattctatccaagcgacatcgcagtggagtgggagtcaaacggtcagcccgaaaataactacaagacaacccccccggttctggacagcgacggctctttttttctatatagcaaacttaccgtggacaaatcccggtggcagcagggaaacgtgtttagctgttccgtcatgcacgaagcgcttcacaatcattatacacagaaatccctgtccctcagtcccggtaaa

SEQ ID NO: 15646 - DNA, 1149 bp, Artificial Sequence
  Description of Artificial Sequence: Synthetic coding sequence
atgggtgttctattaacgcaacgaacgttactatcgctagtattagcgctattatttccgtcgatggcgtcgatggcgatgcatgtagcgcaaccggcggtagtactagcgtcgtcgcgtggtatagcgtcgtttgtttgtgaatatgcgtcgccgggtaaagcgacggaagtacgagttacggtattacgtcaagcggattcgcaagtaacggaagtatgtgcggcgacgtatatgatgggtaatgaactaacgtttttagatgattcgatatgtacgggtacgtcgtcgggtaatcaagttaatttaacgatacaaggtttacgagcgatggatacgggtttatatatatgtaaagtagaattaatgtatccgccgccgtattatctaggtataggtaatggtacgcaaatatatgtaatagatccggaaccgtgtccggattcggatcaagaaccgaaatcgtcggataaaacgcatacgtcgccgccgtcgccggcgccggaattattaggtggttcgtcggtatttttatttccgccgaaaccgaaagatacgctaatgatatcgcgtacgccggaagtaacgtgtgtagtagttgatgtatcgcatgaagatccggaagtaaaatttaattggtatgtagatggtgttgaagttcataatgcgaaaacgaaaccgcgtgaagaacaatataattcgacgtatcgtgttgtatcggtattaacggtattacatcaagattggttaaatggtaaagaatataaatgtaaagtttcgaataaagcgctaccggcgccgatagaaaaaacgatatcgaaagcgaaaggtcaaccgcgagaaccgcaagtatatacgctaccgccgtcgcgtgatgaactaacgaaaaatcaagtatcgttaacgtgtttagtaaaaggtttttatccgtcggatatagcggttgaatgggaatcgaatggtcaaccggaaaataattataaaacgacgccgccggttttagattcggatggttcgttttttctatattcgaaattaacggtagataaatcgcgatggcaacaaggtaatgtattttcgtgttcggtaatgcatgaagcgttacataatcattatacgcaaaaatcgttatcgctatcgccgggtaaa

SEQ ID NO: 15647 - DNA, 1149 bp, Artificial Sequence
  Description of Artificial Sequence: Synthetic coding sequence
atgggcgtgttgctcacccagcggactctgctttcactggtcctcgccctcctttttccatcgatggcatcgatggcgatgcacgtggctcaacctgcggtggtgctggcatcgtcacgcggcattgcatccttcgtttgtgagtacgccagccccggaaaagcgactgaagtgagagtaactgtgctcagacaggcagattcacaagtcacggaggtctgcgcagccacctatatgatgggtaatgaactgacgttccttgacgattcgatttgtactgggacctcgagcggaaatcaagtcaaccttaccattcaaggtctgagggcaatggataccgggctgtacatatgtaaggtggaacttatgtacccacctccttactacctggggattggaaatggtacccagatctacgtgatcgatccagaaccttgtcccgactccgatcaagagccaaagtcgtctgataaaacgcataccagccctccctcacctgcacctgagcttttgggaggctcaagcgtgttcctctttccccctaagccgaaggatactcttatgatcagcagaactccagaagtgacctgcgttgtggtagacgtctcacatgaggatccagaagtgaagtttaactggtatgtcgatggagtggaggtccataatgcaaagaccaaaccaagagaggagcagtacaactcgacttacagagtggtgagcgtcctgaccgttctgcatcaggactggcttaacggaaaagaatacaagtgcaaggtgtctaacaaagccctcccggcacctattgaaaaaacgatctccaaggcaaagggacaaccacgcgaacctcaagtgtacacgctgcccccttcgcgcgacgaactgaccaagaatcaggtgtctctgacctgtttggtcaagggcttttacccatctgacatagccgtcgagtgggaaagcaacggccagcctgaaaacaattacaagactactcctcctgtgctggattccgatggatcgttctttctgtactctaagctgactgtggacaagtctcgttggcagcaaggcaacgtgtttagctgttccgtgatgcacgaagctcttcataaccactacactcagaaaagcctctctcttagtcccggaaag

SEQ ID NO: 15648 - DNA, 1149 bp, Artificial Sequence
  Description of Artificial Sequence: Synthetic coding sequence
atgggagtgctgctcacccaaagaaccctcttgtcgctggtgctcgccctgctgttcccgagcatggcttcgatggcgatgcacgtggcacaaccggcggtggtgctcgcatcatccagaggaatcgcgtctttcgtctgtgaatacgcaagccctggaaaggcaaccgaagtgagagtcactgttctccggcaggctgactcgcaggtgactgaagtgtgcgccgcaacctacatgatgggcaacgaattgaccttccttgacgactccatctgcaccggcactagctccggaaaccaggtgaatcttaccatccaaggcctgagggccatggatacgggtctttacatctgtaaggtggaactcatgtacccaccgccgtactatctgggcatcggaaacggaacccagatctatgtgatcgatccggaaccgtgtcccgactcggaccaagagccgaagtcatccgacaagacccacacctcccctcctagcccagccccggagcttctgggaggatcgtcagtctttctcttccctcctaagccgaaggatactctcatgatctcgcggactccagaggtgacctgcgtggtggtggatgtgtcacacgaggatcccgaagtcaagtttaactggtacgtggacggcgtggaagtccacaacgcaaagacgaagccgagggaggaacaatacaattccacctaccgggtcgtgtctgtcttgactgtgctccatcaagactggctcaatggtaaggagtacaaatgcaaagtgagtaacaaagccctgcccgctccgatcgaaaaaaccatcagcaaagccaaaggacagccgcgcgagcctcaagtgtacactctcccgccgagccgggacgaactgactaagaatcaagtctccttgacttgtctcgtcaaggggttttacccatccgatatcgccgtggagtgggagtcaaacggccagccagagaacaattacaagactaccccgccggtgctggacagcgacggatcctttttcctttactccaaactgacggtggataagtcccggtggcagcaaggcaacgtgttctcctgctcggtgatgcatgaggccttgcacaaccactacactcagaagtcactgtcgctctccccgggcaag

SEQ ID NO: 15649 - DNA, 1149 bp, Artificial Sequence
  Description of Artificial Sequence: Synthetic coding sequence
atgggtgtgctgctgacacagcggacattgctttcactggtgctggccttgctttttccttccatggcgagcatggccatgcatgttgctcagcccgcagtggtgctggcgagctcccgggggatcgcttcttttgtgtgcgagtatgcatcccccggcaaggccactgaggtccgggttacagtgttgcggcaggcagactctcaggtcaccgaggtgtgcgcggcgacctacatgatgggaaacgaattgaccttcctcgacgatagcatatgcactggcactagcagcggtaatcaggtgaaccttacaatccagggcttgcgggctatggacaccggcctgtacatttgcaaagtggagctgatgtaccccccaccctactacctcgggattggtaacggaacacagatctatgtgatcgatccagaaccatgccctgattctgaccaggagcccaaatccagtgacaagacacatacgagccctccatcccccgccccagaactgctgggaggctcctctgtcttcctctttcctcccaagcccaaggacaccttgatgatctcaaggacccctgaggtaacatgtgttgtggtagatgtcagtcacgaggacccagaagtaaaattcaattggtatgtcgatggagtggaggtacataacgcaaagacaaaacccagagaagaacaatataacagcacttatcgggtggtaagcgtgttaaccgtcctccatcaagattggctcaatgggaaagagtataagtgtaaggtttctaacaaggccctcccggcgccgatagagaaaacgatttctaaggcaaaaggacaaccccgtgagccccaggtttatacccttcccccatccagggatgaacttactaaaaaccaggtgtctcttacctgtctggtaaaagggttttaccctagtgacatcgccgtcgaatgggagtctaatggacagccagaaaacaactacaagaccacccctcccgtgctggattcagatggttcctttttcctttattccaaactaacagtggacaagtcaaggtggcagcagggcaatgtcttcagttgttctgtgatgcacgaggcgttgcacaatcactatactcagaagtcattatcactgtcaccagggaag

SEQ ID NO: 15650 - DNA, 1149 bp, Artificial Sequence
  Description of Artificial Sequence: Synthetic coding sequence
atgggagtattattaactcaaagaacactactctcattagttttagctttattatttccatcaatggcatctatggctatgcatgtcgcacaaccagctgttgttttagcatcttcaagaggaattgcatcttttgtttgtgaatatgcttcaccaggaaaagctactgaagttagagtaacagttcttagacaagctgatagtcaagtaacagaagtttgtgctgcaacatatatgatgggtaacgagttaacatttttagatgattctatttgtactgggacttcatctggtaatcaagttaatcttactattcagggactacgagcaatggatactggtttatatatatgtaaagttgaattaatgtatccaccaccatattatttaggaattggtaatggaacacaaatttatgttatagatccagaaccatgtccagatagtgatcaagaaccaaaatcatcagataagactcatacttctccaccatcaccagcacctgaattacttggaggaagttcagtttttttatttcctcctaaaccaaaagacacacttatgatcagtaggacacctgaagttacctgtgtagttgttgatgtttcacatgaagatccagaagttaaatttaattggtatgttgatggagttgaagttcacaatgcaaagacaaaaccacgtgaagaacaatacaattcaacatatagagttgtttctgtacttaccgtacttcatcaagactggcttaatggaaaagaatataagtgtaaagttagtaataaagctctacctgctccaatagaaaaaactatatcaaaagctaaaggacaaccaagagaaccacaagtatatacattaccaccaagtcgtgatgaattaacaaagaaccaagtaagccttacatgtcttgttaaaggattctatccaagtgatatagcagttgaatgggaatctaatggacaaccagaaaataattataaaacaactccaccagttttagattctgatggttcattttttttatattctaaattaactgtagataagagtagatggcaacaaggaaatgtgttttcttgctctgttatgcatgaggcccttcataatcattacactcaaaaatctctttcacttagtccaggaaaa

SEQ ID NO: 15651 - DNA, 1149 bp, Artificial Sequence
  Description of Artificial Sequence: Synthetic coding sequence
atgggagtgctgcttacccagaggaccctgctgagcctggtgctggccctcttgttcccctcaatggccagcatggcaatgcacgtggcccagccggccgtggttctggcgtcgtcacgggggattgcatccttcgtgtgcgaatacgcgagccccggcaaggcgaccgaggtgcgggtgactgtgctgcgccaggctgactcccaagtgactgaggtctgcgccgcaacctacatgatgggaaacgaacttacgttcctggacgattcgatctgcaccggaacctcatcgggaaaccaagtgaatctgacgatccaaggtctgcgggctatggatactggcctgtacatctgcaaggtcgaactgatgtacccaccaccgtattacctgggaataggaaatggaacccagatctacgtgatcgacccggagccttgcccagacagcgaccaggagcctaagtcgagcgataagacccatacgtcccctccgtcgcccgcgcctgagttgctcggtggatcctcagtctttctgttcccaccgaagccaaaagacacgctcatgatctcgcgcacccctgaagttacctgcgtggtcgtggacgtgtcacatgaggaccccgaggtgaagttcaactggtacgtggacggtgtcgaagtgcataacgctaagactaaacctcgcgaggaacagtataactcgacttacagagttgtgagcgtgctgaccgtgctgcaccaagactggctcaacggaaaagaatacaagtgtaaggtgagcaacaaggccctgccggcgccgatcgagaaaaccatctccaaggccaaaggacaaccccgggagccccaagtgtacaccctgccgccttccagagatgagctcactaagaatcaggtgtcgctcacttgtctggtgaaagggttctacccctcagatattgccgtggagtgggaatccaacggacaaccagagaacaactacaagactaccccgccagtgctcgactcggatgggtcgttcttcctgtactccaaacttaccgtcgataaatcccggtggcaacagggcaatgtgttttcgtgcagcgtgatgcatgaggcgctccataaccattacacccagaagtcattgagcctctcacccggtaag

SEQ ID NO: 15652 - DNA, 1149 bp, Artificial Sequence
  Description of Artificial Sequence: Synthetic coding sequence
atgggagtgctgctgactcagcggacactgctctctctcgttttggccttgctgttcccaagtatggcttcgatggccatgcacgtggcccagcctgcggttgtgttggcaagttcaagaggaattgcctccttcgtgtgcgagtatgctagtccaggcaaggcaaccgaggtccgcgtgacagttctgcggcaggccgacagccaggtgaccgaggtgtgcgctgccacatacatgatgggcaacgagctcaccttccttgacgattctatttgtacaggaacttcctcagggaaccaagtgaatctgaccatccagggtctgcgagccatggataccggattgtacatatgtaaggtcgagctcatgtacccaccaccctattacctggggataggcaatggcactcaaatctatgtaatagatccagaaccatgtcctgattctgatcaggagcccaagtccagtgacaaaacgcatacaagcccgcctagccccgcccccgagcttctaggtggatcttccgtttttttgttcccacctaagccgaaagacacgcttatgataagtagaacccctgaagtgacctgcgtggtagttgatgtatctcacgaggatcccgaagtgaagtttaattggtatgttgatggggtcgaggtgcacaatgccaagacgaagccacgagaggagcagtacaacagtacataccgggtggtatcggtgctaactgtcctccaccaggattggctgaatggtaaagaatacaaatgtaaagtttccaataaagcgctgcccgctccgatcgagaagaccatcagcaaggccaagggacagccccgcgaaccccaagtgtacactctcccccctagccgcgatgaactgactaagaatcaggtgagcctgacctgtctggttaagggcttttaccccagcgatattgccgtggaatgggagagcaacggacagcctgaaaataactataaaaccaccccaccagttctcgattccgatggttctttctttctgtattccaaactgaccgtcgacaagagccgatggcagcagggaaatgtgtttagttgcagtgtgatgcacgaggctctgcataaccactacacacagaagtccctaagtctttcgcccggaaag

SEQ ID NO: 15653 - DNA, 897 bp, Artificial Sequence
  Description of Artificial Sequence: Synthetic coding sequence
atgaagtgggtttcgttcatctcgcttctgttcctcttctcttccgcctactcgggttcactcgataaaagacacggcgaagggaccttcacgagcgacgtctcctcctacctggaagagcaggcagccaaggaattcattgcatggctcgtgaaaggcggagggggaggcggtggatcgggaggcggagggagcggaggtggaggctccgccgagtcaaagtacggaccaccatgccccccgtgcccggcgccggaggcagccgggggcccatcagtctttctttttcctcccaagcctaaggataccctgatgatttcacgcacgccggaggtcacctgcgtggttgtggacgtgagccaagaggatccggaggtgcaattcaattggtacgtcgacggagttgaggtgcataatgcaaagaccaaaccacgggaggaacagttcaattcgacttaccgcgtcgtgagcgtgctgactgtgttgcaccaggattggctgaatggaaaggagtacaagtgtaaggtgtcgaacaagggactgccgtcctcgatcgaaaagactatcagcaaggccaaaggacagccgagagaaccgcaggtgtacaccctgccgccgtcccaggaagagatgactaagaatcaggtttcgctgacctgtttggtgaagggcttctacccgagcgacatcgccgtggaatgggagtccaatggtcagccggaaaacaattacaaaaccacgcccccggtgctcgactcggacgggtctttcttcctgtactcccggctgactgtggataagagccgttggcaagaaggaaacgttttttcctgttcggtcatgcacgaggcactgcacaaccattacacccaaaaaagcctcagcctgtcccttggg

SEQ ID NO: 15654 - DNA, 897 bp, Artificial Sequence
  Description of Artificial Sequence: Synthetic coding sequence
atgaagtgggtgtcgttcatctcactgctgtttctcttcagtagcgcgtacagcggtagccttgacaagaggcatggagaaggaacctttaccagtgacgtgagtagctatctcgaggaacaggcggcaaaggaattcatcgcgtggctggtcaaaggtggtgggggaggaggtggctccggaggcggaggctcaggaggcgggggaagcgctgaatcgaagtacggccctccgtgcccaccttgtccagcccctgaagccgcagggggaccttcggtctttctgtttccacctaaaccgaaggacaccctcatgatctcccggacccccgaggtgacctgcgtggtggtggacgtgtcccaggaggatcccgaggtgcagttcaattggtacgtcgacggggtggaggtgcacaacgccaaaaccaagccgagagaggaacagttcaatagcacttaccgcgtcgtttctgtgctcaccgtacttcaccaagattggctgaacggcaaagagtacaagtgtaaggtgtcgaacaagggattgccatcctccatcgaaaagactatctccaaggccaaaggtcaaccccgggaacctcaagtctacacgctgccgccatcgcaggaggagatgaccaagaaccaagtctccctgacttgcctggtcaaaggcttctacccgtcagatattgctgtggaatgggagagcaacgggcaacctgagaacaactacaaaactacgccgccggtgctcgactcggatggctcgttcttcctttactcccgactcaccgtagacaagagccgctggcaggaaggcaatgtgttcagctgttctgtgatgcacgaagccctgcacaatcattacactcagaagtcgctgtcgttgtcgctgggc

SEQ ID NO: 15655 - DNA, 897 bp, Artificial Sequence
  Description of Artificial Sequence: Synthetic coding sequence
atgaagtgggtgtcattcatatcactcctctttctgttttctagtgcatattcagggtctcttgacaaacgacatggagaaggaactttcactagtgacgtgtcttcttacctggaggaacaggctgcaaaggaattcatagcctggcttgtgaaaggaggaggaggggggggaggatctggagggggggggtctggaggaggagggtctgctgaatctaaatatggacctccatgtcctccatgtcccgcaccagaagccgcaggggggccttctgtgttcctgtttccacctaaaccaaaagatacgctaatgatatctcgcacacccgaagtgacatgtgtggtggtggatgtttcacaggaagatcccgaagtacagttcaactggtatgtagatggggttgaagtgcataatgccaaaactaaacctcgggaggagcagttcaattcaacgtatagggttgtgtcagtactgacagtcctgcaccaggattggttaaacgggaaagaatataaatgtaaagtcagtaacaaagggttaccctctagtatcgaaaaaacaatttctaaagcaaaaggacagccgcgcgaacctcaggtctatactctccctcccagtcaggaagaaatgactaaaaatcaagtttcacttacatgcttggtgaaaggattctacccttcagatatagcagtggaatgggaatcaaacgggcagcctgaaaataattataagacaacaccccccgttctggattctgatgggtctttttttctgtatagtcgcttaacagtggataagtccaggtggcaggaagggaatgtgtttagttgctctgttatgcatgaagccctccataatcattacactcagaaatctttaagtctctctcttgga

SEQ ID NO: 15656 - DNA, 897 bp, Artificial Sequence
  Description of Artificial Sequence: Synthetic coding sequence
atgaagtgggtgagcttcatttccctgctctttcttttttcctcagcctacagcggcagcttggataagcggcatggtgagggcacctttacttcagatgtgtcgtcctaccttgaagagcaagcagcaaaagagttcattgcttggctggtgaaaggcggtggcggcgggggtggttccggaggcggagggtcgggtggtggaggcagcgcagaatccaaatacggacccccatgtcctccctgtcccgccccagaggcagcagggggcccatccgtgttcctcttccctcctaagcctaaggatactctcatgatttcgcgaacccctgaagtgacctgtgtggtggtggacgtctcccaggaagatcctgaggtgcaattcaattggtacgtggatggtgtggaagtgcataacgcgaaaactaagccccgcgaggaacagttcaacagcacctaccgcgttgtgtcagtcctgaccgtgctgcaccaagactggcttaatggcaaagaatacaaatgtaaggtgtcaaacaaaggtttgccatcgtctatagagaaaactatatcaaaggccaagggtcaaccaagagaaccacaggtctacaccctgcctccttcacaagaagagatgaccaaaaaccaggtgtcccttacctgtcttgtcaaggggttttacccatcggatattgcagtggaatgggaatccaacggacagccagaaaacaactacaaaacgactccaccagtgttggattccgatggaagtttctttctgtattcccgtttgaccgtggacaagagccggtggcaagaaggaaatgtgttttcgtgttccgtgatgcacgaagcactgcataaccattacacccaaaaatcgctctccctgtcgctcggg

SEQ ID NO: 15657 - DNA, 897 bp, Artificial Sequence
  Description of Artificial Sequence: Synthetic coding sequence
atgaagtgggtttccttcatcagcctgttgtttcttttttcgtccgcatactcgggatccctggataagaggcacggtgaaggaacctttacgtcagatgtgtcaagctacttggaggagcaggcggcaaaggagttcattgcgtggctggtcaagggtggtggtgggggcggcggttccggagggggaggatccggagggggcggctctgctgagtcgaagtacggtcctccttgtcccccatgcccagccccagaagcagcaggagggccatcggtgtttctgtttcctcctaagccaaaggacactctgatgatctcgcggacccccgaagtgacctgcgtcgtggtggacgtctcgcaggaggatcctgaagtccagtttaactggtacgtggacggagtggaagtgcataatgcaaagaccaagcccagagaagaacagtttaactcgacctatcgcgtggtgtcagtgctgactgtgctgcaccaggattggctgaatggaaaggagtacaagtgcaaggtatcgaacaaaggtttgccttcatcaattgaaaagaccatcagcaaggccaagggacagcctagagaaccgcaagtctacactctcccacctagccaagaagaaatgaccaaaaaccaagtctccctcacctgtctcgtgaaaggattttacccttcagacattgcagtggaatgggaatcgaacggccaacccgagaacaactataagacgacccctcctgtgctggattccgatggatcgttttttctgtactcgcgtcttactgttgataagtcccggtggcaagaagggaatgtgttctcatgcagcgtcatgcatgaggcactgcacaatcactacactcagaagtcactgtccctttcgttggga

SEQ ID NO: 15658 - DNA, 897 bp, Artificial Sequence
  Description of Artificial Sequence: Synthetic coding sequence
atgaagtgggtcagctttatctccttgttgttcctattcagctcagcctacagcggctccctcgataagcgccacggagaagggacttttacgtccgacgtctcatcgtacctggaagagcaggcagctaaggagtttatcgcatggcttgtcaagggtgggggcggaggtggtggctctgggggaggagggagcggcggggggggaagtgctgaaagcaagtatggccccccttgtcctccgtgtcctgctccggaggccgctggtggtccaagcgtatttctctttccccccaagcccaaagataccctgatgatctctcgtaccccagaggttacatgtgtagttgtggatgtatcccaagaggaccctgaggtacagtttaattggtacgtggacggagtggaagttcataacgcgaagactaagccacgcgaagagcagttcaatagcacttaccgcgttgtgagcgtgctcacggtgctccaccaagactggttaaacggcaaggaatacaagtgcaaggttagtaataagggtttgccttctagtatagagaagacaattagtaaggccaaggggcagccacgagagccccaggtgtatacgctaccgccaagtcaggaggaaatgactaaaaatcaagtatcactgacatgcttagtcaagggattttacccaagcgacatcgccgttgagtgggagtctaatggtcagcctgaaaacaattacaaaacaactccaccggtcctcgattcggatggatcattttttctgtactccagactgactgtggacaagagtcgatggcaggaagggaacgtttttagttgttccgttatgcacgaagccctgcacaaccactacactcagaagagtctgtccctcagcttgggc

SEQ ID NO: 15659 - DNA, 897 bp, Artificial Sequence
  Description of Artificial Sequence: Synthetic coding sequence
atgaagtgggtcagttttattagcctgctgttccttttctcttccgcatatagtggtagtctggataaacgacatggggaggggaccttcacatcagacgtctctagctacctcgaggaacaagctgccaaggaattcatcgcctggttggtgaagggcggcggcgggggcggcggctcaggcggggggggcagcggcggaggaggctccgccgagagcaaatatgggccaccttgcccaccgtgtccagcaccagaagcggctggcggaccctcggtcttcctgtttccccctaaacctaaggacacccttatgatcagtagaacccctgaagtcacttgcgtggtggtggacgtgagtcaggaggatccagaggtacaatttaattggtatgtggacggagtcgaagtgcacaatgcaaagacaaaacctagggaagagcagtttaattctacgtatagggtggtgtcagtactcactgtactgcatcaggactggctgaatggcaaggagtataagtgcaaggtcagtaacaaggggctaccaagttcaattgagaaaacaatttcgaaagcaaaaggccagcctagagagcctcaggtgtatacgctgcctccctctcaggaggagatgacaaaaaatcaagtgtcattgacctgtctcgtgaaggggttctatccaagcgatatcgccgttgaatgggaaagtaatggacaaccggagaacaactataaaacgacacctccagtgctcgactccgacggtagcttttttctatacagtaggcttaccgtcgacaaatcgcggtggcaggagggcaatgtgttctcctgttcagtcatgcacgaagcccttcataatcattatacccaaaaaagcctttccctttctttgggt

SEQ ID NO: 15660 - DNA, 897 bp, Artificial Sequence
  Description of Artificial Sequence: Synthetic coding sequence
atgaagtgggtgagcttcatcagcctgctcttccttttttcatcggcctactccggatcgttggacaaacggcatggcgaagggacctttacttcagatgtgtcatcgtaccttgaggagcaggcagcgaaagagttcatcgcgtggctggtgaaaggaggcgggggaggaggaggtagcggcggtggaggaagcggagggggtggttcagcagaaagtaaatacggcccaccttgccctccgtgcccggctcctgaagctgcgggtgggccgtcggtctttctgttccctccaaagccgaaggacaccctgatgatctcgcggaccccagaggttacttgcgtggtggtcgatgtcagccaagaagatccggaagtgcagtttaactggtacgtggacggtgtggaggtgcataatgccaagactaagccaagggaagaacagttcaactcgacctacagagtcgtgtcagttttgactgtgctccaccaagactggctgaacggcaaggaatacaaatgcaaggtgtcaaacaagggcctgccgtcgtcaatcgagaaaactatctctaaggccaaaggacagccgcgggaaccgcaggtgtacaccctgcccccttcacaggaggaaatgactaaaaaccaggtgtcgctgacttgcctggtcaaggggttttacccctctgacatcgctgtcgagtgggaatcaaacgggcagccagaaaacaattacaaaaccaccccaccggtcctggactcggacggatcgtttttcctctactcacggctgacggtggataagtcccgctggcaggagggaaacgtgttctcatgttcggtgatgcacgaagcactgcacaaccactacactcagaagtcactttccctcagcctgggt

SEQ ID NO: 15661 - DNA, 897 bp, Artificial Sequence
  Description of Artificial Sequence: Synthetic coding sequence
atgaagtgggtcagctttatctcgctgctttttctgttcagcagcgcctactccggctccctcgataagcgccatggagagggaacctttacttccgatgtcagctcgtatcttgaagagcaggcagcaaaagagtttatcgcttggcttgtgaaggggggcggtggcggtggtggctccggcggcggaggctcgggtggaggtggtagcgcggaatcaaagtacggacccccctgtcccccgtgtcctgcacctgaagcagcaggtgggccctcagtgttccttttccctcctaagccaaaagacacccttatgatttccagaacccctgaggtgacctgtgttgtggtggatgtgtcacaagaagatcctgaagtgcaattcaactggtatgtcgacggagtggaagtgcacaacgcaaaaactaagcccagagaggaacagtttaactcgacctacagagtggtgtccgtgcttactgtgctccaccaggattggcttaacgggaaggagtacaagtgtaaagtctccaataaaggactgccatcgtcaatcgagaaaaccatatcaaaagcaaaggggcagcctagggaaccacaagtgtacactcttccaccaagccaagaagaaatgactaagaaccaggtttctttgacttgtctcgtgaaaggcttctacccctccgatattgccgtcgaatgggagtccaacgggcaaccagaaaacaactacaaaaccacccctccagtgctggatagcgacggctcattctttctgtattcgaggctgactgtggataaaagcaggtggcaagaaggaaatgtgttttcgtgttccgtgatgcatgaggcgctccacaaccactacactcagaagtccctgtctttgtccctgggg

SEQ ID NO: 15662 - DNA, 897 bp, Artificial Sequence
  Description of Artificial Sequence: Synthetic coding sequence
atgaagtgggtatcgttcatcagcctgctgtttcttttttcgagtgcatactcaggcagtcttgataagcgccacggcgagggcaccttcacctccgatgtaagctcatacctcgaggagcaggccgccaaggaattcatagcatggctagtcaagggcgggggaggggggggaggttcaggaggcgggggatccgggggcggaggctctgcagaatcaaaatacggaccgccatgtcccccttgccctgcccctgaggctgctggtgggccctctgtttttttatttccaccaaaacccaaggatacactgatgatctccagaaccccagaggttacctgcgtcgtcgtcgatgttagtcaggaagacccagaggttcagttcaattggtacgtagatggtgtggaggtgcacaatgccaagactaagcctagggaagagcagtttaacagcacatacagggtcgtgagtgtgctcacagtcctccatcaggattggctgaacggaaaggaatacaaatgcaaagttagcaataaaggcctcccgagttccatcgagaaaaccatcagtaaggctaagggccagccaagagagcctcaggtgtataccctcccccccagtcaagaggaaatgacgaaaaatcaagttagtctgacgtgccttgtaaagggtttctacccctcggacatcgccgtggaatgggaatccaacgggcagcctgagaataattataagaccacccctcccgtgctggattctgatggtagtttcttcttatacagcagactgaccgtggacaaatcaagatggcaggagggtaacgtcttcagctgctcggtgatgcatgaggctctccacaatcattatactcagaaatcactgagcctctcgcttggc

SEQ ID NO: 15663 - DNA, 897 bp, Artificial Sequence
  Description of Artificial Sequence: Synthetic coding sequence
atgaagtgggtgagcttcatctctttgctgtttctctttagctccgcctatagtgggagcctcgataagaggcatggagaagggacatttacgagcgacgtgagcagctacctggaggagcaagcagcgaaggagttcattgcctggctggtaaagggcggaggaggcgggggcgggtcagggggtgggggtagcgggggcggagggtccgccgagtctaaatacggtcctccctgcccgccctgcccagctcccgaggccgcgggcggaccatctgtcttcctgtttcccccgaagcctaaagacaccctgatgattagcaggacgccggaagtgacttgtgtcgtggttgacgtgtcacaggaagatcctgaagtgcagtttaattggtacgtggatggggttgaagttcacaatgcaaagaccaaaccaagagaagagcaattcaatagcacgtatcgggtggttagcgtgctgaccgtgcttcaccaggactggttgaacgggaaggagtataagtgcaaggtgagtaataaagggttgccgagtagtattgagaagaccatttctaaggccaagggccagcccagagaaccccaggtgtatacccttccccctagccaagaggaaatgaccaaaaaccaggtcagcttgacttgcctggtgaaaggattctatccttccgatattgccgtcgaatgggaaagcaacgggcagccagagaacaactataagactacaccacccgtactcgactccgacggctccttctttctttattccagactgacagtggacaaatcccgatggcaagaaggaaacgttttctcatgcagcgtcatgcacgaagcgctgcataaccattacactcagaagtcattgtctctgtccctcgga

SEQ ID NO: 15664 - DNA, 897 bp, Artificial Sequence
  Description of Artificial Sequence: Synthetic coding sequence
atgaaatgggtctcattcattagcttgctgtttttgttctcaagcgcctactctggatcactggacaagagacacggagagggtacctttacaagcgatgtgagtagttacttggaggagcaggctgcaaaagagttcatcgcttggttggttaaaggtggcggtggaggcggcggctccggtggcggcggatcaggaggaggcggatcagccgagtcaaagtatggacctccgtgccctccctgcccagctcccgaagctgcaggaggaccctccgtatttctcttcccacctaagcctaaagacaccttgatgattagccgcacccctgaagtcacatgcgtggtggtggacgtgtcacaggaagaccctgaggtccaattcaattggtatgtagatggtgttgaggtccataacgcgaagacaaagcctcgcgaggaacagttcaattcaacatatagggtggtgagcgtcctgacagtgctccatcaagactggcttaacggcaaggagtacaaatgtaaagtgtctaacaaaggcctgcctagctcaatcgaaaagactatttctaaagccaaaggccagccacgcgaaccacaggtgtacaccctgccacccagccaggaagaaatgaccaagaaccaggtatccctgacgtgcctggtcaagggcttttatcctagcgacattgccgtggaatgggagtccaacggccagcccgaaaacaactacaagactactcctccggtcctcgattctgatggttcttttttcctgtacagtagactgaccgtggacaagtctcgctggcaggaaggcaatgtttttagctgttctgtaatgcatgaagctcttcataaccattatacccaaaagtctctctcattgagcctgggc

SEQ ID NO: 15665 - DNA, 897 bp, Artificial Sequence
  Description of Artificial Sequence: Synthetic coding sequence
atgaagtgggtgagtttcatctctttactctttctatttagcagtgcctactcgggaagtctggacaaaagacacggcgagggcactttcacaagcgacgttagctcctacctcgaagagcaggccgcaaaagagtttattgcgtggttggtgaagggaggagggggggggggaggcagcggcggcggagggtccggtggtggcggttccgcagagtctaagtatggtcctccatgtcccccctgtcctgctccagaggctgctggggggcctagcgtcttcctatttccaccaaaacctaaggatacgctgatgatctccaggactccagaagtgacatgcgttgtcgtcgatgtatcccaggaggaccccgaagtccaatttaactggtatgtggacggagtggaagttcacaacgctaaaacaaaacctagagaggagcagttcaatagcacatatcgggtggtgtcggtgctgacagtcctgcatcaggactggctaaatgggaaggaatataaatgcaaagtgtccaacaagggactgccaagttcgatcgagaaaacaattagcaaagctaaagggcagcctcgggaacctcaggtttacactctaccacccagtcaggaggagatgaccaaaaaccaggtgtccttgacgtgtttggttaaggggttctacccgagtgacatcgccgttgagtgggagagcaacggacaaccagagaacaattacaagacaaccccgccggtgctcgactcggacgggtcattcttcctctattctcggttaactgttgacaagagccgctggcaggagggcaacgtgttttcatgctctgtcatgcatgaagccctgcataaccactatacgcagaagagcctgagtctgtcactcggg

SEQ ID NO: 15666 - DNA, 897 bp, Artificial Sequence
  Description of Artificial Sequence: Synthetic coding sequence
atgaaatgggtgtcgttcatctcactgctgtttttgttcagttcggcgtacagcggctccctggacaagcggcacggtgaaggcaccttcacgtcggacgtgtcctcgtacctcgaggagcaggcagctaaggagtttatcgcgtggctggtgaaaggaggagggggaggtggaggcagcggcggaggcggttctggaggtggcggatcggccgaatcgaaatacggaccgccatgcccaccttgccccgccccggaggccgccggtggcccgtccgtgtttctgttcccacctaaaccaaaggacaccctcatgatcagccggaccccggaagtgacttgcgtggtggtcgatgtatcgcaggaggacccggaggtccagttcaactggtacgtggacggtgtggaagtgcataacgctaagactaaaccacgcgaagaacagtttaactcaacttacagggtggtgtcggtgctcaccgtcctccatcaagattggctcaacggtaaagagtacaaatgtaaagtctcgaataaaggactgccgtcctcaatcgaaaagaccatctcgaaggcgaaaggtcagccacgcgagccgcaagtctacaccctgcctccgtcccaagaagaaatgaccaaaaaccaggtgtctctgacctgcctcgtgaaaggattttacccgtccgatattgcggtggagtgggaatcgaatgggcaacccgaaaacaattacaagaccactccgccggtgctcgactccgacggatcgttctttctctacagccggctgactgtcgataagagcagatggcaggaaggaaacgtgttctcctgttcagtgatgcacgaggctctccacaaccactacacccagaagtccctgagcctcagcttgggg

SEQ ID NO: 15667 - DNA, 897 bp, Artificial Sequence
  Description of Artificial Sequence: Synthetic coding sequence
atgaaatgggtgagctttatctcactcttgttcctgttctcctcagcgtacagcggctccctcgacaaacggcacggagaaggtacgtttacctcagatgtttcgagctacttggaggagcaggctgccaaggagtttatcgcgtggctcgtgaagggcgggggtggaggcggaggatcaggtgggggaggctcaggtggtggaggatcggccgaatcgaagtacgggccgccatgccctccttgccctgccccagaggcggcaggaggaccatcagtgtttctgttcccgccgaagcctaaggacactctgatgatcagccgcactccggaggtgacctgcgtcgtggtggacgtctctcaagaggatccagaagtgcagtttaactggtacgtggacggagtggaggtccataatgctaagaccaagccgcgcgaggaacagtttaactccacttaccgggtggtgagcgtgcttaccgtgcttcatcaggactggctcaatggtaaagagtataagtgtaaggtgtccaataaagggctcccgtcgtcgatcgaaaagactatctcaaaggcgaagggacagccccgcgaaccacaggtgtacactctcccaccgtcacaggaagaaatgactaagaatcaggtgtcgctcacgtgtctggtcaaaggattttacccgagcgatattgctgtggaatgggaaagtaacggacaacctgagaataactacaaaaccacccctccggtgttggactcagatggatcctttttcctctactcaagactgaccgtcgataagagccggtggcaggaggggaatgtattctcgtgctcggtgatgcacgaagctctgcacaaccattatactcagaagtcgctgtctctgtcactcgga

SEQ ID NO: 15668 - DNA, 897 bp, Artificial Sequence
  Description of Artificial Sequence: Synthetic coding sequence
atgaaatgggttagcttcatttcactgctctttttattttccagtgcatactccggcagtctagacaaacgccacggagaaggaactttcaccagcgacgtcagttcctacctcgaagaacaggccgccaaggaattcatcgcatggctggtaaagggcggcggtggcggtggggggtcagggggaggtggatctggaggagggggctctgctgaaagcaaatatggaccaccttgtcccccttgtccagcgcccgaagctgctgggggccctagcgtcttcctcttccccccaaagccgaaagatactctgatgatctcccgaacccctgaagtgacttgcgtcgtggtggacgtaagccaggaggatcctgaagtgcagttcaactggtatgtggacggggtggaggtccacaatgccaagacaaagcccagggaggagcaattcaactccacctatcgggtagtctcggtgctgaccgttctgcaccaagactggctgaacgggaaggaatacaagtgcaaggtgtccaacaaaggtctcccctcatccatcgagaaaactattagtaaagcaaagggccagccccgtgagccacaggtatacaccctgccaccctcccaagaagagatgaccaagaaccaggtgtcgctgacttgtctggtgaagggtttctatccctccgacatcgcagtcgaatgggagtcaaatgggcaaccagaaaacaactataaaaccacgccccctgtcctagactccgatggctctttcttcctttattctcggctgactgttgacaaatcaaggtggcaagaagggaacgtgttcagttgcagtgttatgcacgaggctctacataaccactacactcagaaatccttaagcctgagtctcggc

SEQ ID NO: 15669 - DNA, 897 bp, Artificial Sequence
  Description of Artificial Sequence: Synthetic coding sequence
atgaagtgggtttcatttatttcacttttattcctttttagttctgcatattctggatctttagataaaagacatggggaaggtacatttactagtgatgtttctagttatttagaagaacaagctgcaaaagaatttattgcatggcttgttaaaggagggggtggaggagggggatctggaggaggaggtagtggaggaggaggatctgcagagagtaaatatggtccaccttgtccaccttgtccagcacctgaagctgctggtggtccaagtgtatttttatttccaccaaaaccaaaagatacgttaatgatatcaagaactcctgaagttacatgtgttgttgttgatgtatctcaagaagacccagaagttcaattcaattggtatgttgatggtgttgaagttcataatgcaaaaactaagcctcgagaagaacaatttaattctacatatagagttgtttcagttttaacagttttacatcaagattggcttaatggtaaagaatataaatgtaaagtctcaaataaaggacttccatcatcaattgaaaaaactataagtaaagctaaaggtcaacctagagaacctcaagtatacactcttccaccatcgcaagaagaaatgacaaaaaatcaagtttctttaacatgtttggtaaaaggtttctatccatctgatatcgctgttgaatgggaaagtaatggtcaaccagaaaataattataagacgacacctccagttcttgattcagatggttcattttttttgtattctcgtcttactgtagacaaatcaagatggcaagaaggtaatgtattctcgtgttcagttatgcatgaagcattacataaccattatactcagaagagtttatctcttagtttaggt

SEQ ID NO: 15670 - DNA, 897 bp, Artificial Sequence
  Description of Artificial Sequence: Synthetic coding sequence
atgaagtgggtgagctttatctcgctcttgttccttttttcctcagcctattccgggagtcttgataagagacacggggaaggaactttcaccagcgatgtctcctcatacctcgaagaacaggcagcaaaggagtttattgcatggcttgtgaagggtgggggtggaggtggaggatcaggtgggggaggtagcggcgggggaggaagcgcagagtccaaatacgggcctccatgcccaccatgtcccgctcccgaggcagccggaggaccttcagtgttcctgtttcctccaaagccaaaagacactcttatgatctcccgcactcctgaggtgacttgtgtggtggtggatgtctcacaggaggacccggaggtccaattcaattggtacgtcgatggtgtggaggtccacaatgcaaagacgaaacctagagaggaacagtttaactcgacctaccgtgtcgtctccgtcttgaccgtgctgcatcaggattggctgaatgggaaagagtacaagtgtaaggtgtcaaataagggattgccatcatcgattgaaaagaccatatcgaaagcgaaaggacagccacgcgaaccacaagtgtataccctgcccccttcgcaagaagaaatgacgaagaatcaagtgagccttacctgtctggtcaaggggttctacccctcggatattgcggtcgagtgggagtcgaacgggcagccggaaaacaactacaagaccacccctcccgtgctcgactccgacggttcgttcttcctgtactcgcgccttaccgtggacaagtcaaggtggcaggaaggaaacgtgttttcgtgtagcgtgatgcatgaagctcttcataaccattacacgcagaagtcgctctcactgtcgcttggt

SEQ ID NO: 15671 - DNA, 897 bp, Artificial Sequence
  Description of Artificial Sequence: Synthetic coding sequence
atgaaatgggtttcgttcatcagccttctgttccttttttcgagcgcatattccggatcgttggataaacgacatggggaaggtactttcacttcggatgtcagctcctacctggaagagcaggcagcgaaggagtttatcgcctggctcgtgaaaggcggtggcggaggagggggttcaggaggaggtggatccggaggaggaggatcagctgaatcaaaatacggccctccgtgtcccccgtgccctgcacctgaggccgccggaggcccctcagtgttcctgttccctccgaagcccaaggacaccttgatgatttcacgcaccccggaagtgacctgcgtcgtcgtggatgtgtcccaggaggaccctgaggtccagtttaactggtacgtggacggtgtcgaggtgcataatgccaagactaagcctcgggaagagcagttcaactcaacttaccgggtggtgtccgtcctgactgtcctgcatcaagactggctgaacggaaaggaatacaagtgtaaagtcagcaacaagggactgccttcctccatcgaaaagaccatctccaaggccaagggacagccgcgcgaacctcaggtgtacactctgccgccctcgcaagaagaaatgactaagaaccaagtgtccctcacctgcctggtgaaagggttttacccatccgatattgccgtcgagtgggagtcgaatggacagccagaaaacaattacaagaccactcctccggtcctcgattctgatggatcgttctttctctactcgcgtctgaccgtcgacaagtcaaggtggcaagaaggaaatgtgttcagctgcagcgtcatgcatgaggccctccacaaccactacactcagaagtcactgtcgctgtcgctcggt

SEQ ID NO: 15672 - DNA, 897 bp, Artificial Sequence
  Description of Artificial Sequence: Synthetic coding sequence
atgaaatgggtgagtttcatttctctgctgttcttattttcctctgcatactccggttcacttgataagagacatggagaagggaccttcaccagcgatgtgtcaagctatctggaggaacaggcggcgaaggagtttatcgcctggttggtaaagggaggcggcggaggcggtggctctggtggaggcggtagtggagggggcgggtcagcagaatcaaagtatggtcccccttgccctccgtgccccgctcccgaagctgcagggggaccaagcgtgtttctctttccgcctaagcctaaagacacgcttatgatcagccgcacgccagaggtgacctgtgtggtagtcgacgtctcacaggaagatcctgaggttcagttcaactggtatgtggacggtgtggaggtgcataacgccaagacaaaacctagagaagagcagttcaactctacctatcgagtggtgagtgtgctgactgtgttgcaccaggattggctgaatgggaaggagtataagtgcaaagtgtctaacaagggcctgccttcttcaatcgagaaaactatctcgaaggcgaagggccagcctcgggagccacaggtgtacaccttgcctcccagccaagaagagatgacgaaaaatcaggtgtccctcacttgcctcgttaagggcttttaccccagcgatatcgctgtggagtgggaatcaaatggacagcccgagaacaactacaaaaccaccccccctgtcctagactccgacgggtccttcttcctgtattcaagactgactgtcgataagagccggtggcaagagggaaatgtcttctcgtgtagcgttatgcatgaggccctgcataatcactacacccagaagagcctgtccctttctttgggc

SEQ ID NO: 15673 - DNA, 897 bp, Artificial Sequence
  Description of Artificial Sequence: Synthetic coding sequence
atgaaatgggtgtcgtttatctcactgctcttcctcttcagcagcgcatacagcggatccctggataagaggcatggtgaagggacctttacttcggacgtgagcagctatctcgaggaacaagctgcgaaggagtttatagcctggctggtgaaagggggaggcggcggaggaggttctggtggaggtgggtctggtggcggaggatccgccgaaagcaaatacggccccccttgtcctccctgcccagcaccagaggcagcgggaggtccgtccgtgtttcttttcccacctaagcctaaggacaccctgatgattagcagaacgccagaggtgacttgtgtcgtcgtcgatgtgtctcaggaagatcccgaagtccaattcaactggtatgtcgacggtgtggaggtccataacgccaagactaaacctcgagaggaacaattcaacagcacctaccgagttgtgtcggttctgaccgtgcttcaccaagattggctcaatgggaaggaatacaagtgcaaagtttcgaacaagggccttccttcttctattgaaaagacgatctcgaaggccaaaggccagcctcgggagccacaagtgtacaccctgcctccctcgcaagaagaaatgaccaagaatcaggtgtccctgacttgtcttgtgaaaggattttacccttcggatatcgcagtcgaatgggaatcaaacggacagcccgagaataactacaaaacgactcctccagtgttggatagcgatgggtcgtttttcctgtactcgcgcctgactgtggacaagtccagatggcaggaaggaaacgtgtttagctgtagcgtgatgcatgaggcacttcataatcactacactcaaaagtccctctcactctcactcggt

SEQ ID NO: 15674 - DNA, 897 bp, Artificial Sequence
  Description of Artificial Sequence: Synthetic coding sequence
atgaagtgggtctctttcatatcattgttgtttctctttagcagcgcatattccggctccctcgataaaagacatggggaaggcactttcacatcagatgtatcatcctacttagaagaacaagcggcaaaggagttcatagcctggcttgtaaagggaggcggtggaggtggcggcagtgggggtggaggaagtggtggtggggggtcagctgagagtaagtatggccctccttgccctccttgtcctgcacctgaggccgctggtggtccatctgtcttcctcttcccaccaaagcccaaagataccttaatgatttcgaggactcctgaggtcacttgcgtggttgttgatgtttctcaagaagaccctgaggtccagttcaattggtatgtagatggagttgaagtgcataatgccaaaaccaaacctagagaagagcagtttaatagtacatatcgagttgtgtctgtgctgaccgtccttcatcaagattggctcaacgggaaagaatataagtgcaaggtgagtaacaagggacttccgtctagcatagaaaaaacgatttccaaagcgaaaggccaaccacgcgaaccccaagtgtatactttaccaccttcacaagaagaaatgaccaagaaccaggtatcattgacctgccttgttaaaggtttctatccatcagacattgccgttgaatgggagagcaatggccaacctgaaaacaattacaagacgactccacccgttctggattctgatggttctttctttctttacagccgtcttacggtggacaagagtcgttggcaagagggaaatgtcttctcctgctccgtgatgcacgaggcacttcacaaccattatactcaaaaatctctatctctctctttggga

SEQ ID NO: 15675 - DNA, 897 bp, Artificial Sequence
  Description of Artificial Sequence: Synthetic coding sequence
atgaagtgggtttcatttatctcccttctttttctgtttagttctgcctattcagggtcattggataaaagacatggtgaaggcacattcacatcggatgtaagctcatatttagaggaacaggctgccaaagaatttatagcgtggttagtcaaaggtggtggaggaggagggggatctggaggggggggaagcggaggaggggggagcgccgagtcaaagtacggcccaccctgtcccccctgcccggcgccggaagctgccggaggcccttctgttttcttatttcctccaaaacccaaagatacgcttatgatcagccggacgccggaggttacctgtgtagttgttgacgtcagccaagaggacccagaagtccaatttaactggtatgtggacggagtggaagtccacaatgccaagacgaaacctcgcgaagaacaattcaactccacctatagagtggtttccgtgttaacagtgcttcatcaggactggcttaacggcaaagaatataaatgtaaggtgtcaaacaagggactgccgtcatccattgaaaaaaccatttcaaaggccaaaggacagccacgagaaccgcaagtctatacgctgcctccgtcacaggaagagatgacaaagaaccaggtcagcttaacttgtctggtgaaagggttttatccgagtgatatcgctgttgagtgggaaagcaatggacagcccgagaacaactataaaacaaccccgcctgtgcttgattcggatggttcctttttcctctatagcaggttaacagtcgataaaagcagatggcaagaaggaaatgtatttagttgtagcgttatgcacgaggcacttcataatcattatacgcaaaaatcattaagcctgtcattaggt

SEQ ID NO: 15676 - DNA, 897 bp, Artificial Sequence
  Description of Artificial Sequence: Synthetic coding sequence
atgaaatgggtatcgtttatatcgctattatttttattttcgtcggcgtattcgggttcgctagataaacgtcatggtgaaggtacgtttacgtcggatgtttcgtcgtatctagaagaacaagcggcgaaagaatttatagcgtggctagttaaaggtggtggtggtggtggtggttcgggtggtggtggttcgggtggtggtggttcggcggaatcgaaatatggtccgccgtgtccgccgtgtccggcgccggaagcggcgggtggtccgtcggtttttttatttccgccgaaaccgaaagatacgttaatgatatcgcgtacgccggaagttacgtgtgttgtagtagatgtttcgcaagaagatccggaagttcaatttaattggtatgtagatggtgttgaagtacataatgcgaaaacgaaaccgcgtgaagaacaatttaattcgacgtatcgtgtagtttcggtactaacggtattacatcaagattggctaaatggtaaagaatataaatgtaaagtatcgaataaaggtttaccgtcgtcgatagaaaaaacgatatcgaaagcgaaaggtcaaccgcgtgaaccgcaagtttatacgttaccgccgtcgcaagaagaaatgacgaaaaatcaagtttcgttaacgtgtttagtaaaaggtttttatccgtcggatatagcggtagaatgggaatcgaatggtcaaccggaaaataattataaaacgacgccgccggtattagattcggatggttcgttttttttatattcgcgtctaacggtagataaatcgcgttggcaagaaggtaatgtattttcgtgttcggtaatgcatgaagcgttacataatcattatacgcaaaaatcgttatcgctatcgctaggt

SEQ ID NO: 15677 - DNA, 897 bp, Artificial Sequence
  Description of Artificial Sequence: Synthetic coding sequence
atgaagtgggtgtcgtttatctctctgctgtttctgttttcgtctgcatatagcggctcattggataagaggcatggcgaaggtacattcacaagcgacgtgtcctcttacttagaggaacaggctgcgaaagagttcatcgcgtggttagtgaaaggaggtgggggtggggggggatctggtggcggggggtccgggggcggcggctctgcagaatctaagtacgggcctccctgtcccccctgtcccgcccctgaggccgcgggaggaccttccgtgttcctgtttccccccaagcccaaggatacccttatgatttctcgtacccccgaggtaacatgtgtcgtggtggatgtcagtcaggaggatccagaggtccagttcaattggtacgttgacggcgtggaggttcacaatgccaagacgaaaccaagggaggagcagttcaactccacctaccgcgtggtttcagtcctcacagtgctgcaccaggactggctgaatgggaaagaatacaagtgcaaggtctctaacaaaggtctgccatccagtatagagaagacgattagcaaggccaagggtcagccgagggagcctcaggtctatacgctccccccctctcaggaagaaatgactaaaaaccaagtcagtctgacctgccttgtgaaaggcttctatccctccgacattgcggtagaatgggagagcaacggtcagcccgaaaataattataagacaactcccccagtcctcgattctgacggatcattcttcctgtactcacgtctgactgtcgacaagagccgctggcaggagggcaacgttttcagttgctcagtgatgcatgaggcgttgcacaatcattatacccagaagtctcttagcctgagcctcggg

SEQ ID NO: 15678 - DNA, 897 bp, Artificial Sequence
  Description of Artificial Sequence: Synthetic coding sequence
atgaagtgggtgtctttcattagtctcctttttctgttttcatcagcatacagcggctcgctcgataagaggcatggagagggcacttttacttcggatgtcagcagctacctggaagagcaggcagcaaaagaattcatcgcgtggctcgtgaagggtggcgggggaggaggaggaagcggtggtggtggatcgggaggcggggggtcggctgaatctaagtacggtccgccctgtcctccttgcccggccccggaagcggccggcggcccctccgtctttctctttcctcccaaaccaaaggacactcttatgattagccgcacgccagaggtgacttgtgtggtcgttgacgtcagccaggaagatccagaggtgcagtttaactggtacgtggacggtgtcgaggtgcacaacgcaaaaacgaagcctagagaagagcagttcaactcaacgtacagggtggtgagcgtccttactgtgttgcaccaggactggctgaatggaaaggaatacaagtgcaaagtctcaaacaagggccttcctagctcaattgagaaaactatttccaaagcaaagggacaaccccgggaacctcaggtgtacaccctgcccccttcgcaagaagagatgaccaagaaccaagtgtcactcacttgtttggtgaagggattctacccatccgacattgcagtcgaatgggaatcgaatgggcagcctgaaaacaactacaagaccacgccacccgttttggactcagacgggagcttctttctctactcgagactgactgtggataaatcacgctggcaagaggggaacgtcttttcatgtagcgtgatgcacgaggctcttcataaccattacactcaaaagtccctctcgttgagcctggga

SEQ ID NO: 15679 - DNA, 897 bp, Artificial Sequence
  Description of Artificial Sequence: Synthetic coding sequence
atgaaatgggtgagcttcatctctctgctatttctgttctccagcgcttacagcggtagcctcgataaaaggcacggtgaaggcaccttcaccagcgatgtgagcagttacctagaagagcaggcggcaaaggagtttattgcctggctggtcaagggaggtgggggcggtggtggtagcggtggtggtggtagcggtggaggaggaagcgcggaatccaagtatggcccgccatgtccaccatgcccagcaccggaagcagccgggggcccatctgtcttccttttccctccgaagccaaaagacacattgatgatcagcaggactccggaagttacgtgtgtggtcgttgatgtgagccaagaggatcctgaggtgcaattcaattggtacgtcgacggcgttgaggtgcacaacgctaagacgaagccacgcgaggagcagtttaactccacttatcgggttgttagcgtcctgaccgtcttacaccaggactggctgaatgggaaagaatataaatgcaaagtgtccaataaagggctgcccagttctattgaaaagaccatcagcaaagcaaagggtcagccgcgcgagccgcaggtctacacactcccgccaagtcaggaggaaatgaccaaaaaccaagttagcctgacctgtttggtcaaaggcttctacccgagcgacattgcggttgagtgggaatcaaacggccagccggagaataactataaaacaacgcccccggttcttgatagcgacggaagcttcttcctttatagcaggctgaccgttgacaagagccgatggcaagaaggcaacgtgttcagctgttcggtaatgcatgaagccctgcataatcactatacccagaaatcgctgagcctgagcctgggg

SEQ ID NO: 15680 - DNA, 897 bp, Artificial Sequence
  Description of Artificial Sequence: Synthetic coding sequence
atgaagtgggtgagtttcattagtctccttttcctgttctccagcgcctattcagggtccctggataaaaggcacggggaaggaacgtttacttcagacgtctcgtcctatctcgaggaacaggctgccaaagagttcatcgcgtggctggtcaagggcggagggggaggcgggggaagcgggggcggcgggagcgggggtggcggatctgccgaaagtaagtacggacctccgtgcccaccgtgccctgcaccggaggcggcagggggcccttccgtgttcctctttccgcccaaacctaaggacactctgatgatctcccggactccggaagtcacctgtgtcgtcgtcgatgtttcacaggaggacccggaagtgcaattcaactggtacgttgatggagtcgaagtccacaacgctaagacgaagccgcgggaggagcagtttaactcaacttaccgcgtggtgtcagttctgacggtccttcatcaggattggcttaatggaaaagagtacaagtgtaaggtgtccaacaagggactcccatcgagcattgaaaaaaccatctcgaaggccaagggtcaaccaagagagccgcaagtgtacactctgcctccctcccaggaagaaatgaccaaaaatcaggtgtccctgacgtgcctggtcaaaggtttctacccatccgacatcgccgtagaatgggaatcgaacggtcaaccggaaaacaattacaagaccactcccccagtgcttgacagcgacggatcattcttcctgtactcgcgcttgaccgtggacaagtcacgttggcaggagggtaatgtgttttcttgcagcgtgatgcatgaagcgctgcacaaccactacacccagaagtcgctctcgctctcactggga

SEQ ID NO: 15681 - DNA, 897 bp, Artificial Sequence
  Description of Artificial Sequence: Synthetic coding sequence
atgaaatgggtgtccttcatatcactactttttctgttttctagcgcctactcaggatccttggataagcggcacggtgaagggaccttcaccagtgacgttagttcctatctggaggaacaggcagccaaagagtttatagcctggctggtgaagggcggcggcggcgggggaggctctgggggaggagggtctggcggcggcggcagtgcagagagcaaatacggcccaccttgtccaccatgtcccgcccctgaagccgctggcggcccatctgtcttcctgttcccacccaagcctaaggataccctgatgattagccgaacacccgaggtgacttgcgtggtcgtagacgtgtctcaggaggatccagaggtccagttcaactggtatgtcgacggtgttgaagtgcacaacgctaagactaagcctagagaagagcagtttaacagtacctaccgcgtggtgagcgtgttaaccgtactgcaccaagattggctgaacggcaaagaatataagtgcaaagtctctaataagggcttaccctcttccattgagaagactatatccaaggcaaaggggcaaccacgagagccacaggtgtatacactgccaccatcacaggaggagatgaccaaaaaccaggtcagtttaacatgtctggttaaaggcttctacccttcagatatagccgtggaatgggaatccaatgggcagccagagaacaattataagacaacccccccagtcctggactcagatgggagtttctttctgtacagcaggctgaccgtggacaaatcccgatggcaagagggtaacgtattttcctgcagtgttatgcacgaggccctccacaaccactacactcagaagtccctgtccctcagtctcgga

SEQ ID NO: 15682 - DNA, 897 bp, Artificial Sequence
  Description of Artificial Sequence: Synthetic coding sequence
atgaaatgggttagctttatctcccttctctttcttttttctagtgcgtatagtggatcactcgacaagagacatggtgaagggacttttactagcgacgtgagcagctatctggaggagcaggccgcaaaagagttcattgcctggttagtgaagggcgggggtggcgggggaggttcagggggcggcggatcaggaggcggcggttctgcagagtccaaatacggccctccctgtccaccctgccctgcgcctgaggcggctggtgggccgagcgtatttctgtttccccccaagcccaaggatactttgatgattagccgtacgcctgaagttacttgtgtggtggtggatgtttcccaggaggaccccgaggtgcagttcaactggtatgtcgatggcgtagaggtccataacgccaagaccaagccaagggaggagcagtttaattcgacgtatagggtggtatccgtgttaaccgtcctgcaccaggattggctcaatggaaaggagtataagtgcaaagtctcaaacaaaggactccccagcagcatcgagaagactatcagcaaagccaaagggcaacctcgcgaaccacaagtttacaccctgcctccatcccaggaggagatgactaagaaccaggtaagcctgacgtgcctggtgaaggggttttacccctccgacatcgcggtggagtgggagtcaaacggtcagcccgagaataactataagaccacgcctccagtacttgactccgatggctccttttttctgtatagtcgcctcacggtggataagagtaggtggcaggaggggaacgtcttttcctgtagcgtgatgcacgaagctcttcacaaccactacacgcagaagagtttatcgttaagtctcgga

SEQ ID NO: 15683 - DNA, 897 bp, Artificial Sequence
  Description of Artificial Sequence: Synthetic coding sequence
atgaaatgggtcagtttcatttcactgctgttcctgttcagttcagcatactccggaagcctggacaagcggcatggagaagggaccttcaccagcgatgtttcaagctatctggaggaacaagctgctaaggagtttattgcatggcttgtcaagggaggaggcggagggggtggctctggcggaggaggatctggtggagggggctcagctgagtccaagtacggaccaccctgcccgccatgcccggcccctgaagcggctggagggccatctgtgttcttgttccctcccaagcctaaagacactttgatgattagtcgtactcccgaagtaacgtgtgtcgtggtggacgtgtctcaggaagacccagaagtgcagtttaactggtacgtagacggtgttgaggtccacaacgcaaaaactaagccccgtgaagaacaatttaactcaacatatcgggtggtctctgtgctcactgtcctgcaccaagattggttgaatggaaaagagtataaatgcaaagtgtcaaacaaagggttgccatcctctatcgagaagacaatttccaaagcaaagggccagccaagagaacctcaggtctacacgttgccacctagccaggaagagatgacgaagaatcaggtcagcctgacctgtctggttaaagggttttatccatctgatattgctgtagagtgggagagcaacggacaacctgagaacaactataagacaacaccacctgtgctggatagtgacgggtcgttttttttgtactccaggctcacggtcgataagagccgatggcaggagggcaacgtgttcagttgctcagtgatgcatgaggcactgcataatcactacactcaaaagtctctcagtctatcccttgga

SEQ ID NO: 15684 - DNA, 897 bp, Artificial Sequence
  Description of Artificial Sequence: Synthetic coding sequence
atgaagtgggtcagcttcatcagcctgctatttctgttctccagcgcttacagcggaagtctggacaagcggcacggtgaggggacctttacctcagacgtatcctcctacctggaggagcaggcagccaaggaattcatagcatggctcgtgaaaggcggcgggggcggaggcggatccggaggtggaggctctgggggggggggctctgcagagtctaagtacgggcctccctgtcctccttgcccagcccctgaggccgcgggcggccctagcgtgttcctgttcccccccaagccaaaggacacactgatgatttcaaggacccctgaagtgacatgtgttgtagtggacgtgagccaggaagatccagaagtgcaatttaactggtatgtagatggagttgaagtgcacaatgcgaagaccaaacctcgggaggagcaattcaatagcacttaccgggtggtgtcggtcctcacggtgctgcaccaagactggctgaatggaaaggagtataaatgcaaggtctctaataagggattaccctcatctattgaaaaaacaatttccaaggccaaaggccagcccagggaaccccaggtgtatactctgcctccttcgcaggaggagatgaccaaaaatcaggtctctttgacctgcctagtgaagggattctacccttccgatatcgcagtggagtgggaatcaaatggccagcccgaaaacaattacaaaacgacaccccccgtgctggatagcgacggcagtttcttcctgtactcaagattaaccgttgataaaagtaggtggcaggagggaaatgtcttcagttgtagtgtgatgcatgaggcactccataaccactacacgcaaaagtcccttagtctctctcttgga

SEQ ID NO: 15685 - DNA, 897 bp, Artificial Sequence
  Description of Artificial Sequence: Synthetic coding sequence
atgaaatgggtgagcttcatctcccttctgtttctgtttagctcggcgtactcgggctccctcgacaagcgtcatggcgagggcacttttacttcagacgtgtcatcctatctcgaggagcaggcagcaaaggagttcatagcatggctggtcaaaggtgggggcggaggcggaggatcgggaggagggggttcgggtggaggcggttcggctgagtcgaagtacgggcccccttgcccaccttgccctgcccccgaagccgcaggaggtccatccgtgtttctgttcccgcctaaaccaaaagataccctgatgatttccagaacccctgaagtgacctgcgtggtcgtcgatgtgtcgcaagaagatccagaagtccagtttaactggtatgtcgatggagttgaggtgcataacgcgaaaacgaaaccaagggaagaacaattcaatagcacttatcgagttgtgagcgtgcttactgtgctccatcaagactggcttaacggcaaggagtacaaatgcaaggtgagcaacaagggactccccagcagcattgaaaagaccatctctaaagccaaggggcagcccagagaacctcaagtctacaccctcccgccgtcgcaagaggaaatgaccaagaatcaggtgtcgcttacctgcctggtcaaggggttttacccatcagatattgcagtggaatgggagagcaatggccaacccgaaaacaattacaagactactcctccagtccttgacagcgacggtagcttctttttgtacagccgactgacggtggataagtcccggtggcaggaagggaatgtgttttcgtgttcggtgatgcatgaggccctgcacaaccactacactcagaaatcactttcactcagcctgggg

SEQ ID NO: 15686 - DNA, 897 bp, Artificial Sequence
  Description of Artificial Sequence: Synthetic coding sequence
atgaagtgggtgtctttcatcagcctgctcttcctcttctcgtcggcgtactccggctccctggataagcgccacggagaaggaacgttcacttctgacgtgtcgtcgtaccttgaggagcaggctgccaaggaattcatcgcctggttggtgaaaggaggaggcggcggaggggggagcggcggaggaggctcgggtgggggaggtagcgccgagtcaaagtacggaccgccatgccctccatgcccggccccagaggcagctggagggccaagcgtttttctgtttccgccgaagcctaaagatactctcatgatctctcggaccccggaagtgacttgcgtggtcgtggacgtctctcaggaggaccccgaagtgcagttcaactggtacgtggatggcgtcgaggtgcacaatgcaaagactaagccgcgggaagagcaattcaattcaacctaccgcgttgtctcggtcctgactgtcctccaccaggactggctgaacgggaaggagtacaagtgcaaggtgtcgaacaaaggactcccgtcatccattgagaaaactatatcgaaagccaagggtcagccgcgtgaaccgcaagtctacaccctgccaccttcccaagaggaaatgaccaagaaccaggtgagcctgacctgtctggtgaaaggtttctatccatcggacatcgccgtcgaatgggagtcgaatggtcagccggagaacaactacaaaaccactccaccagtcttggactcggatggttcgttcttcctctactcaaggctgaccgtcgacaaatccagatggcaggagggtaatgtgttctcatgctcggtgatgcacgaagcgctgcataaccattatacccagaagtcgttgtccctgtccctcggc

SEQ ID NO: 15687 - DNA, 897 bp, Artificial Sequence
  Description of Artificial Sequence: Synthetic coding sequence
atgaaatgggtatctttcattagtctgctttttttgttttctagcgcatatagtgggagcctggacaaacgtcacggcgaggggacctttacctctgacgtttcctcgtacttggaggagcaggccgcgaaagagtttattgcgtggctggtgaaaggggggggtggcggcggaggatctggcggtgggggctcaggagggggcggctccgcggaaagcaagtatggcccaccgtgccccccttgtcccgcccctgaggccgcaggcggccccagtgtgtttctgtttcctccgaaaccgaaagacacactgatgatcagcagaaccccagaagtgacctgtgttgtggtggacgtgagtcaggaggatccagaggtgcagttcaactggtatgtcgacggcgtagaagtccacaatgccaagacgaaaccacgggaggagcaattcaactctacgtaccgcgtggtctcggttctcactgtactgcatcaggactggctcaacgggaaggaatataaatgcaaggtgagcaacaagggtctgcccagctctatcgaaaaaacgatcagtaaggccaaaggtcagccccgcgaaccacaagtgtatacactcccccccagtcaagaggaaatgaccaagaaccaggtgagcctgacgtgcctcgtgaaaggcttttatccaagtgatattgctgtggagtgggagagcaatgggcagccagagaacaactacaaaacaacccctcccgtgttggacagcgacgggtctttcttcttatacagcaggctcacagttgacaaatccaggtggcaggagggaaatgtgttttcctgtagcgtcatgcacgaagccctgcataaccattatacgcagaaatccttgagcttgagtttaggg

SEQ ID NO: 15688 - DNA, 897 bp, Artificial Sequence
  Description of Artificial Sequence: Synthetic coding sequence
atgaaatgggtgtcgttcatttcgctgctctttctcttttcttccgcttactccggcagcctggacaaacggcacggcgagggcacttttacctcagacgtgagctcatacctcgaggagcaagcggccaaagagtttattgcatggttggtgaagggtgggggtgggggtggcgggagcggcggcggggggagtggaggcgggggcagtgccgagagtaaatacggtccaccctgcccaccttgcccagcccctgaggctgctgggggaccaagcgtttttctctttccgcctaaacccaaagatacactgatgatttcccgcactcctgaagtgacctgcgtggtggtggatgtcagtcaggaagaccctgaggtccagttcaactggtatgttgacggtgttgaagtgcacaacgccaagactaaacctagggaggagcagttcaatagtacatatagagttgtaagcgtcctgacggtcctccaccaggactggttgaacggaaaagagtataagtgtaaggtctccaataaagggctccctagctccatagagaaaactatcagcaaggcaaaaggacagccccgtgagcctcaggtttacaccctgccacctagccaggaagaaatgaccaagaaccaggtctcattgacgtgcctcgtcaagggtttttatccttccgatattgctgtggaatgggaaagcaacggacaacctgaaaataactacaaaacaactccaccggttcttgatagcgatgggtcattcttcctgtatagccgacttacagtagataaaagtaggtggcaagagggcaatgttttttcatgcagcgtgatgcacgaagcattgcacaatcattatacgcagaaatcactgtcactctccttgggc

SEQ ID NO: 15689 - DNA, 897 bp, Artificial Sequence
  Description of Artificial Sequence: Synthetic coding sequence
atgaaatgggtttctttcatttccttactgttcttgttcagctctgcctactctggtagcctggataagagacacggggaggggacatttacctcagacgttagctcttatctggaggaacaggcggccaaggagttcattgcctggttggtaaaaggcggtgggggaggggggggctccggcggtggtggaagcggcggcgggggctcagccgagagcaagtatggacccccgtgtccgccctgcccagcgccagaggccgctggagggccgtctgtctttctgtttccaccaaagcctaaggacacccttatgatctcgcgtacaccggaggtcacctgtgtggtagtggatgtcagccaggaagatcctgaggtccagtttaactggtatgtggacggcgtggaggtgcataacgctaagactaaaccgcgagaggaacagttcaattctacgtatcgggtggtgtctgttctgacagtgttgcaccaggactggcttaacgggaaagagtataagtgcaaggtgtcgaataagggtcttccaagcagcatcgagaagaccatcagtaaggccaagggtcagccccgggagcctcaggtttacacgttgccgcccagccaggaggagatgactaagaaccaggtctctttaacctgcctggttaaggggttctatccgtcagatatcgcagtggagtgggagtctaacggccagcccgaaaataattataaaacaacccccccagtgctcgattcggacggcagcttcttcctgtattcccgtctgactgtggataagtcgcggtggcaggagggaaatgtgttctcttgttctgtgatgcacgaggctctgcacaatcattacacacagaagtctctatcactgagcctggga

SEQ ID NO: 15690 - DNA, 897 bp, Artificial Sequence
  Description of Artificial Sequence: Synthetic coding sequence
atgaaatgggttagctttatatcactgctgttcctattctcaagcgcctactccggatccctggataagcgacatggcgagggaaccttcacctcagatgtgtcttcctacctggaggagcaggctgcaaaggagtttattgcctggcttgtgaagggaggcggcgggggggggggttctggcggaggtgggtccggaggcggcggtagtgccgaatccaagtatggccccccctgcccaccctgtcctgcacccgaagcagctggcggaccctctgtgtttttgttcccacccaagcctaaagataccctgatgatttcccgaacccccgaggtgacttgcgtggtcgtagatgtatctcaggaggatccggaggtgcagtttaattggtacgtagatggggtagaggtccacaacgctaagacaaagccgcgagaagagcagttcaattctacttatagagtggtgtcagtcctgaccgtgctacaccaggattggctgaacggaaaggaatacaagtgtaaagtgagcaataaagggcttcccagcagcattgagaaaacaattagcaaagctaagggccaacctagggaacctcaggtatacaccctgccccctagccaggaggagatgactaaaaaccaggtctctttaacatgcctggtcaagggcttctatccctctgacatagctgtcgagtgggagtccaacgggcaacccgagaataactataagaccaccccacccgtgttggacagcgatgggagcttctttttatacagccgcttgacagtcgacaaatctagatggcaagagggaaatgtcttctcatgtagcgtcatgcacgaggcattgcacaaccactacactcagaaaagcttatctctgtcactgggt

SEQ ID NO: 15691 - DNA, 897 bp, Artificial Sequence
  Description of Artificial Sequence: Synthetic coding sequence
atgaagtgggtgtccttcatatcactgctcttcctgttcagcagtgcttatagcggcagtctggacaagcgacacggagagggaacttttacttccgatgtgagctcatatttggaggaacaggccgctaaggaattcatcgcctggttggtgaaaggcggggggggaggtggcggctctgggggagggggtagcggaggaggaggatctgcagaatcaaagtacggaccaccgtgtcctccttgtcccgctccagaggccgcaggcggaccatctgttttcttgttcccgcctaaacccaaagacacactcatgatctcgcgcacgcccgaagtcacatgtgtggtcgtggacgtctcccaagaggatccagaagttcagttcaactggtatgtagatggggttgaggtccataatgctaaaacaaaaccaagagaagagcaattcaatagtacctaccgcgtggtgtctgttctgactgtacttcaccaggactggctcaatggcaaggagtacaagtgcaaggtgtcgaacaaagggctcccttcttcgatcgagaagactattagtaaggctaagggtcaaccgagggaaccacaagtgtatactctgccaccttcccaggaggagatgactaaaaaccaggtgagcctgacctgcctggtgaaaggcttctatcccagcgacatcgctgtcgagtgggagtccaatgggcagcctgagaataattataagaccacaccgccggttttggatagcgatggctcttttttcctttacagtcgtctgacggttgataagagtcgatggcaggaagggaacgttttctcatgctccgtcatgcacgaggcgctgcacaaccactacacccagaagtcacttagcttgagcctcggg

SEQ ID NO: 15692 - DNA, 897 bp, Artificial Sequence
  Description of Artificial Sequence: Synthetic coding sequence
atgaagtgggttagctttatctccctgctctttctgttttccagcgcttatagcgggagtctggacaaaagacatggcgagggcacatttacaagcgacgtttctagttacctggaagaacaggctgcgaaggagtttattgcatggttggtgaagggaggagggggcggaggaggaagtggaggcggcggatccggtggcggtggaagcgcagagtcgaaatatggcccaccttgtcctccctgccctgctccggaggccgcaggtggcccctcagtttttctgtttcccccgaaaccgaaggacacactcatgatttcacggaccccagaagttacttgtgtggtcgttgatgtcagtcaggaagaccctgaggtacagtttaattggtatgtcgacggagtggaagttcataacgctaaaaccaagcccagagaagagcagttcaacagtacttacagggtggtgagcgtcctgactgttctccatcaggattggcttaatggcaaggagtacaaatgcaaggtgagtaataagggcctgcctagctctatcgagaagactatctcaaaggcaaaaggtcagccacgagaacctcaggtgtacacactgccacccagtcaggaagagatgaccaaaaatcaagtgagccttacctgccttgtcaaggggttctatccaagcgatatcgctgtcgagtgggagagcaatgggcaacctgaaaacaattacaagactactccccccgttttggattccgatggttccttctttctgtactcccggctgaccgtcgacaagtcaaggtggcaggagggcaatgtgttctcttgcagtgtgatgcacgaggctctgcacaaccattatactcagaaatcacttagcttgagcctagga

SEQ ID NO: 15693 - DNA, 897 bp, Artificial Sequence
  Description of Artificial Sequence: Synthetic coding sequence
atgaagtgggtcagcttcatctccttgcttttcttgttcagcagcgcatattccgggtccctggacaagaggcacggtgagggaactttcacttcggatgtgtcttcatatctggaggaacaggctgcgaaggagttcatagcgtggctcgtaaaggggggcggcggcgggggcggaagcggaggaggtggctcaggggggggagggtcggccgagtctaagtacgggcctccctgccccccgtgccctgccccggaagcagctggggggccatctgtgttcctcttcccgcccaagcctaaggacactcttatgattagtcgaacaccagaggtcacttgtgtcgtggtcgacgtcagccaggaagaccccgaggttcagtttaattggtacgtggatggcgtggaagttcacaacgcaaaaacaaagcccagagaggaacaattcaatagcacgtatcgcgtcgttagcgttcttacagtgctgcaccaggactggctgaacggcaaggagtacaaatgcaaggtgtccaataaggggttgccgtccagtattgaaaagactatttcaaaagccaaagggcagccaagggaacctcaggtttataccctgcctccttcacaggaggagatgacaaaaaaccaggtaagcctgacctgccttgtgaaagggttctatcccagtgatattgccgtagagtgggagagtaacggtcagcccgagaacaactacaagacaactccacccgtgctggatagcgacggctcattcttcctttattcgcgcctgaccgtggataagagtaggtggcaggagggaaacgtcttcagttgctctgtgatgcacgaggcgctgcacaaccattacacccagaagtccctgagcctgtcattggga

SEQ ID NO: 15694 - DNA, 897 bp, Artificial Sequence
  Description of Artificial Sequence: Synthetic coding sequence
atgaagtgggtcagtttcattagcctgctcttcctcttcagcagcgcgtacagcggctccctggacaagcgccacggagagggaaccttcaccagcgacgtgagctcatacctggaggagcaggcagcaaaggaatttatcgcatggctggtcaagggaggaggaggaggtggaggatcggggggcggggggtcaggaggtggcggatccgcagagagcaagtacggcccgccgtgcccgccgtgtccggcacctgaggccgccggtggaccgtcggtcttcctctttccaccgaagcctaaagacaccctgatgatcagcagaactcctgaagtcacgtgtgtggtcgttgatgtgtcccaagaagacccggaggtgcagtttaattggtatgtggacggagtcgaggtgcacaacgccaagaccaaaccgcgcgaagagcagttcaattccacttacagagtggtcagcgtgctgaccgtgctgcaccaggattggctgaacggaaaggagtacaaatgcaaggtcagcaataaggggctgccgtcctcgatcgaaaaaactatttcaaaggcgaagggacaaccccgggaaccacaggtgtacactctgccaccctcccaggaagaaatgactaagaaccaagtctcacttacttgcctggttaaggggttttacccttctgacatcgcggtggagtgggaaagcaacggtcagccggaaaacaactacaagaccactcccccagtgctggacagcgatggttccttcttcctgtactctaggctgacggtggacaagtcgcggtggcaggagggcaacgtgtttagctgctccgtgatgcatgaagcactgcataaccattacacccagaagtcgctgtcgctgagcctcggt

SEQ ID NO: 15695 - DNA, 897 bp, Artificial Sequence
  Description of Artificial Sequence: Synthetic coding sequence
atgaagtgggtatctttcatttccttgctgttcctgttctcctccgcatacagcggaagtctggacaagaggcatggcgagggcacattcactagtgacgtttcctcctatttggaagagcaggccgcaaaagaattcatcgcttggctggtaaagggagggggaggtggcggaggctcaggcggcgggggcagcggcggcggcggctcagctgaaagtaagtacggccctccttgtccaccttgtcctgctccagaagctgccggaggcccatctgtgtttttattccctcccaagcccaaggatacacttatgatttccaggactcctgaggtcacctgtgtagtcgtggatgtatcacaagaggaccctgaagtccagttcaattggtatgtcgatggtgttgaagtccacaatgccaagaccaagccgcgggaggagcaatttaattccacttatcgtgtcgtgtcggttctcacagtattacaccaagactggcttaacggcaaggagtataaatgtaaggtgtcaaacaagggcctcccatcctccatcgagaaaaccatatcaaaggctaaaggccaaccgagggagccacaggtgtacaccttgccaccatctcaggaggaaatgaccaagaatcaggtctctctgacctgcctggtgaaggggttctatccaagcgacatcgccgtggagtgggagtctaatggccagcccgagaataattataaaacaacgccccccgtccttgacagcgatggaagcttttttctgtactcccggctgaccgtggataagagtagatggcaagagggaaacgtgttttcgtgttctgtgatgcacgaggctttgcataatcattacactcagaaaagcttatcgctcagcttaggc

SEQ ID NO: 15696 - DNA, 897 bp, Artificial Sequence
  Description of Artificial Sequence: Synthetic coding sequence
atgaagtgggttagttttattagcctgttgttcttattcagttccgcgtactccggatccctggataaaaggcatggcgaaggaacctttacaagcgacgtcagcagctatctcgaagagcaggcagccaaggagttcatagcctggctcgtaaagggcggagggggaggggggggcagtggcggaggggggagtggtggtgggggcagtgccgagtctaagtacggccccccctgcccaccttgccccgctcccgaagccgccgggggaccctccgtttttctctttccacccaaacctaaggatactctcatgattagcagaacacctgaggttacctgcgtggttgtcgatgtctcccaggaggatcccgaggtgcagttcaattggtacgttgatggggtggaagtgcacaatgccaagaccaaaccacgggaagagcagttcaattctacttatagagttgtgagtgtactgacagtgcttcaccaagattggctaaacggcaaagaatacaagtgcaaagtctccaacaaaggactaccttcaagcattgagaagactatctcaaaagcgaaagggcagccacgagagccccaagtgtatacactgcccccctcacaggaagaaatgaccaagaaccaggtctccttgacttgcctagttaagggattctaccctagcgatattgctgtggaatgggagtcaaacggacagccggaaaataactataagaccactcccccagtgctggattccgacgggtcgttctttctgtacagcaggcttactgtggataagtctcggtggcaggaagggaatgttttctcatgttctgtaatgcatgaggcgctacataaccactacacccaaaaatccctatccttgtcacttggg

SEQ ID NO: 15697 - DNA, 897 bp, Artificial Sequence
  Description of Artificial Sequence: Synthetic coding sequence
atgaagtgggtgtctttcattagccttctctttctcttttcgtctgcatattccggatcattggataagagacatggggaaggaactttcacctcggatgtgagttcctaccttgaggaacaagcagcaaaggagtttattgcatggcttgtcaaaggtggaggaggaggcggtggttctggcggtggcggttcaggcgggggaggttcggcggaatccaaatacggcccgccctgcccaccatgccctgctccagaagccgccggaggtccttccgtgttcctctttcctccaaaacctaaggacaccctcatgatcagccggacccccgaagtgacctgtgtggtggtcgatgtctcccaagaagatcctgaggttcagtttaactggtacgtggatggagtggaagtccataacgccaagactaagccccgagaagagcaattcaattccacttaccgggtggtgtccgtccttactgtgttgcaccaagactggcttaacggaaaggagtataagtgtaaagttagtaataagggtctgccatcatcgatagaaaagaccatttcaaaagcgaaaggtcaacctagagagccgcaagtgtacacgctgcctccgagccaggaagagatgaccaagaaccaggtgtctctgacttgtctcgtaaaggggttttacccatccgatatcgcagtggaatgggaatcgaacggacagcccgagaacaactacaagaccacgcctccagtcctggactcggacggatcattctttctgtactcacgcctcactgtcgataagtcgcgttggcaggagggaaatgttttttcgtgtagcgtgatgcatgaagcacttcacaatcattacacccagaagtctctgtcgctgagtcttggc

SEQ ID NO: 15698 - DNA, 897 bp, Artificial Sequence
  Description of Artificial Sequence: Synthetic coding sequence
atgaagtgggtgtcattcatttctctgctattcctgtttagtagtgcctatagtggttcattggacaagcgacatggagaaggcacttttacatctgatgtgtcttcctatctcgaagagcaggctgccaaggagttcattgcatggctcgtgaaggggggcgggggcggagggggttctggtggaggcgggtctgggggtggaggatctgcagaaagtaaatatggacccccttgtccaccctgccccgcgccagaggccgctgggggtccatccgtgtttctgttccctccaaagcctaaggatactctgatgatctcgcggacgcccgaggtgacctgcgtggttgtcgacgtctctcaggaggaccccgaggtacagttcaattggtatgtggacggagtggaggttcataacgcaaagaccaaacccagagaagagcagttcaattcgacttatcgcgtggtttcagtgctcactgtgttacaccaggattggctaaatggaaaagagtataagtgcaaagtctcgaacaaaggtctgcctagtagcatcgagaaaacaatatcgaaggccaaaggccagcccagagaaccacaggtgtataccctcccgcctagtcaggaagagatgacaaagaaccaggtgtccctgacttgtctggtaaaggggttttaccccagcgatattgccgtggaatgggaatccaacggtcagcccgagaacaattacaaaaccacacccccagtattggactcggacggtagttttttcctatattcccggcttacagtagacaagagccggtggcaggagggcaacgttttctcatgcagtgtcatgcatgaagctctgcataatcattatacccagaagtccctgtccctaagtctagga

SEQ ID NO: 15699 - DNA, 897 bp, Artificial Sequence
  Description of Artificial Sequence: Synthetic coding sequence
atgaagtgggtgtcgttcatcagccttctttttctgtttagctcggcctactcaggatccctcgataaacgtcacggtgaagggacttttacttcggacgtgtcgagctatcttgaagagcaagcagcaaaagagtttatcgcatggctggtgaaaggaggtggcggtggtggcggttccggaggaggaggatcaggagggggaggatctgccgagtcgaagtacggaccaccatgtcccccctgccccgctcccgaggccgcaggcgggcctagcgtgtttctttttccccctaagcctaaagacaccctcatgatttccagaacccctgaagtaacttgcgtcgtggtggacgtctcccaagaggatccggaagtccaattcaactggtacgtggatggtgtggaagtccataatgcaaagactaagcctcgagaagagcagtttaacagcacttaccgggtagtcagcgtgctgaccgtgctgcatcaggattggctcaacggaaaggagtacaaatgtaaggtcagcaataaaggattgccaagcagcatagagaaaacgatttccaaggccaagggtcagccccgcgaaccccaggtgtacaccctcccaccatctcaagaggaaatgaccaagaatcaggtgtcactgacctgtctggttaagggattctacccctcggatattgcggtggaatgggagagcaatggacaacccgaaaacaactacaaaactacgcctccagtcttggattccgacggatccttctttctgtactccaggctgacggtggacaaatccaggtggcaagaaggaaacgtgttctcatgttctgtgatgcacgaggcactccataatcactacacccagaaaagcctttccctgtcactcggt

SEQ ID NO: 15700 - DNA, 897 bp, Artificial Sequence
  Description of Artificial Sequence: Synthetic coding sequence
atgaagtgggtaagcttcatttctctgctgttcctgttctcgtctgcctacagtgggagtctggacaaacggcatggcgaaggcacatttacgtcagatgtttcatcatatctggaagagcaggccgcaaaggagttcatcgcctggctggttaaaggcggaggtggcggaggtggctctggaggagggggcagtggtggcggcggaagcgccgagtccaagtatggcccaccatgccccccatgtccagcacccgaggccgcaggcgggccctctgttttcctctttcccccaaaaccaaaagacacactaatgatctccaggaccccagaggtcacctgcgtagttgtcgacgtgtcacaagaagaccccgaagtgcagttcaactggtacgtggatggcgtagaagtgcacaacgctaaaactaaaccccgagaggagcaattcaatagtacctacagggttgtatccgtgttgacagtgctgcaccaagattggctgaacggaaaggagtataagtgtaaagttagcaacaaggggttgccatctagcattgagaaaacaattagcaaggccaagggccagccccgagagccccaggtatatacacttcccccttctcaggaggaaatgaccaaaaatcaggtttcattaacgtgcctggtaaaggggttctacccgagcgacattgccgtagagtgggagagcaacggacaacccgaaaataactataaaacaacgcctcctgtcttagattcagacggatccttttttttgtactctaggctgaccgtcgacaagagtaggtggcaggagggaaatgtgttcagttgttccgttatgcacgaggcactacataaccactacacacagaaaagcttatctctgtccctcggc

SEQ ID NO: 15701 - DNA, 897 bp, Artificial Sequence
  Description of Artificial Sequence: Synthetic coding sequence
atgaagtgggtctcctttatttctctgttgtttctgttcagtagtgcgtattccggatctctggacaaaagacatggtgagggcacctttacatcagatgtgagcagctacctcgaagagcaagccgctaaagagtttatcgcctggctcgtgaaaggggggggcggcggcggaggttccgggggaggcggctcgggagggggagggtcggccgagtcaaaatatggtcccccatgccccccatgcccggctcctgaagccgctggagggccctcagtgttcctttttcccccaaagccaaaggacacacttatgatcagtcgtacccctgaagtgacgtgcgttgtggtggacgtctcccaagaggatccagaggtacagtttaactggtacgtggacggggtggaagttcacaatgccaagactaaaccaagagaggaacagtttaacagcacgtaccgcgttgtgtccgtgctgacagtgctccaccaagattggctgaacggaaaagagtacaagtgtaaggtgagtaataaagggttgccttcttcaatcgagaagactatatccaaggccaagggccaaccaagggaaccacaagtttacacattgccccccagccaggaagagatgacaaagaatcaagtctccctgacctgccttgtaaagggattctatccatccgacattgccgtggagtgggagagcaatggtcagcccgagaataactataagactactcccccagtgttggatagtgatgggtctttcttcctgtacagtcgcctgaccgtggataagtcgagatggcaggaaggcaatgttttctcttgctctgttatgcacgaagcattgcacaatcattatacacagaagtcactgtccctgtccctgggc

SEQ ID NO: 15702 - DNA, 897 bp, Artificial Sequence
  Description of Artificial Sequence: Synthetic coding sequence
atgaagtgggtgtccttcatcagcctgctgttcctgttctcatcggcttactcaggctcgctcgacaaacggcacggggaaggcacctttaccagtgacgtgtcgtcgtacctcgaagaacaagccgcaaaggagttcattgcctggcttgttaagggtggcggaggaggaggcggtagcggaggcggcggaagcggaggcggaggttcagcagaatcaaaatacggaccgccatgccccccatgcccggctccagaggcagcgggaggaccctccgtgttcctgttcccaccgaagccgaaggacactctcatgatctcacggacgcctgaagtgacctgtgtggtcgtggacgtttcccaggaggatccggaagtgcagttcaattggtacgtggacggagtggaggttcacaatgccaagaccaaaccacgcgaagaacaattcaattccacttaccgggttgtgtccgtgctgaccgtgctgcaccaagattggttgaacgggaaggagtacaagtgcaaggtttcgaataaaggcctgccgtcgtcgatcgaaaagactatatccaaagcgaaagggcaaccgagggagccccaggtgtacacgttgcccccgtcgcaggaagagatgaccaagaaccaggtgtccctgacttgcctcgtcaaaggattctatccatctgatatcgcagtggagtgggagtccaacggtcagccggagaataactacaagaccactccaccggtgctggattccgacggatcctttttcctttactcaagactcactgtggacaagagccggtggcaggagggtaacgttttttcgtgctcagtgatgcatgaagccctgcataaccactacacccagaagtccctgtcactttctctggga

SEQ ID NO: 15703 - DNA, 897 bp, Artificial Sequence
  Description of Artificial Sequence: Synthetic coding sequence
atgaagtgggtgagtttcatctccctgctttttctcttttcatccgcctacagtgggtctcttgataagagacatggcgagggaacttttacctcagacgtctcctcgtacttagaggagcaggccgccaaagaattcattgcttggctggttaagggcggcggcgggggcggggggagtggaggcggagggtctgggggagggggctccgctgaatcaaagtatggacctccgtgccctccttgtcctgcaccagaggccgccgggggtccttcagttttccttttcccacctaaaccaaaagacaccctcatgatctcgcgaaccccagaagtgacgtgtgtggttgtcgacgtatcccaggaagatcccgaagtgcagttcaactggtatgttgatggcgtggaagtgcacaatgcaaaaacaaaaccacgggaggagcaattcaactctacctatcgggtcgtctccgtgctcaccgtgcttcaccaggactggctcaatggaaaggaatacaagtgcaaggtgtcgaacaagggcctgccgagtagcatagagaaaacaatatcgaaggctaagggccaaccaagggaaccccaggtctatacactgcctccttcccaggaggagatgacaaaaaaccaggtaagcttgacatgcctagtgaagggcttttacccatcagacatcgcggtagaatgggaatcgaatgggcagccagagaataattataaaaccactcctccagtgctggactccgacggatccttctttctatattccaggcttactgttgacaagagccgatggcaagagggcaatgtattctcgtgcagtgtaatgcatgaggccctccataatcactacacacagaaaagtttatccctgtctctcggg

SEQ ID NO: 15704 - DNA, 897 bp, Artificial Sequence
  Description of Artificial Sequence: Synthetic coding sequence
atgaagtgggtatcgttcatctctctcctcttcctcttctcgagcgcatactccggatcgctggacaagcggcatggagaagggacctttacttcggatgtgtcgtcatatctggaagaacaggctgcaaaggagtttatcgcctggcttgttaagggagggggtggtgggggtggcagcgggggcggcggatccggtggcggaggttccgcagagtccaagtacggacctccatgtccaccgtgtccagcaccagaggcagcgggaggtccatccgtgtttcttttccctcctaagcccaaggatactcttatgatctcccgaactcctgaagtcacctgtgtggtcgtggatgtctcacaggaagatcccgaggtgcaattcaactggtacgtggatggagtggaagtgcataatgctaagactaagccacgcgaagaacagtttaactcgacttatcgggtcgtgtctgtgctgactgtgcttcaccaggactggctgaatggaaaggaatacaaatgtaaggtttcaaataagggcctgccttcgtcgattgaaaagactattagcaaggcaaagggacaaccacgcgagcctcaagtctacacgctccctccctcccaggaagaaatgacgaaaaatcaagtgtcgctgacttgtctcgtgaagggattttacccaagcgatattgcagtcgaatgggaatcaaacggacagccagaaaacaattacaagaccaccccacctgtgttggatagcgatggctcctttttcctctactcccgtctgaccgtggacaagtctcgatggcaggaagggaacgtcttttcgtgcagcgtcatgcacgaggcacttcataaccattacacccagaagtcgctgtcgctgtcccttggt

SEQ ID NO: 15705 - DNA, 897 bp, Artificial Sequence
  Description of Artificial Sequence: Synthetic coding sequence
atgaagtgggtgtcatttatttctctgctctttctattttcttcggcctactccgggagcctggacaagcgtcatggggagggtacgtttacctccgacgtgtcatcctatctcgaggagcaggctgctaaagagtttatagcatggttagtaaaggggggtggcggtggggggggttctggaggaggaggcagcgggggtgggggctctgccgaaagtaagtatggccccccctgccccccttgcccagccccggaggccgccggcggtccatcagtatttttgttcccccctaagccaaaggacactctgatgatctcccgtacccccgaggtcacatgtgtggtcgtagatgtgtcgcaggaggatccggaggtgcagttcaattggtatgtcgacggcgtggaagtacataacgcgaagacgaagcctagggaagagcagtttaactctacatacagggtcgtgagcgtgttgactgtcctgcatcaagattggcttaacggcaaggaatacaagtgtaaggtatcaaataagggcctgccttctagcatagagaaaacgataagtaaagcaaagggtcaaccgagggagccccaggtgtatacactgccgccaagtcaagaagaaatgaccaagaatcaagtttcactgacctgtctggtgaagggcttttacccctccgacatcgcagtggaatgggaatccaacggtcagcctgaaaacaactataaaactacccccccagttttggacagcgacggatccttctttctctatagccgactaaccgtggataagtcccggtggcaggaaggcaacgtattttcatgctcagtgatgcatgaagcactgcacaatcactacactcagaagtcgctgagcttatctttggga

SEQ ID NO: 15706 - DNA, 897 bp, Artificial Sequence
  Description of Artificial Sequence: Synthetic coding sequence
atgaaatgggtctcctttatttcactactgtttctgttctcttctgcatactcaggctccctggacaagcgccatggagaaggtacttttacctccgatgtctcttcatacttagaggagcaggccgcgaaagagtttatcgcgtggctagtcaagggaggtggtggggggggcggttcgggagggggcggatcagggggtggtggttcagccgagtccaaatatggaccaccatgcccaccttgtccagcgcccgaggccgcaggtggaccttccgtgttcctgtttccacccaagccaaaggatactttaatgatcagcagaactcctgaagttacatgcgtggtagtggatgtttcccaggaagacccagaagtgcaattcaattggtacgtcgacggcgtggaggtccataatgctaaaactaaaccacgagaggagcagtttaactctacctaccgtgtggttagtgtgctcacagttctgcaccaggactggttgaatggcaaggagtataaatgcaaggttagcaataagggactgccttcgagtatcgagaaaactataagcaaagctaaagggcagccacgggaaccacaggtgtataccctgcctccatctcaggaggagatgactaagaatcaggtcagcctcacctgtctggttaagggattctacccatccgacattgcagtcgagtgggaatctaatggacaacctgagaataattacaagacaacgccgcctgttctcgattcagacgggtctttcttcttgtactcaagattgactgttgataagagtaggtggcaggaggggaatgtcttcagttgctcagtcatgcatgaagcactgcacaaccactacacacagaaaagcctttccctttctttgggg

SEQ ID NO: 15707 - DNA, 897 bp, Artificial Sequence
  Description of Artificial Sequence: Synthetic coding sequence
atgaaatgggtgagcttcatatcgctcctgtttctgtttagctcggcatactcagggtcacttgacaaacggcatggagagggtacttttacttcggatgtctcatcgtaccttgaagaacaagcagccaaagagtttattgcatggctggtgaaaggtggaggcggaggaggcggaagcggaggtggcggcagcggtggcggagggtcagcggaatccaagtacggaccaccatgtcctccatgtcctgcgccggaagcagcgggtggaccatccgtgtttctttttcctccaaagccgaaagatacccttatgattagcagaaccccggaagtgacttgtgtcgtcgtcgatgtgtcacaagaggacccagaagtacaattcaactggtacgtggacggagtagaggtccacaacgccaaaactaagcccagagaagaacagttcaattcgacctaccgggtggtgtccgtgctcaccgtgctccatcaagattggcttaatggaaaggagtacaagtgcaaggtttcgaataaggggctgccctccagcatcgaaaagaccatctccaaggcaaagggccagccccgtgaaccacaagtgtataccttgcctccttcgcaggaagagatgactaagaaccaagtgtcgttgacgtgtttggtgaagggattctacccttccgacattgccgtcgaatgggaaagcaacggtcagcctgaaaacaactacaaaaccactcctccggtgctggattctgatgggtcgtttttcctttactcgcgcctcaccgtcgataagtctcgttggcaagagggtaacgtgttcagttgcagcgtaatgcacgaggcattgcataatcattacacgcagaagagcctctcactctcactgggc

SEQ ID NO: 15708 - DNA, 897 bp, Artificial Sequence
  Description of Artificial Sequence: Synthetic coding sequence
atgaagtgggtgtctttcatatccctcctgttcttgttctcctcagcttactctggttcccttgacaagcgtcatggcgagggcacctttactagcgacgtttcatcatacttggaagaacaagcagctaaggagtttatagcatggctggtgaaaggtggaggcggcggaggtggaagcggtggaggcggatcaggcggtggaggttcagctgagtctaagtatggcccaccttgccccccctgccccgcacccgaggccgccggaggccctagcgtgttcctctttccaccaaagccaaaagatacactcatgatatcacgcactcccgaggttacctgtgtggtagtagacgtatcccaagaggaccccgaagtacagtttaactggtatgtcgatggcgtagaggtgcacaacgcaaaaaccaagccaagggaagaacagtttaattccacttaccgcgtcgtgtctgtgcttaccgtcctgcatcaggactggctgaacggtaaggaatataagtgcaaagtaagcaacaaaggactgcctagctcaatagagaagaccattagtaaggcaaaaggtcagcctagggaaccacaagtctacaccttgcctcccagccaagaggagatgaccaagaatcaagtaagcctcacctgtttggtcaagggattttacccttctgacatagccgtggaatgggagagtaatggacagccagagaataactacaagactacccctcccgtgctggacagcgacggctcatttttcctttacagtcgcctcactgtggacaagagcaggtggcaagagggcaacgtgttctcttgcagcgtgatgcacgaggctctccacaaccactatacacaaaagagtctgagtctcagcctggga

SEQ ID NO: 15709 - DNA, 897 bp, Artificial Sequence
  Description of Artificial Sequence: Synthetic coding sequence
atgaaatgggtgtcatttatctccctgctgtttctgtttagcagtgcatatagtggctccctggataagcgacacggtgagggcacttttacaagcgacgtgtccagttacctcgaggagcaggctgcgaaagagttcatcgcctggcttgtcaaaggaggaggtgggggaggggggagtggaggggggggatctggcggcggaggttccgctgagtctaagtacggccctccttgccctccatgccccgccccagaagccgcggggggaccttctgtgtttctttttccgccaaagccaaaagacaccctcatgataagccgcacacctgaggtcacctgcgtcgtggtggacgtgtcacaggaagatcctgaggttcaatttaattggtatgtcgacggggtggaggtacacaacgcaaagaccaaaccccgagaagagcagttcaattccacctatagggtggtttccgtcttaacagtgctgcaccaggactggcttaacgggaaggagtataaatgcaaggtgagcaataaaggcctgccatcctccattgaaaaaacgatcagcaaagccaaaggtcagccccgcgaaccccaggtgtacaccctgccaccatcccaggaagaaatgacgaaaaaccaggtgtccctaacatgtttagttaaagggttttatcccagcgacattgcagtggagtgggaatcaaacgggcagccggaaaataattataaaacaacacctccggtactggattccgacgggagtttcttcctatattctcggctgaccgtggataagagccggtggcaggaggggaacgtcttttcgtgctcagtgatgcatgaggccctgcacaatcattatacccagaaaagtctctctctttcactgggc

SEQ ID NO: 15710 - DNA, 897 bp, Artificial Sequence
  Description of Artificial Sequence: Synthetic coding sequence
atgaagtgggtcagttttatctcgctcctgttcctgttcagctcggcctactcgggtagccttgataaacggcatggagaagggaccttcaccagcgacgtctccagctacttggaagaacaggcggcgaaggagttcatcgcatggctggttaaaggaggaggcggcgggggtggatccggaggaggtggttcaggaggtgggggctccgccgaatcgaagtacggaccgccatgcccaccctgtccggccccggaagcggcgggaggtccatcggtgttcctgttcccccctaagccgaaggatacgcttatgatctcgagaacccctgaagtgacctgcgtggtggtcgatgtgtcgcaagaggaccccgaggtacagttcaattggtacgtggatggcgtggaagtccacaatgccaagaccaaaccccgggaagaacagttcaattcaacttaccgcgtggtgagcgtcctcaccgtgcttcatcaggactggctgaacggaaaagagtacaaatgcaaggtgtccaacaagggactcccttcaagcatcgaaaagactatctcgaaggctaaaggacaaccaagagaacctcaggtctacaccctgccgccatcccaggaggagatgactaagaaccaagtctcgctcacctgtctcgtgaaggggttctacccgtcagacatcgcggtcgagtgggagagcaacgggcagcccgaaaacaattacaagaccactcccccggtcctcgattctgacggatccttcttcctgtactcacggctcaccgtggacaagtcgcgctggcaggagggaaacgtgttctcatgcagcgtcatgcatgaagccctgcataatcattacactcagaagtccctgagcctgtcccttgga

SEQ ID NO: 15711 - DNA, 897 bp, Artificial Sequence
  Description of Artificial Sequence: Synthetic coding sequence
atgaagtgggtatcgtttatctccctcctgtttctcttttcgagcgcatactcaggatcacttgataaaagacacggagagggaaccttcacctcagacgtgagctcttacctggaggagcaggcggccaaggaattcattgcatggctggtaaaaggaggagggggtggaggaggtagcgggggtggcggctccggaggaggcggatccgctgaatctaaatacgggccgccgtgcccaccttgtccagcacccgaagcagcggggggacccagtgtttttctctttccacccaagcccaaggatactctgatgatatcaaggacccctgaagtgacgtgtgtggtcgtcgacgtgtcacaggaggatcctgaggtgcagttcaattggtacgtggacggcgtggaggtgcataacgccaagacgaagcctagagaggaacagttcaattccacttatcgagtggtgtcagtgctgactgtcctgcatcaggattggcttaacggtaaggaatacaagtgcaaagtgagcaacaaggggcttccctccagcattgaaaagaccatctccaaggccaagggccaacctcgggagccacaagtgtatacgttgccaccgtcgcaagaagaaatgaccaaaaaccaggtgtctctcacttgtcttgtcaaaggtttctacccttcggatattgccgtagagtgggaatcaaacggacaacctgagaacaattacaaaaccacccctccggtgcttgattccgacgggtccttcttcctctactcgcggttgactgtcgataaatcgcggtggcaagaaggaaacgtgttttcctgttcggtgatgcatgaagctctgcacaatcattacactcaaaagtcactgtcccttagcctgggt

SEQ ID NO: 15712 - DNA, 897 bp, Artificial Sequence
  Description of Artificial Sequence: Synthetic coding sequence
atgaaatgggtgtcgttcatctccctcctgttcctgtttagttccgcgtactcaggatcgctggacaaaagacacggcgaaggcaccttcacttccgatgtgagctcctacctcgaggaacaggccgcgaaggagtttattgcatggctggtgaagggtgggggtgggggaggtggcagcgggggcggcggttcaggaggaggaggatcagcagagtccaagtacggcccaccgtgcccgccttgcccagcacccgaagccgcggggggtccatccgttttcctgtttccgcctaagcccaaggatactttgatgatctcaagaaccccggaagtgacctgtgtggtcgtggatgtgagccaggaagatcccgaggtccaattcaactggtatgtcgacggagtggaagtccataacgcgaaaactaagccgagggaagagcagttcaactcaacctatcgcgttgtctcggtcttgacggtgctgcatcaagattggctgaacggcaaggaatacaaatgcaaggtgtccaataaggggctgccctcgtcaattgaaaagaccatcagcaaagccaaaggccagccgcgtgaaccgcaagtgtacacgcttccgcctagccaggaggaaatgacgaaaaaccaggtttctctgacctgcctggtgaaaggtttctacccatccgacatcgccgtcgagtgggagtcaaacggacaaccggaaaacaattacaaaactactcccccggtgcttgatagcgacggctcgttctttctgtactcgcgactgacggtggacaagtcgcgctggcaagaaggtaacgtgttctcatgttcggtgatgcacgaagccctgcacaatcactacacccagaagtcgctgtcactgtcgcttggg

SEQ ID NO: 15713 - DNA, 897 bp, Artificial Sequence
  Description of Artificial Sequence: Synthetic coding sequence
atgaagtgggtatccttcatttccctgttgtttcttttttcatctgcgtactccggaagcctggacaagcggcatggtgagggaaccttcacgtccgatgtgtcctcttatctggaagagcaggctgctaaggagtttatcgcgtggctagtcaagggtggtggcggcgggggaggttccgggggcgggggaagcggcggcggcggtagtgctgaaagtaagtacggtcccccttgccccccatgtcccgccccagaggcggccggaggtcctagcgtcttcctcttccctccgaaacctaaggatactctgatgatatcccgtacgcccgaagtaacctgcgtagttgtagatgtgagtcaggaagatcctgaggtccagtttaattggtatgttgacggcgtcgaggttcacaatgccaagactaagccacgagaagaacaattcaacagtacctaccgggtcgtttcggtcttgacggtgcttcaccaggattggctaaacggaaaggaatacaaatgcaaggtctctaacaagggactgcccagttcaatcgaaaagaccatctccaaagctaagggacagccccgcgaaccgcaggtctacacgctgccgccctcacaggaagaaatgaccaagaatcaggtgtcactcacgtgcttggtcaagggtttctatccatccgatatcgcggttgaatgggaatcaaatgggcagccagagaacaactacaaaaccactccacccgttctagatagtgatggatctttctttttgtattcgcgcttaaccgtcgataagagccgatggcaggaaggtaacgtcttttcctgctctgtgatgcatgaagcgctgcataaccattatacccaaaagagcttgagcctttcacttggg

SEQ ID NO: 15714 - DNA, 897 bp, Artificial Sequence
  Description of Artificial Sequence: Synthetic coding sequence
atgaagtgggtgtccttcatttcactgctgttcctgtttagctccgcctactcgggttcactggacaagagacatggggaggggacgtttacgtcggatgtgtccagctacctcgaagaacaggccgcgaaagagtttattgcttggctggtgaagggaggaggcggaggtgggggaagcggtggcggtggctcaggaggaggtggttcggccgaatcgaaatacggacccccttgccctccctgtccagcgccagaagcagccggaggaccatcggtgtttctgtttcctcctaagcctaaagatacccttatgatctcgcggaccccagaagtcacctgtgtggtggtcgatgtctcgcaggaagatcccgaggtccagttcaattggtacgtggacggtgtggaggttcataatgcaaagactaagcctagggaagaacagtttaacagcacctacagagtcgtgtcagtcctgaccgtgctccatcaggactggctcaacggtaaggaatacaagtgcaaggtgtcgaacaagggcctgccaagctccatcgaaaaaactatttccaaagccaaaggtcaacctcgagaaccccaagtctacaccttgccacctagccaggaggagatgactaagaatcaagtctcccttacgtgtcttgtcaagggtttctacccttcagatatcgccgtggaatgggagtcaaatggccaacctgaaaacaattacaagactactccgcctgttctcgattccgacggaagtttcttcctttattccagacttaccgtggacaaaagcaggtggcaagaaggtaacgtttttagctgctcggtgatgcatgaggcacttcataatcactacacccaaaagtcactttcactgtccctggga

SEQ ID NO: 15715 - DNA, 897 bp, Artificial Sequence
  Description of Artificial Sequence: Synthetic coding sequence
atgaaatgggttagttttattagcctgctcttcttgttcagctctgcatacagtggcagcctggacaaaagacacggagaaggcaccttcacctcggacgttagcagctacttagaggaacaggctgcgaaggaattcatcgcctggctggtaaagggaggaggaggcggaggagggtctggcgggggaggctcggggggaggcggatctgcagaatcaaaatatggaccaccttgtccaccttgtccagcacctgaggctgcaggaggacctagtgtatttctgttcccccctaagccaaaggatacactgatgatatctcggacaccagaggtgacgtgcgtggtggtggatgtcagccaggaggatcccgaggttcagtttaattggtacgttgacggagttgaggttcataacgccaagacaaagcctagagaggaacagtttaacagtacatatcgtgtggtgtctgtgttgaccgtcctgcatcaagattggctcaacgggaaggaatacaagtgtaaggtgagtaacaaaggcctgccttcatctattgagaagacaatcagtaaggcaaagggacagcctagggagccccaagtgtacaccttaccaccttctcaggaggagatgaccaagaaccaagtctctctgacatgcctggtgaaaggcttctatccctcagatatcgcagtggaatgggagtccaacggccaacccgagaacaactacaaaaccactccccctgtgttggacagcgatggatctttttttctgtacagtaggctgacggtcgacaaaagcagatggcaggagggaaatgttttttcttgtagcgttatgcacgaggccctccacaaccattacacccaaaagtctctgtccctatctttgggc

SEQ ID NO: 15716 - DNA, 897 bp, Artificial Sequence
  Description of Artificial Sequence: Synthetic coding sequence
atgaagtgggtcagtttcatttccctgctctttctctttagcagcgcctatagcggaagtcttgataaacgccatggcgagggaacctttacttccgacgtctccagttacttagaagagcaagccgccaaagagttcatcgcctggctggtcaaaggaggggggggtggcggcggtagcggcggggggggaagtggaggcggaggaagcgctgaaagtaaatacggtcccccctgccctccctgtcccgcaccagaagcagccggtggaccctcagtctttttgttccctccgaagcctaaagataccctgatgatctctcggacccccgaagttacctgtgtagttgtcgatgtgagccaagaagaccccgaggtccagttcaattggtatgtagacggcgtagaggtgcacaacgccaagaccaaacctagagaggagcagtttaactccacatacagggtggttagtgttctaaccgtcctgcaccaggattggctgaatgggaaggaatacaagtgcaaagtgtctaataagggcctgcctagctctattgagaaaaccatctccaaggcaaaagggcagcccagggaaccgcaagtgtatacactgccgccctctcaggaagagatgactaagaatcaggttagcctgacgtgcctggtcaaaggcttttacccctcagacatcgcagtggagtgggagtctaatggtcagcccgaaaataactataaaacgacaccacctgtgctggacagcgatgggagcttttttctctacagccggttgaccgtggataagtcccgctggcaggagggcaacgtgttttcttgctcagttatgcacgaagccctacacaaccactacacccagaaatcactgtccttgtcactcgga

SEQ ID NO: 15717 - DNA, 897 bp, Artificial Sequence; identical to SEQ ID NO: 15683
  Description of Artificial Sequence: Synthetic coding sequence

SEQ ID NO: 15718 - DNA, 897 bp, Artificial Sequence
  Description of Artificial Sequence: Synthetic coding sequence
atgaagtgggtttccttcattagcctgctgtttcttttcagcagtgcatactccggatctctggataagagacacggggaagggaccttcaccagcgacgtaagcagttatctcgaggagcaggcagccaaagagtttatcgcgtggttggtaaagggcggcgggggcggggggggatccggcggcggcggtagtggaggaggtggctcagctgaaagcaaatacggaccaccgtgccctccttgcccggcgccagaagcggctgggggacccagtgtatttcttttcccccccaaaccgaaggacaccctcatgatctcacgcacccccgaagttacatgcgtcgttgtagacgtttctcaggaggacccagaggtgcagttcaattggtacgtcgacggggtcgaggtccataacgccaaaacgaagccccgggaggagcagtttaatagtacttatcgggtcgtgtccgttctgacagtgctccatcaggattggctgaatggcaaggagtacaagtgtaaggtgagtaataagggcttgcccagtagcatcgaaaaaacgatcagtaaggcgaaaggtcagcccagggaaccccaggtttacacattgccaccatctcaggaggagatgaccaagaaccaggtgagcttgacctgtctcgtgaaagggttttacccaagtgatattgccgttgagtgggagagcaacgggcagcctgaaaataactataagaccaccccaccagttctggactcagatggttcattttttctctactcaaggctgacagtcgacaaatctaggtggcaggagggtaacgtattctcctgcagcgtaatgcatgaggcactgcataaccactacacccagaaatcactctccctgtcactggga

SEQ ID NO: 15719 - DNA, 897 bp, Artificial Sequence
  Description of Artificial Sequence: Synthetic coding sequence
atgaaatgggtctccttcataagcctactctttttgttctcctctgcatactctggaagcctagataaacggcatggggagggtacattcacctccgacgtgtcttcctacctcgaggaacaggccgccaaggaatttatagcgtggctcgtgaaggggggaggcggtggcgggggaagcgggggaggggggtcgggtgggggagggtccgcagagtccaaatatggccctccctgtccgccttgtcccgcacccgaagctgccgggggccccagtgtttttttgtttccacccaaacccaaagacactttaatgatttctcgcacaccagaagtgacttgtgtggttgtggacgtgtctcaggaggacccagaggtccagttcaattggtatgtcgacggcgttgaagtgcataatgctaagaccaagccacgcgaggagcagtttaactcaacctatcgggtcgtgtccgtcttgaccgtgcttcatcaggactggttgaatgggaaggagtacaaatgcaaggtttcgaacaagggtctgccctccagcatagagaaaactatatcgaaagccaaggggcaaccacgcgaaccccaggtctacacccttcctcctagtcaagaggaaatgaccaaaaaccaggtgagtctcacttgtctcgtcaagggtttctacccgtccgatatcgctgtagaatgggagtccaacggacagccggaaaacaactataaaacaaccccacctgtcctggattcagatgggtctttttttctgtactcgcgtttgactgtagataaatccagatggcaagaaggtaacgtgttcagttgcagcgtgatgcatgaggctctgcataaccactatactcaaaaaagtctgagcctgagcctgggc

SEQ ID NO: 15720 - DNA, 897 bp, Artificial Sequence
  Description of Artificial Sequence: Synthetic coding sequence
atgaaatgggtgagcttcatctcactgctgttcctcttctccagcgcttactcaggctcacttgacaagaggcatggcgaaggcacctttacctctgacgtgtcctcgtacctcgaagaacaggcagccaaggaattcatcgcatggctggtgaaaggtggaggtggaggaggaggatcaggcggcggaggaagcggcggaggaggaagcgccgaaagcaagtacggaccgccgtgtcctccatgtcctgcgccggaggcagccggaggaccaagcgtctttttgttcccgcctaagcctaaggacactctgatgatttcccggaccccagaagtgacctgcgtcgtggtggatgtcagccaggaagatcccgaagtgcagttcaactggtatgtcgacggcgtcgaagtgcacaacgctaagactaaacccagagaggagcaattcaactcgacctaccgcgtggtgagcgtgctcaccgtgctgcaccaggactggctgaacggcaaggaatacaagtgcaaagtgtccaacaagggactgccaagcagcatcgagaaaaccatctccaaggccaagggtcagcctcgggagccgcaggtctacacgctccctccgtcgcaagaagaaatgaccaagaaccaagtgtccctgacttgcctcgtgaagggtttctatcctagcgatatcgccgtggagtgggaaagcaatggacaaccggaaaacaactacaagaccactcccccagtcctggatagcgatggatccttctttctgtactcccggctgactgttgacaaatcgcgctggcaggaaggcaacgttttctcgtgctcggtgatgcacgaagccctgcataaccattacacccagaaatcgttgtccctctcactggga

SEQ ID NO: 15721 - DNA, 897 bp, Artificial Sequence
  Description of Artificial Sequence: Synthetic coding sequence
atgaaatgggtcagcttcatctcccttctgttcctgtttagcagcgcatactccggatccctggataagcgccacggagaaggtactttcacgtccgacgtgtcctcttacctcgaggaacaagccgcgaaggagttcatcgcatggctcgtgaagggcggtggcgggggagggggatcgggaggtggaggaagcggaggcggcggctccgccgagtcgaaatacggacctccatgccctccgtgtccggccccagaggccgctggaggaccatccgtgttcctgtttccgccgaagcccaaggacaccctcatgatctcccggactccggaagtcacttgtgtggtcgtcgatgtgagccaggaggacccggaagtccagttcaactggtatgtcgacggcgtggaagtgcataacgctaagactaaaccgcgagaagaacaattcaatagcacctaccgggtggtgtcagtgctcactgttctgcaccaggattggctcaatggaaaagaatacaagtgcaaagtttccaacaaaggcctcccgtcgtccattgaaaagaccatctcaaaggcgaagggtcagccccgtgagccacaagtctacacgctgcccccatcgcaagaggagatgactaagaatcaggtgtcgctcacttgcctcgtgaaagggttctatccgagcgatatcgccgtggagtgggaatctaacggacaaccagaaaacaactacaagaccactccgccagtccttgactcagacggatcctttttcctctactcaaggctgacggtcgataagtcacgctggcaggaaggaaacgtgtttagctgctcggtgatgcacgaagcgctgcataatcactacacccaaaagtccctgtccctgtctctcggg

SEQ ID NO: 15722 - DNA, 897 bp, Artificial Sequence
  Description of Artificial Sequence: Synthetic coding sequence
atgaagtgggtgtctttcattagtctactatttctcttttcttctgcttactcaggttctctggacaaacgccacggcgaggggacctttactagtgacgtctcttcctatctggaggagcaggcagctaaggaatttattgcttggcttgtgaagggtggaggaggaggcggtggatctggaggtgggggatccgggggggggggtagcgctgagagcaagtacggtcccccgtgccctccatgcccagcaccagaagctgctggagggccctcagtctttctctttccgcctaagccaaaagatacactgatgataagccgcaccccggaggtaacgtgcgtggtggtggatgtgtcccaggaggacccagaagtccagttcaattggtacgttgatggggtagaagtccataacgcgaagacaaagcccagagaggagcagttcaatagcacatatcgagtcgtttccgtgttgaccgttctgcaccaggactggctgaacggcaaggagtataaatgtaaagttagtaataaaggcctcccttcgagtatcgaaaagaccatctccaaggccaaaggacagccccgagagccacaggtatacaccctaccccctagccaggaggaaatgactaagaaccaggtttctctgacctgccttgtgaaaggcttttacccttccgacatcgctgtcgagtgggaatccaatggtcagccagagaacaactataagactacaccaccagtgctcgactccgatgggtctttctttctgtattcacgcttgacggttgataaatctagatggcaggaaggcaacgttttctcctgctcagtcatgcacgaggcactccacaaccactatacacaaaaaagtctatcactcagtctcggt

SEQ ID NO: 15723 - DNA, 897 bp, Artificial Sequence
  Description of Artificial Sequence: Synthetic coding sequence
atgaagtgggtgtccttcattagcttgctgtttctgttctcatccgcctactcgggaagcctggacaaaaggcatggcgagggaactttcacctcggatgtctcgtcctacctggaggaacaagccgcgaaagaattcatcgcttggctcgtgaagggcggtggcggaggcggaggttcaggtggtggaggatcgggaggaggaggatccgcggagtccaagtacggcccgccgtgcccgccttgcccggccccagaagcagcagggggaccttccgttttcctgttccctcccaaacccaaggacaccctcatgatctcgaggaccccggaagtgacttgcgtggtcgtcgatgtttcgcaagaggatccggaagtgcagttcaactggtacgttgatggagtggaggtgcacaacgcaaaaactaagccgagagaagagcagttcaatagcacctaccgcgttgttagcgtgctgactgtcctccaccaagattggctgaacggcaaggaatacaagtgtaaggtcagcaacaaggggctcccatcgtcaatcgagaaaactatctcgaaggcgaaggggcagccacgcgagccgcaggtgtacacgctgccaccttctcaggaagagatgactaagaaccaagtgtccctcacctgtctcgtcaaaggcttttatccgtctgacattgcggtggagtgggagtccaacgggcagcctgagaataactataagactactccaccagtgctcgactcggacggatcgttctttttgtactcccgcctcactgtggacaagagccggtggcaggaaggcaacgttttctcctgctccgttatgcacgaggccctgcacaaccattacacccagaaatcgctgtccctttcactgggc

SEQ ID NO: 15724 - DNA, 897 bp, Artificial Sequence
  Description of Artificial Sequence: Synthetic coding sequence
atgaagtgggtttcgttcattagcctgctttttcttttttcatcagcgtactcgggatcccttgataaacgccacggcgaaggcacctttactagcgatgtgtcgagctaccttgaagaacaagccgcaaaggagtttattgcgtggcttgtcaaggggggcggcggaggaggaggtagcggtggtggagggagcgggggaggtggatcagcggaatcgaagtacggaccaccttgtcccccttgtcccgcaccagaagcagcaggagggccttcggtttttctgtttccacctaaacctaaggacacccttatgatatcgcggaccccggaagtgacctgtgtggtcgtcgacgtctcacaagaggacccggaagtgcagttcaactggtacgtcgatggagtggaggtgcataatgccaagaccaagcctcgcgaggagcagttcaactcgacctaccgcgtggtgtccgtgctgaccgtgctgcatcaggactggctgaatggcaaggagtacaagtgtaaggtcagcaacaagggccttcctagctcgatcgaaaaaactatttcgaaggcgaaggggcaacctagggagccacaagtgtatactcttcctccttcacaggaggaaatgaccaaaaaccaggtaagccttacctgcctggtcaagggtttctacccttcagatattgcagtggagtgggaatcgaacgggcaacccgagaataactataagactactcccccggtcctggattccgatgggtcgttttttctgtattcgcggcttaccgtcgataagtcccgttggcaagaaggtaatgtgttttcatgctccgtgatgcatgaggcactgcacaatcattacacccagaagtcactgtccttgtccctcggt

SEQ ID NO: 15725 - DNA, 897 bp, Artificial Sequence
  Description of Artificial Sequence: Synthetic coding sequence
atgaaatgggtgtcatttatctctctgctgttcctgttctcatcggcctactccggatcactcgacaagcggcacggagaaggcacttttacctcggacgtgtcctcgtacctcgaggagcaagctgccaaggagttcatcgcgtggctggtcaagggaggaggagggggcggaggatcgggaggtggtgggtcgggcggaggaggcagtgcggaatccaagtacgggcccccgtgtcccccgtgccctgcaccggaggccgcaggcggaccgtcggtgttcctgttcccacccaaacccaaggataccttgatgatttccaggaccccagaggtcacttgcgtggtggtggacgtgtcgcaggaggaccccgaagtgcaattcaactggtacgtggacggagtggaagttcacaacgccaagactaagcctcgagaggaacaattcaattccacttatcgagtggtgtccgtgctgactgtattgcaccaggattggctgaatggcaaggagtacaaatgcaaggtgtcaaacaaaggcctgccttcatccatcgaaaagacgatctcgaaagccaaaggacagccaagggaaccgcaggtgtacaccctgccaccgagccaagaggagatgaccaaaaatcaagtgagcctgacgtgcctcgtgaaaggtttttacccatcggacatcgcggtggaatgggaatccaatggccagcctgaaaacaactacaagacgactcccccggtgctggactcggacgggagctttttcctgtactcgcggctgaccgtcgataagtctcgctggcaggagggaaacgtgttctcctgtagcgtgatgcacgaagcgctgcataaccattacacccagaaaagcctgtcgttgtcgctggga

SEQ ID NO: 15726 - DNA, 897 bp, Artificial Sequence
  Description of Artificial Sequence: Synthetic coding sequence
atgaaatgggtctcattcatctccctgctcttcctatttagttcagcatattctgggtcccttgataaacggcacggagagggaacattcacatctgatgtgagttcatatctcgaagagcaggccgctaaagaattcatagcatggttggtgaaaggaggaggaggagggggagggtccggaggaggggggagtggagggggggggtcagctgaatcaaaatacggacccccatgtcccccttgtccagctcctgaagctgctggagggccatcagtgtttctgttcccacctaaacctaaagacactttgatgatatccagaactcccgaagtcacatgcgtagtggtcgatgtctctcaggaagatccagaagtccagtttaattggtatgttgacggggtggaggttcataatgctaaaactaaacctagggaagaacagtttaactctacatatagagtggtgtctgtgctcacagtgttacatcaggattggctgaatggaaaagaatacaaatgcaaagtttcaaataaagggttaccctcgtctatagaaaaaactatcagtaaagccaagggacagccacgggaaccccaggtttatactcttcctccctctcaggaagaaatgactaaaaaccaggtgtcactgacttgtctggtaaaaggattctacccttctgatattgctgtggaatgggaatccaatgggcagccagaaaataactataagacaactccccctgtgctggatagtgatgggtctttctttttatactccaggcttactgtcgataaatccagatggcaggaaggaaatgtgttctcttgttctgtaatgcatgaggccctgcacaatcattatacacagaaatctctaagtctttcactcgga

SEQ ID NO: 15727 - DNA, 897 bp, Artificial Sequence
  Description of Artificial Sequence: Synthetic coding sequence
atgaaatgggtgagtttcatttcgttgttgtttctcttctcctcggcgtatagcggctccttggacaagcgtcacggagagggtacctttacatcggatgtctcgtcctacctggaggagcaggccgccaaggagttcattgcctggcttgtcaagggagggggtggaggggggggaagcggaggaggtggtagtggcggtggcggatcggccgagagcaagtatggaccaccttgcccgccgtgtccagctcccgaagcagccggcggtccgtcggtgttcttatttccacccaagccgaaagacaccctcatgatctcgcgtacgcccgaagttacctgcgttgtcgtggacgtgtcccaggaggatccagaggttcagtttaactggtacgtggacggggtcgaggtgcacaacgcgaagaccaagcctcgggaggaacaattcaatagcacgtatcgagtggtttctgtcctgacagtgctgcaccaagattggctaaatggtaaggagtataaatgcaaggtttccaacaaaggcttgcccagctcgattgaaaagacgatttccaaggcgaagggtcagccgcgcgaaccacaagtatacacgctgccgccatcacaggaggagatgaccaagaatcaagtgtccttgacgtgtttagttaagggattttacccgagcgatatcgccgttgagtgggaatccaacggacaaccagaaaataattacaaaactacccccccggtgctagattcggacggctctttcttcttgtattcccgcctgacggtggacaaaagccgctggcaagagggtaacgtctttagctgctccgtcatgcatgaggctctgcacaatcactatacccagaaatccctatccctgtcattgggc

SEQ ID NO: 15728 - DNA, 897 bp, Artificial Sequence
  Description of Artificial Sequence: Synthetic coding sequence
atgaagtgggtgagcttcataagcctcctgtttctcttttctagcgcatattcaggctcactcgataagcgacatggcgaaggaactttcacttcggatgtgtcctcctaccttgaagagcaggcagccaaggagttcattgcctggttggtgaagggaggaggaggaggcggtgggagcggaggagggggctcgggtggtggaggttcggcggaatccaaatacggacctccctgtcccccatgtcctgctcctgaagcagcaggtggtccatccgttttcttgtttcctcctaagccaaaggataccctgatgatctcgcgaactccagaggtgacgtgtgtggtggtcgacgtgtcgcaagaggaccccgaggtgcagtttaactggtacgtcgacggagtggaagtgcataatgccaaaactaagcctagagaggaacagttcaattccacttacagagtcgtttcggtgctgactgtgcttcaccaggactggctgaacggaaaggagtacaagtgtaaggtaagcaataagggccttccttcgtcgatcgaaaagaccattagcaaagcaaagggacagccgcgagagccccaggtctacacgctcccaccaagccaagaggaaatgacgaaaaatcaagtctcccttacctgtctggtgaaggggttttacccatccgatattgcagtggaatgggaatcaaatggccaacctgaaaacaactacaagaccaccccacctgtgctggattcagacggctcgttcttcctgtattctcggctgaccgtggataagtcccggtggcaggaaggaaacgtcttttcgtgcagcgtgatgcacgaggcactccacaatcactacactcaaaaaagccttagcctgtcgctggga

SEQ ID NO: 15729 - DNA, 897 bp, Artificial Sequence
  Description of Artificial Sequence: Synthetic coding sequence
atgaaatgggtgtccttcattagtctcctctttcttttctcatccgcatactccggatccctcgataagcggcacggcgaaggtacctttacttccgacgtgtcctcatacctggaggaacaagcagccaaagaattcatagcctggctcgtgaagggaggagggggagggggcggatcgggaggaggtggtagcggaggcggcggttcagcagagagcaagtacgggcctccctgccctccgtgtcccgcaccagaagctgcaggtggtccttcagtgttccttttcccaccaaagccaaaagatactctcatgatttccagaacccctgaggttacttgtgtcgttgtcgatgtgagccaagaggacccagaagtgcaattcaactggtacgtcgacggagtggaagtgcataatgcaaagaccaaaccaagagaggaacagtttaactccacgtatcgggtcgtaagcgtgcttaccgtccttcaccaagactggcttaacggcaaagagtacaagtgtaaagtgtcgaacaagggccttccgtcctccatcgaaaaaactatctcgaaggcaaaaggacaacctcgcgaaccgcaagtgtataccctgcccccctcgcaagaagaaatgaccaaaaaccaggtttcccttacttgtcttgtcaagggattttaccccagcgatatcgccgtcgaatgggagtcaaatgggcagccagaaaacaattacaaaaccactccacctgtgttggattctgatggatcgttctttctctacagccggctcaccgttgacaagagtcgctggcaggagggaaatgtgttctcgtgctccgtgatgcacgaagccctgcataatcattacacccagaagtccctttcactgtcactggga

SEQ ID NO: 15730 - DNA, 897 bp, Artificial Sequence
  Description of Artificial Sequence: Synthetic coding sequence
atgaagtgggtgtccttcatctcactgctcttccttttttcttccgcctactcagggtcactggacaagcgccatggcgagggcacattcaccagcgatgttagcagttatctcgaggagcaagccgcaaaggagtttattgcgtggctcgtgaaggggggaggaggtggtgggggcagcgggggtggagggtccgggggaggaggatctgccgagtccaagtacggacccccatgtccaccatgtcccgccccggaagcagctggtggcccaagcgtctttctgtttccacccaagcctaaagatactcttatgatatcaagaacacctgaagtcacatgtgtggtcgtggatgtgtctcaggaagatcctgaggttcagttcaactggtatgtggacggcgttgaggttcataacgcaaaaacaaagccacgggaggagcagttcaattctacttaccgcgtcgtaagtgtcctgaccgtgcttcatcaggactggctcaatggtaaagagtacaagtgcaaggtgtctaataagggccttccttctagcatcgagaagaccatctcaaaagccaagggacagccccgtgagcctcaggtctacactctgccacccagtcaggaagagatgactaaaaatcaggtcagcctgacctgccttgttaaagggttttatccctccgacatcgccgtagaatgggaatcaaatggtcagccagagaacaactacaagaccacaccaccagtcttggattccgatgggtccttctttttgtactccagactgacagtggacaaatccagatggcaggaaggcaacgtcttctcttgctctgtgatgcatgaggcgctgcacaaccactacacccagaagtccctttccttgagtcttggc

SEQ ID NO: 15731 - DNA, 897 bp, Artificial Sequence
  Description of Artificial Sequence: Synthetic coding sequence
atgaaatgggtgagttttattagcttgctattcctgttttccagcgcctattcggggtccttggataaacggcatggggagggaacttttacaagtgacgtcagcagttacctcgaggagcaggctgccaaggagtttatcgcctggctagttaaaggcggaggaggagggggagggtcaggaggtggtggatctggcgggggaggatcggcggagagtaaatacggacccccctgtccaccttgcccagcacctgaggcggctgggggacccagcgtgtttctgttccctcccaagccaaaggacacgctcatgattagtcgcacacctgaagtgacttgcgtagtggtagacgttagtcaggaggaccccgaggtacaattcaactggtacgtggacggtgtcgaagtacacaacgcaaagaccaaacctagagaagaacagtttaatagtacgtatcgtgtcgtgagtgtgcttacagtcttgcaccaagattggttgaacggaaaagaatacaagtgcaaagtcagtaataagggtctgccgtctagtattgaaaagactatttccaaagcgaaggggcagccgcgcgaaccccaggtctacaccctgccaccctctcaagaagaaatgacaaaaaaccaggtttcgttgacgtgcctggtcaagggtttttatcctagtgatatagccgtagagtgggaatccaacggacaaccagaaaacaattacaaaactacgccccctgtcctggacagcgacgggagcttctttctgtattcccgactcaccgttgacaaaagtcgctggcaagaaggcaatgttttttcctgctcggtgatgcacgaagcactgcataaccactacactcagaaatccctcagtttaagcctcgga

SEQ ID NO: 15732 - DNA, 897 bp, Artificial Sequence
  Description of Artificial Sequence: Synthetic coding sequence
atgaagtgggtgagctttatctctctgctgtttctgtttagctcagcctactctggctccctggataagagacacggggaaggaacatttacttcggatgtatcctcctatctcgaagagcaggccgccaaggagttcatcgcctggctcgtgaagggcggaggggggggagggggctcaggggggggcggtagtggcggaggaggcagcgccgaatctaaatacggcccaccgtgccccccctgccccgccccagaggccgccggcggtccctctgtgtttttgttcccccctaagcccaaagacactttgatgataagccggacccctgaggtaacttgtgtcgtagtcgatgtgtcccaggaggatccggaagttcaattcaactggtacgtcgacggagtggaagtacacaatgctaaaacaaaaccccgagaagaacagttcaacagtacctatcgcgtggtttccgtactgactgtgctccaccaggactggctcaacggcaaggaatacaaatgcaaggtcagtaataaagggctccctagttccattgagaagactatcagcaaagctaagggccaacctagagaaccgcaggtgtacactcttccacctagccaggaggagatgaccaaaaaccaggtgtcattaacatgtcttgtaaagggcttctatcctagcgacattgcagtagaatgggagagcaatggacagccagagaacaattataagaccacgcccccagtgttggacagtgacggatctttctttctatactcccggctcaccgttgataaatctcggtggcaggagggtaatgtgtttagctgcagcgtgatgcacgaagcgctgcataatcattatacccagaagtcactttcactgtccctcggc

SEQ ID NO: 15733 - DNA, 897 bp, Artificial Sequence
  Description of Artificial Sequence: Synthetic coding sequence
atgaaatgggtctcgttcatctcgttgctctttcttttctcctcggcctactccggatctcttgacaagaggcatggcgagggtaccttcacgagtgatgtctcctcctaccttgaagagcaggcggctaaggagtttattgcctggctcgtcaagggcggcggcggcgggggtggctccggcgggggcggttctggcggcggcggcagcgctgagtccaagtacggcccgccctgtcccccctgtcccgccccggaggctgccggcggaccatccgtcttcttgttccctccaaagcccaaggatactcttatgatatcccgtacgccggaggtcacctgtgtcgtggtggacgtctcccaggaagatcctgaggtccagttcaactggtacgtagacggtgtcgaggtccataacgccaagacgaagccgcgcgaggagcagttcaactccacctaccgggtcgtcagcgttctcacagtcctccaccaggattggctgaatggcaaggagtacaaatgcaaggttagcaacaagggactcccatcgtcaattgagaagaccatctcgaaagcaaaaggacaaccgcgagaaccccaagtttacacgctgcctccttcccaggaggagatgaccaagaaccaagtatccctgacctgcctcgttaagggcttctacccttctgacatcgctgtcgagtgggagagcaacggtcagcctgagaacaattacaagacgaccccccctgtgcttgacagcgacggcagcttctttttgtactctcgtctcacagtcgacaaaagccgctggcaggagggaaatgtttttagctgctctgttatgcacgaagctctgcacaatcattacactcagaaaagcctctcgctcagtctgggc

SEQ ID NO: 15734 - DNA, 897 bp, Artificial Sequence
  Description of Artificial Sequence: Synthetic coding sequence
atgaaatgggtatccttcataagtctacttttcctgttttcttctgcttactcaggttccctggataagcgccacggcgaggggaccttcacctcagatgtgtcttcgtacttagaggaacaagctgctaaagaatttatagcatggctggttaaaggtggcggtgggggtggagggagtggaggaggaggctcgggaggaggaggttctgctgaatcaaaatatggacccccatgcccaccgtgcccagcaccagaagctgcaggaggaccatctgttttcctttttccaccaaagccaaaagatacacttatgatttcacgaacacctgaggtgacgtgcgtcgtggtcgacgtttcgcaggaggacccagaggtgcaattcaactggtacgttgatggagtggaggtccataatgctaaaacaaaaccaagagaagaacagttcaattccacataccgtgttgtttcggttcttacggtccttcatcaagactggcttaacggcaaagaatacaagtgtaaggtttcaaataagggacttccatcatcaattgaaaagactatatcaaaagcgaaaggacagccacgagagccacaggtttatacgttgccaccgagtcaagaggagatgacgaaaaaccaagtttcgttgacatgcttagtaaagggtttctacccgtcggacatcgctgtggaatgggaatctaatgggcaacctgagaataattacaagactaccccgccggttttggatagcgatggatcattttttttgtactcgagactgactgtggataagtcacgttggcaggagggaaatgtcttctcatgttctgttatgcatgaggctcttcacaaccactatacgcagaaatctctctcccttagtctgggt

SEQ ID NO: 15735 - DNA, 897 bp, Artificial Sequence
  Description of Artificial Sequence: Synthetic coding sequence
atgaagtgggtcagctttatctcactcctttttcttttttcctccgcctatagcggatcgttggacaaaagacatggtgaaggcacctttacctccgatgtgagctcgtacctggaagaacaagcagcaaaggagtttattgcttggcttgttaagggcggcgggggtgggggaggaagcggaggtggaggaagcgggggaggaggatcggcagagtctaagtatggccccccttgccctccttgccctgcacctgaagcagccggaggcccgtcagtctttttgtttccgccaaagccaaaagataccctgatgatttcgaggactcccgaagtgacctgcgtggtcgtggacgtgtcgcaagaagatccagaagtgcaattcaactggtacgttgatggcgtggaagtccacaacgccaagaccaagccccgcgaagaacagtttaactccacctacagagtggtgtcagtgctcactgtgctccatcaagactggcttaacggcaaggagtataagtgcaaggtgtcgaataaaggacttccatcctcaatcgaaaaaaccattagcaaggcaaagggacaaccacgggaaccccaggtgtataccctccctccctcccaggaagagatgaccaaaaatcaggtttcccttacttgtttggtgaaaggattctatccctccgacatcgccgtggaatgggagtccaacggtcaaccggagaacaattacaagaccactcctccagtcctggacagcgacggttcgtttttcctttactcgcgactcactgtggataagtcgcgctggcaagagggaaacgtgttctcgtgttccgtgatgcacgaagcactgcataaccattacacccaaaagtcactgagccttagcctcgga

SEQ ID NO: 15736 - DNA, 897 bp, Artificial Sequence
  Description of Artificial Sequence: Synthetic coding sequence
atgaaatgggtgtcctttatctcactgctcttccttttttcctccgcttactcaggaagcctggataaacggcatggagaaggaaccttcaccagtgacgtgtcctcctacctcgaagagcaggccgccaaggagtttatcgcatggttggtgaaggggggtggaggaggcggaggaagcgggggcgggggtagtggcggcggcgggtctgccgaatcgaagtacggtccgccatgcccgccgtgtccagcgcctgaggcggcaggagggcccagcgtctttctgttcccgcctaaacctaaagacactcttatgatctcccggaccccagaagtgacctgcgtcgttgtggatgtctctcaggaagatccggaagtgcagttcaattggtacgtcgatggtgtggaggtgcacaacgctaagactaagcctagagaggaacaattcaattcgacctaccgcgtagtctccgtgttgacggtgctccaccaagactggctcaacggaaaagaatacaagtgtaaggtgtctaacaagggactgccgagctcgattgaaaagaccatcagcaaagcgaagggacagccgagggagccacaggtgtacactctgccaccctcacaagaggagatgactaagaatcaggtgtcgctgacctgcctcgtgaagggcttctacccgtcagacatcgccgtggaatgggaaagtaacggacaacccgaaaacaactacaagactaccccacccgtccttgactcggacgggtcattcttcctgtattcgcgactgactgttgacaagtcacgctggcaagagggaaacgtattcagttgctccgtgatgcacgaagctctccacaatcattacacgcagaagtcgctgagcctgtcgcttggt

SEQ ID NO: 15737 - DNA, 897 bp, Artificial Sequence
  Description of Artificial Sequence: Synthetic coding sequence
atgaaatgggtatcattcatctctctgctgtttttgttctcgtcggcctactccggctcgctggataaacggcatggagaaggaacgttcacttccgacgtgtcgtcctacctggaggaacaggcagcgaaggaattcatcgcttggctcgtgaagggaggaggcgggggaggtggctcaggcggagggggctcgggaggaggaggaagcgctgagagcaaatacgggccgccgtgcccgccatgtcctgccccagaggccgcgggcgggccgtcggtgttcttgtttccgccaaagcctaaggacaccttgatgataagccgaactccggaagtgacctgcgtggtggttgacgtgtcacaggaggaccccgaggtgcagttcaattggtacgtcgacggagtggaggtccacaacgcaaagactaagccgagggaagaacaattcaacagtacttaccgggtggtgtcggtcctgacggtgctgcaccaggactggctcaacggcaaagaatacaagtgcaaggtgtccaataagggactcccatccagcatcgaaaagaccatctcaaaggccaagggacaaccgcgcgagccgcaagtctacactctccctccgagtcaagaggaaatgaccaagaaccaagtgtcgctcacgtgcctggtgaaaggcttttacccttcggacatcgccgtcgaatgggagtccaatgggcaaccagaaaacaactacaagacgactccccctgtgctggacagcgatggctcttttttcctctattcgcgcctgaccgttgacaagtcccgctggcaggaaggcaacgtgttctcctgctctgtgatgcatgaagcccttcataatcactacacccaaaagtccctgtcactttcgctggga

SEQ ID NO: 15738 - DNA, 897 bp, Artificial Sequence
  Description of Artificial Sequence: Synthetic coding sequence
atgaagtgggtcagttttatttccctcctgtttctgttttcctccgcgtacagcgggagcttggataagcggcatggcgagggcactttcactagcgacgtgtcttcctatctggaagagcaggctgccaaagaatttatagcatggctcgtaaaaggcggaggcggcggtggcggatctggcgggggagggagcggcggcggtggcagcgccgaaagtaagtacgggccgccctgtcctccttgcccagcgcccgaggccgccgggggcccgtctgtattcctgttcccgccgaagcccaaagacactcttatgatctcaagaaccccggaggttacatgcgttgtggttgatgtgagccaggaagaccctgaagtgcagtttaactggtacgtggacggcgtggaagttcataatgccaaaacaaaaccccgggaagagcagttcaactccacctacagagtcgtttctgtgcttactgtcctgcatcaggattggcttaacggaaaagaatataaatgcaaggtgagtaacaaagggctcccatcttcaatcgagaagactatatccaaggctaagggtcagccaagggaaccacaggtgtacactctgcccccctcacaggaagaaatgacgaagaaccaggtgtccctgacatgcctggtcaagggcttttaccctagtgacatcgcggtggagtgggagtctaatggccagccagaaaataactataagacaacacccccagttttggattctgacgggtcttttttcctgtactcccgactcactgtggataagtctcggtggcaggaaggaaatgtgttttcatgcagtgtaatgcacgaagcgcttcataaccactatacgcagaaatctctttctctgagtcttggt

SEQ ID NO: 15739 - DNA, 897 bp, Artificial Sequence
  Description of Artificial Sequence: Synthetic coding sequence
atgaaatgggtgtctttcatcagcctgctgttcctgttctcatccgcgtacagcggaagcctcgacaagagacacggcgaaggaaccttcacttcggacgtgtcgagctacctggaggaacaagccgcgaaggagttcatcgcctggctggtcaagggcggaggtggaggcggagggtcggggggtggaggatccggaggaggtggttccgctgaaagtaaatatggcccaccttgcccgccctgcccagccccggaggcggcaggcggcccttccgtgttcttgttcccaccaaagccgaaagacactcttatgatctcccggacgccggaagtcacctgcgtggtggtggacgtgagccaagaggatcctgaggtgcagttcaactggtacgtggatggagtagaagtgcacaacgccaaaactaagccgcgggaggaacagtttaactcgacttacagagtcgtctcggtgctcaccgtcttgcaccaggactggctgaatggaaaggagtacaagtgtaaagtgtcgaataagggactgccatcttccatcgaaaagaccattagcaaagctaagggacaaccgagggagccgcaagtctacactctccctccaagccaggaagaaatgaccaaaaaccaggtgtcgctgacctgtcttgtgaagggattttacccgtcggacatcgcagtggaatgggaatccaatggccagcccgagaacaattacaagaccactcccccggtgcttgatagcgacgggtcgtttttcctctactcacgcctgaccgtcgataagtcgcgctggcaggaggggaacgtcttttcatgctccgttatgcacgaagccctgcataaccattacacgcagaagtcactctcactcagcctgggg

SEQ ID NO: 15740 - DNA, 1740 bp, Artificial Sequence
  Description of Artificial Sequence: Synthetic coding sequence
atgaaatgggtgagcttcatctcccttctgtttctcttcagcagcgcttattctggctctctggacaaaaggcacggcgagggaacctttacatctgacgttagctcctatctggaggaacaggctgctaaagagttcatcgcctggcttgttaaaggcagaggtcatggggaagggacatttacaagcgacgtatccagctacctggaagagcaagccgcaaaagagttcatcgcttggctggtgaaagggcggggccacggcgaaggcacattcacgagcgacgtgagcagctacctcgaagagcaggctgctaaggaattcatcgcctggctcgtgaaaggtagggggcatggagaaggaacattcacctccgatgttagttcgtatctcgaggaacaagcagccaaagaattcatcgcttggctggtcaagggccggggccatggggagggcacattcacctctgatgtatcttcatacctcgaagaacaggccgcaaaggagtttatcgcttggctcgtgaagggaaggggccacggagaaggaacgtttaccagcgacgtgtcatcttatctcgaagagcaggctgcgaaagagttcattgcttggctggtcaagggaaggggacatggagaaggcactttcacctccgatgtgtcctcttatctcgaggaacaggcagcaaaggagttcatcgcttggctggtcaagggaagaggccacggggaaggtacatttaccagcgacgtgtcctcttatctggaagaacaggctgcgaaagaatttattgcatggttagttaagggaaggggccatggagaaggcacttttacctctgacgtctcttcatacctcgaggagcaagcagccaaagagttcattgcttggctcgtgaagggtaggggacatggtgaagggactttcacatccgatgtcagcagctatctggaggaacaggccgcaaaggaatttattgcttggctggttaagggccgtgggggtggcggtggaggtggctctggcgggggtggcagcggaggcggaggaagtgcagagtccaaatatggccccccatgccccccatgtccagctcctgaggcggcaggtggtccatccgtctttttgtttccacccaaacccaaggataccctgatgatctccaggacacctgaggtcacttgcgtggtggtcgacgttagccaggaggatccagaagttcagttcaactggtacgtggatggagtggaggtccataacgctaagaccaaaccccgcgaggaacagttcaactcaacatatagagtggtgagcgtcttgacagttctgcatcaggactggctcaacggcaaggaatacaaatgcaaagtaagcaacaaagggcttcccagctctatagaaaagactatctctaaagcaaaagggcaacctagggagccacaagtctatacgttaccaccttcacaggaggaaatgacaaaaaaccaggtgtcactaacatgccttgtcaaggggttttaccccagtgacattgcggtggagtgggagtctaacgggcaacctgaaaataactacaaaacaacccctccggtgctggacagcgatggcagcttcttcctttactctcggctcactgtggacaaaagtaggtggcaagaaggcaatgtctttagctgctcagtgatgcacgaggctctccataatcactacacccagaaaagcttgtccctgtcgctcgga

SEQ ID NO: 15741 - DNA, 1740 bp, Artificial Sequence
  Description of Artificial Sequence: Synthetic coding sequence
atgaagtgggtgtcattcattagcctgctttttttgttctcaagtgcctacagtgggtctctcgacaaacgtcacggcgaaggaaccttcacctctgacgtgtcttcatatctcgaagaacaagcagccaaagagttcattgcttggttggtcaaggggcgtgggcacggagaaggcacatttacatccgatgtttcatcctacctggaggagcaagcggcaaaagagttcattgcctggttggtcaaaggcaggggccacggggagggaacattcacatccgacgtgtcaagttatttggaggaacaggcagctaaggaattcatcgcttggctagtgaaaggcagaggccatggcgagggcacatttacatccgacgtgagtagctacctggaagaacaagccgcgaaggaattcatcgcctggctggtcaagggcagaggacacggggaaggaacattcacgtccgatgttagttcctacctcgaagagcaggctgccaaagaattcattgcttggttggttaaaggacggggccacggagagggtacattcaccagcgatgtatctagttacctggaagagcaggccgccaaggagtttatagcttggctcgttaaaggcagggggcacggcgagggcactttcacaagcgacgtctcatcttatctagaggaacaagctgctaaggagttcattgcctggctcgtaaaaggacggggacatggcgaaggaacattcactagcgatgtgtcctcttaccttgaagaacaggcagctaaagagtttattgcttggttagttaagggtcggggccacggggaggggacgttcacatcggatgtgtcttcttatttggaagaacaggctgctaaggagttcatcgcgtggctcgttaagggccggggccacggcgagggtaccttcacctccgacgtctcgtcatacctcgaggagcaggcggctaaggaattcattgcctggcttgtcaagggcaggggaggaggaggcggagggggatcgggtggcgggggaagcgggggcggaggcagtgcggaatccaaatatgggccgccctgcccaccatgccctgcgcccgaagcggccggcggcccttctgtcttcctcttcccccccaagccaaaagatacactgatgatcagtaggacgcccgaggtgacgtgtgtggtggtcgacgtgagccaggaggacccagaagtgcagtttaattggtacgtcgatggtgttgaggtccacaacgccaagaccaagccaagggaggagcagtttaacagcacttacagggtcgtgagtgttttaactgtgttgcatcaggactggctcaacggcaaggaatacaagtgcaaagtttccaataaaggcctcccatcaagcatcgaaaagacaatcagcaaggctaaggggcaacctagggagccacaggtatatacactgcctcccagccaggaggagatgacaaagaatcaggtgtccctcacctgcctggtcaagggattttaccccagcgatatcgcggtagagtgggagtctaacggacagccagagaacaactataaaacaacaccccctgtgctggatagcgatggctctttttttctgtattccaggctgacagttgataagtcccgctggcaggaaggaaatgtgttctcctgttccgttatgcacgaagcactccacaatcactatacgcagaaatcactgtcgctgtccctgggt

SEQ ID NO: 15742 - DNA, 1740 bp, Artificial Sequence
  Description of Artificial Sequence: Synthetic coding sequence
atgaagtgggtgagcttcatctcactgctgttcctgttctcctctgcctactccggttcactggataagcgacatggtgagggaactttcacttccgacgtcagtagttacctcgaagaacaggccgcaaaggagttcattgcctggctggtgaagggacggggacatggcgaggggaccttcacctctgatgtctcctcctatctggaggagcaggcggcaaaagaattcatagcatggctcgtgaagggtcgcgggcacggggaaggtactttcaccagcgatgtgtcgtcgtaccttgaggaacaggcagcgaaggagttcatcgcatggcttgtcaagggcagaggtcacggagagggaacgttcaccagcgacgtgagctcgtacctggaggaacaggcggccaaggagtttatagcttggctggtaaagggacgcggccacggggaaggcacttttacctctgacgtctcaagctatcttgaggagcaggccgccaaagaattcattgcgtggctcgtaaaggggagaggtcacggggaaggaaccttcacctccgatgtgtcgagctatctcgaagaacaagccgcgaaggaattcatcgcgtggttggtgaaaggaaggggacacggagaaggaacgtttacctccgacgtctcctcctacctggaagaacaggcagctaaagagttcattgcatggctcgtcaagggccgtggccatggagaaggaactttcacgtcggatgtgagctcctaccttgaagagcaggctgctaaggagtttatcgcttggttggtcaaggggcgcggtcacggcgaaggaacttttacgtccgatgtgagctcatacctggaggagcaagcggctaaagagtttatcgcctggctcgtaaaaggaaggggtcatggagaggggactttcacttcggacgtcagttcgtacctggaagagcaagccgcaaaagagttcatcgcctggttggttaagggccggggaggaggtggtggaggcggatcgggcggtggcggcagcggaggtggagggtcagccgagtcgaagtacgggccgccttgcccgccatgccctgctccggaagcggcgggcggtccgtcagtgttcctttttccgcccaagccgaaagatactctcatgatctcgcggacccctgaagtgacctgcgtcgttgtggatgtttcacaggaggacccggaggtgcaattcaattggtacgtggacggcgtggaagttcataacgccaagaccaagccaagagaagaacagtttaacagcacctaccgcgtggttagcgtgctgactgtcctgcaccaagactggctgaacggcaaggaatacaagtgcaaagtgtccaacaagggattgccatcctcaatcgagaaaaccatctccaaggccaaggggcagccgcgcgaaccccaggtgtacactctgcccccaagccaggaggaaatgaccaaaaatcaagtgtcgcttacttgtctggtcaagggattctacccttcagacatcgcggtcgagtgggaatcgaatggacagccggagaacaactacaaaactactccaccggtgctcgactctgatggatctttctttctgtactcaagactgaccgtggacaaatcgcggtggcaagaagggaatgtgttctcctgttcggtgatgcacgaggctctccacaaccattacacccaaaagtcactgagcctgtcgctcgga

SEQ ID NO: 15743 - DNA, 1740 bp, Artificial Sequence
  Description of Artificial Sequence: Synthetic coding sequence
atgaagtgggtgtccttcatctctctgctgttcctcttctcgtcagcttactcaggttcgctcgataaacggcacggcgaaggcaccttcactagcgacgtttcaagttacctggaggaacaggcggccaaggaattcatcgcttggctggttaagggtcgggggcacggtgaaggaactttcacttcagatgtgagtagctacttggaagagcaagccgccaaggagtttattgcttggcttgttaagggacggggccatggggagggaacgtttacgtcggacgtgagcagctacctcgaggagcaagcggcaaaggagtttatcgcctggttggtcaagggtcgagggcacggagaaggaacgttcacttccgatgtcagttcgtacctcgaagaacaagccgcgaaggagttcatcgcatggctcgtgaaggggcggggtcacggcgagggaaccttcaccagtgatgtgagctcctatttggaggagcaggccgctaaagagtttatcgcatggttggtaaaaggccgcggccatggagagggcacgtttacgtccgacgtcagttcctacctcgaagagcaggcagcgaaagagttcatagcgtggttggtgaaaggacgcggccatggcgaaggaaccttcacttccgacgtgtcatcgtaccttgaagagcaggcggccaaagagttcatcgcgtggctggttaaaggcaggggacacggagaaggtacctttacgtcggatgtctcgtcgtacctggaagaacaggctgccaaagaattcattgcgtggctcgtgaaagggcgcggacatggagaggggaccttcacctccgatgtgtcatcatatctcgaggaacaagctgcaaaagagtttattgcctggctggtcaagggcagaggacacggtgagggaacctttacctccgacgtctcgagctaccttgaggaacaagcggcaaaagaattcatagcctggcttgtgaaaggaaggggtggcggcggagggggagggtcgggaggaggcggttcgggagggggcggaagcgcggaatcgaagtacgggccaccatgccccccgtgcccggccccggaagctgccggcggaccttcggttttcctgttcccaccgaagcctaaggacactctgatgatctcccgcacccctgaagtcacctgcgtggtggtggacgtctctcaagaggacccagaagtgcagttcaactggtatgtggacggagtcgaagtccacaacgcaaagactaagcccagagaagaacagttcaattcgacctaccgggtggtgagcgtcctgaccgtgctgcaccaggattggctgaacggcaaggaatacaagtgcaaggtgtcgaataaaggactgccgtctagcatcgaaaagaccatctcgaaggcaaaggggcaacccagagagcctcaggtctacaccctgccaccgtcacaggaagaaatgactaagaatcaggtgagcctgacttgtcttgtgaagggcttctacccgtctgacatcgccgtcgaatgggaatcgaacggtcagccggagaacaattacaagaccactccgccagtgcttgattccgacggatcctttttcctgtactccagactcactgtggacaagtcgcgctggcaagaaggaaacgtgttctcatgtagcgtgatgcatgaagcactgcacaaccattacactcagaagtcactgagcctgtccctggga

SEQ ID NO: 15744 - DNA, 1740 bp, Artificial Sequence
  Description of Artificial Sequence: Synthetic coding sequence
atgaagtgggtgtcatttatcagccttctctttttgttttcgtccgcatactccggctccttggacaagcgacacggcgaaggcaccttcacctccgacgtgtcgtcgtacctcgaagagcaggcagccaaggaattcatagcgtggctcgtgaagggtcgaggacatggagagggaaccttcacctcggacgtttcatcctacctcgaagaacaagctgcaaaagaattcatcgcctggctcgttaaaggtagaggtcacggtgagggaactttcacttcagatgtgagttcttacctcgaggagcaggccgcaaaggaattcattgcatggcttgttaagggaagaggccatggtgaaggtacctttacgtcggacgtttcgtcataccttgaagagcaagctgctaaagagtttattgcttggcttgtaaagggtcgggggcatggggaaggtacttttacttcagacgtgtcgagctaccttgaggagcaagcagcaaaggagttcatagcatggcttgtgaagggcaggggtcatggtgaggggacctttacctccgatgtgagttcctatctggaagagcaagcagcgaaagagtttatagcatggttggtgaagggccgcggacacggtgaagggacttttacttcggacgtttccagctacctggaggagcaggcagcgaaggagtttattgcctggctcgtcaaaggaagaggacatggggaaggaacctttactagcgatgtgtcctcgtacttggaagaacaggcagcgaaagaattcattgcgtggctggttaaggggcgcggacatggagaaggaacgttcacctcagatgtaagctcttacctggaggaacaagccgccaaggagtttatcgcttggttggtcaagggacggggacacggggaaggcacgtttacgagcgacgtctcgtcttacctggaagagcaggccgccaaagagttcattgcctggttggtcaaaggacgtggagggggcgggggtggaggatcaggagggggcggaagcggtggaggaggctccgccgaatcgaagtacggcccgccttgcccaccttgtccagcacctgaagctgcaggaggaccctccgtctttctgtttccccctaaaccaaaggatactcttatgatttcgcgtactcctgaggtcacctgcgttgttgtggatgtgagtcaagaggatcctgaagtccaattcaactggtacgtcgatggtgtggaagtccataacgcaaaaactaagcctagagaagaacagtttaacagcacctaccgcgtggtgtcagtgctgactgtgcttcatcaggattggctcaacgggaaagaatacaagtgtaaggtcagcaataagggtctgccaagctccattgaaaaaaccatctccaaggcaaagggtcagccaagagaacctcaagtgtatacgctgcctccatcccaagaagagatgaccaagaatcaggtgtcactcacttgtctcgtcaaaggtttttacccatccgacatcgcagtggaatgggaatcaaatgggcaacccgaaaacaactacaagactaccccgcccgtgcttgattcggatggtagtttctttctttactcaaggctgactgtcgataagtctcggtggcaagaaggaaatgtgtttagctgttcagtgatgcacgaggcgctgcacaaccattacacccagaagtcgctttcgctgtcgctgggg

SEQ ID NO: 15745 - DNA, 1740 bp, Artificial Sequence
  Description of Artificial Sequence: Synthetic coding sequence
atgaagtgggtcagctttatctctttgctgttcctcttctcatcagcctactcggggagcctggacaagcggcacggagaggggacgttcactagcgacgtgtcgtcgtacctcgaagaacaggcggcgaaggaatttatcgcatggctggtgaaggggcgcggacacggcgaaggcaccttcaccagcgatgtgagctcgtatttggaggaacaggccgctaaggagttcatcgcctggcttgtaaagggacgcggccatggtgaggggacctttacctcagacgtctcctcctacctggaagaacaggccgcaaaagaattcattgcgtggctggtcaaagggcgcggccacggcgagggaacttttacctccgacgtctcgtcttacctggaagagcaagcagcaaaggaattcatcgcttggctcgtgaagggacggggacatggggaaggtactttcacttctgatgtgtcgtcatacctcgaggaacaagcagccaaagaatttatcgcctggctcgttaagggccggggacacggagaaggcactttcacctcggacgtgtccagctaccttgaagagcaagccgcgaaagaattcatcgcgtggctggtaaagggtcgaggccatggtgaaggaaccttcacttcagacgtgtcgtcctacctggaggaacaagccgctaaagaattcatagcctggctggtcaagggtaggggtcatggagagggaaccttcacctccgatgtgagtagctacttggaggagcaagctgccaaggagttcattgcttggttggtcaaggggcgaggccacggggagggaactttcacgagtgacgtgagctcatatctcgaagagcaggcggccaaggagtttatcgcttggcttgtgaagggaagaggtcacggcgaagggacttttacctcggatgtgtctagctacctcgaggagcaggccgcaaaggagtttattgcgtggttggtaaagggcagaggtgggggagggggaggaggctccggcggcggaggcagcggtggaggaggcagtgcagaatccaaatacggaccgccgtgcccaccctgtcctgcaccagaggccgcgggagggccttcggtctttctgttccctccaaagcccaaagacacgctgatgatctcgcgcaccccggaggtgacctgcgtggtcgtggacgtgtcccaggaggatccggaagtgcagtttaactggtacgtggacggagtggaagtgcacaatgcgaaaactaagcctcgcgaggaacagttcaattcaacctaccgggtcgtgtccgtcctgactgtgctgcatcaagattggctcaacggtaaggagtacaagtgcaaagtgtccaataaaggtctgccgtcgtcgatcgagaagactatctccaaagctaagggacagccgagggagccacaggtttacactctgcccccatcgcaggaggagatgaccaaaaaccaggtcagtcttacttgtctggtgaagggattctacccgtccgacatcgcagtggaatgggaatccaacggacagccagaaaacaattacaagactacgccgccggtgctggattctgatggcagcttcttcctctactcgagactgaccgtcgacaaatcccgctggcaagaaggaaacgtgttctcctgctcagtcatgcatgaagccctgcacaaccactacacccaaaagtccctctccctgagcctcggc

SEQ ID NO: 15746 - DNA, 1740 bp, Artificial Sequence
  Description of Artificial Sequence: Synthetic coding sequence
atgaagtgggtcagtttcatcagcctgctctttctgttcagcagcgcatactcaggatctcttgataaaaggcacggtgaaggaactttcacttctgacgtgtcctcctacctggaggaacaggcagccaaggaatttattgcttggctagtaaaggggcgagggcacggcgagggtacctttacatctgatgtgagctcctacttagaggagcaagctgcaaaagaattcattgcatggttagtcaaaggacgcggccatggtgagggcacctttactagtgatgtcagtagctatctagaagaacaggcagcaaaggagtttatcgcctggctggttaagggacggggccacggagaaggtacctttacatcagatgtgtcttcatatctggaagagcaggccgccaaggagttcatcgcttggctcgtaaaaggtcgcggccacggcgaagggacctttactagtgatgtgagcagctatctcgaggagcaggccgccaaggaatttattgcttggctggtgaaagggcgcgggcacggcgagggcacattcacatctgacgtgagtagctacctcgaagagcaggccgcgaaggagttcatcgcatggctggttaagggtcgaggacacggcgagggcacatttacatcagatgtttcttcttacctggaggagcaggccgccaaggagtttatcgcgtggctggttaaagggaggggacacggcgaggggacgttcacatcagatgtcagctcttacctcgaggagcaagccgcaaaggagttcattgcctggctagtcaaaggacgggggcatggagaagggacattcacttctgacgtgagctcgtacctggaagagcaggccgctaaagagtttattgcttggctggttaaaggccgcgggcacggggagggaactttcactagtgatgtgtcatcttatttggaagaacaggcggccaaagagttcatcgcgtggctggtgaagggacgtggtggtggaggcggtggaggtagcggcggaggcgggtccgggggcggaggttcagcggagagcaaatatggtcccccttgccctccatgtcccgcacccgaagccgccggcggcccatctgtattcttgtttccccctaagcccaaggacacgcttatgatatcgagaacacctgaagtgacttgcgttgtggttgacgtgtcccaggaggatcccgaggtacagtttaattggtatgttgatggtgtagaagtgcacaacgccaaaaccaaacccagggaagaacagtttaatagcacatatcgcgtggtgtcagtgctcacagtcttacatcaggactggctcaatggaaaggaatacaagtgtaaagtaagcaacaagggacttccaagttctattgagaagacaatttccaaagccaagggccagccaagagagccgcaggtatatactctgcctccgagtcaggaggaaatgaccaaaaaccaggtgtccttgacttgtcttgtgaaaggattctaccccagcgacattgcagtagaatgggaatcaaatgggcagcccgagaataattacaaaacgactccccctgtgcttgattcggacggtagctttttcctctattcgcggctgaccgtggacaagagtagatggcaagagggtaatgtattctcatgttccgtgatgcatgaagccctgcacaatcattacacgcaaaaaagcctctcactttcccttgga

SEQ ID NO: 15747 - DNA, 1740 bp, Artificial Sequence
  Description of Artificial Sequence: Synthetic coding sequence
atgaagtgggtgtcattcatcagtctgctgttcctgtttagttccgcctactcggggtccctggataaacggcacggcgaaggaacctttactagcgatgtgtcatcgtacctcgaagaacaagccgcgaaagagtttatagcttggctggtcaagggtaggggccacggggaggggacgttcacctccgacgtgagctcgtacctggaagaacaggcggcaaaggagtttatcgcttggctcgtgaaggggcgcggacatggcgaaggcactttcacgtcagacgtgtcgtcctatcttgaagaacaagcagcgaaagagttcatcgcgtggctcgtgaaaggaagaggacatggagaaggaactttcacttcagatgtctcgtcgtaccttgaagagcaggcagcaaaagagttcattgcttggctcgtcaaagggcggggtcacggtgagggtactttcaccagcgacgtttccagctacctcgaggagcaggcggccaaggaattcattgcctggctggttaagggcagggggcacggagaaggtacgttcacttcggacgtgtcctcttacttggaagagcaggccgcgaaggagttcattgcatggttggtaaagggccgcggacacggtgaaggaaccttcacgtcggacgtctcttcttatctcgaagagcaagccgcgaaggaattcatcgcatggctggtaaaaggcagaggccacggcgaagggactttcactagcgacgtatcttcatacctggaggagcaagcagctaaggagttcatagcttggttggtgaagggccggggacatggagaggggactttcacctcggatgtttcctcgtacctcgaggaacaggcggcgaaggagtttattgcgtggctggtgaagggacggggccatggagagggcacttttacctcggacgtctcctcgtatctggaggaacaagccgccaaggagttcatcgcctggctggtgaaaggtcgcgggggaggaggcggaggggggagcggaggcgggggaagcggaggaggtggaagcgccgagtcaaaatacggacctccgtgtccaccctgccccgctcctgaagcggccggtggcccttcggtgttcttgtttccgccaaagccaaaagataccctgatgatctcaagaaccccagaggtgacctgtgtggttgtggacgtgtcgcaggaagatccggaagtccagtttaactggtacgtcgacggggtggaagtgcataatgccaaaactaagccgcgcgaagaacagttcaattcaacctaccgcgtggtgtccgtcctgactgtcctgcatcaggactggcttaatggtaaggaatacaagtgcaaagtcagcaacaagggtctgccgtcctcaatcgaaaagaccatctctaaagccaagggacaaccgcgagagccacaggtctacactctgcctccgagccaggaagaaatgaccaaaaaccaggtgagcttgacctgcctggtgaagggcttctacccgagcgacatcgccgtggaatgggaatccaacggacagccggaaaacaactacaagaccacgcccccagtgcttgatagcgatggttcgttcttcctctacagccggttgaccgtcgacaagtcaaggtggcaagagggaaatgtcttttcttgcagcgtcatgcacgaggccctccacaaccactacacccaaaagagtctgtccctctcgctcgga

SEQ ID NO: 15748 - DNA, 1740 bp, Artificial Sequence
  Description of Artificial Sequence: Synthetic coding sequence
atgaaatgggtatctttcatctctctgcttttccttttcagttccgcttactcaggatccctggataagaggcacggtgaaggcaccttcacatcagatgtgtcctcttacctcgaggagcaggccgctaaagaattcatagcttggctagttaagggaaggggacacggtgaaggtaccttcacttccgacgtatcctcctacctggaggaacaggcagccaaggagttcatcgcctggctggtaaaagggcgcggccacggcgaaggcacatttaccagcgacgtttcctcttacctcgaagagcaggcagccaaagagttcattgcttggctggtcaagggacggggtcatggcgagggcacctttacgtccgatgtgtcctcgtatctggaggaacaggcagcaaaggagttcatcgcttggctggtcaagggacgtggccatggagaaggcaccttcaccagcgacgtctcatcatatttagaggaacaggccgccaaagaatttatcgcttggcttgttaagggaaggggccacggggagggtacattcacctccgatgtctcctcttacttggaggagcaggctgccaaggaatttattgcttggttagtaaagggccgggggcatggagaaggcacattcacctccgatgttagctcatatctggaagagcaggcggccaaggaattcattgcctggttggtaaagggccgcgggcacggcgagggcacatttaccagcgacgtgagtagctacctggaggagcaagcagcaaaagagttcatcgcgtggttggtcaagggacgaggacatggagaggggacatttactagcgacgtgagtagctatttggaggaacaggccgcgaaggaatttattgcgtggctggtaaaaggtagagggcatggcgagggcacattcacctctgatgtgagctcatatctcgaggagcaggctgctaaagagtttattgcttggctcgtgaaaggcagaggcggaggggggggtgggggatctgggggcggaggctcaggtgggggaggttctgctgagtcaaagtacggacctccatgcccaccatgccctgctcctgaagcagccggagggccgtccgtttttctatttcctccaaaacccaaggacaccttgatgatttcgagaacacctgaggtaacatgcgtggtagttgacgtgtcccaagaagaccctgaagtgcagttcaattggtatgttgacggcgtggaagtgcacaatgccaaaacgaaaccaagggaggagcaattcaattcgacttacagagtagtctccgtcttgactgtgctgcaccaggattggttaaatggaaaggaatataagtgtaaagtaagtaataaaggcctgccctcgagcatagagaagaccatctcgaaagcaaaggggcagcccagggaaccccaagtatatactctgcctccctcgcaagaggagatgacaaaaaatcaggtaagcctgacatgcctcgtgaaagggttttacccctccgatatcgcagttgaatgggagtccaacggccagccagagaacaactacaagaccactcctccagtgcttgacagtgacggatcattcttcctttattcaagacttacagtggacaagtcccgttggcaggagggtaatgtgttcagttgctctgtgatgcacgaggcattgcacaaccattatacacaaaagagtttaagcctgtcgctgggt

SEQ ID NO: 15749 - DNA, 1740 bp, Artificial Sequence
  Description of Artificial Sequence: Synthetic coding sequence
atgaagtgggttagttttatcagccttctgtttctgtttagctccgcctactcgggctctcttgataagcgccatggcgaaggaacctttaccagcgatgtgtcctcctacttggaggaacaagcagcaaaggaattcatcgcatggctggttaaaggtcggggtcatggcgagggaacgtttacctccgatgtctcctcatacctcgaagaacaagcagccaaggaattcattgcctggctcgtgaagggtcggggccatggtgaaggcacctttacgtcggacgtgtcgtcgtacctggaggagcaggccgcaaaagagttcatagcgtggctggttaagggtcgcggtcatggagaggggacgtttacctcagacgtgtcgagttaccttgaggaacaagcggcgaaggagtttatcgcttggctcgtcaagggacgagggcatggggagggcaccttcacctctgatgtgtcatcgtaccttgaagagcaagcggctaaggagtttatagcatggctcgtgaaaggtcgtgggcatggagaaggtacttttacttcagacgtatcatcctatctcgaagagcaggcagcaaaggagtttattgcctggctggtaaaaggccgaggacatggggaagggactttcacgtcagacgtctccagctaccttgaggagcaagcagcgaaggagttcatcgcctggctggtgaagggcagggggcacggtgagggcacgttcactagcgatgtctcgagttatcttgaagaacaggctgcgaaagaattcatagcctggctcgtaaagggacgcggacacggcgagggaacctttacttccgacgtgagctcatacctggaggaacaggcagctaaagagtttattgcatggcttgtgaagggaaggggccacggagaagggaccttcacttcagatgtgtcgagctacttggaagaacaggccgccaaagaattcattgcttggcttgttaagggaagaggaggaggaggtggcggaggttcgggaggaggaggaagcggcggaggaggaagtgcagaatctaagtacggtcctccttgtccaccttgtccagcgcccgaagcagcaggcgggccgagtgtgtttctgtttccacccaagcccaaggatactctgatgatctcccgtacccctgaagtgacttgcgtggtggtcgatgtctcacaagaagatccagaagtgcagttcaattggtacgtggacggcgtggaagtgcacaatgcaaagactaaaccgagagaagaacaattcaatagcacctaccgggtggtgtcggtccttactgtcttgcatcaggactggctgaacggaaaggaatacaagtgtaaggtcagcaacaagggactgccttcttccattgaaaaaaccatttcgaaagcaaagggtcaaccaagagaaccacaggtgtacacccttcccccttcgcaagaggagatgactaagaaccaggtgtcgctcacctgtctggtcaaagggttttatccttcagatattgcagtggaatgggaatccaacggtcagccggaaaacaattacaaaaccactccacctgtcctggattccgatggatcgtttttcctttactccagactgaccgtggacaagtccagatggcaagaaggtaacgtcttttcatgcagcgtgatgcacgaagcattgcataaccactacactcaaaagtccctgtcacttagccttggt

SEQ ID NO: 15750 - DNA, 1740 bp, Artificial Sequence
  Description of Artificial Sequence: Synthetic coding sequence
atgaagtgggtcagttttatctccttgctcttcctcttcagctcagcctattcgggaagccttgacaaacgacacggcgagggaacgtttacatccgatgtgtcgtcctatctcgaagagcaggccgcaaaggaatttattgcgtggcttgtgaaaggccgtgggcatggggagggcacatttacttccgacgttagctcttacctcgaggagcaagccgcaaaggaattcatcgcatggttggtcaaaggccgtgggcacggggaaggcacatttacatccgacgtatcaagttatctcgaggagcaggccgccaaggagtttatcgcctggctcgtgaagggcagaggacacggtgaaggcacattcacttcggatgtgtcaagctacctcgaggagcaagcagcaaaagagtttatcgcatggctcgtcaaggggaggggtcacggagaagggacttttacctctgatgtctctagctaccttgaagagcaggcggcaaaggagttcattgcttggctggtgaaaggcagaggacacggtgaaggaacttttacgagcgatgtctcttcttacctggaggaacaggcagcaaaggagttcatcgcctggctggtcaaggggaggggccacggggagggcactttcacaagtgatgtgagcagctacctcgaagagcaggccgcgaaggaatttatcgcctggctggtcaagggcaggggccacggcgaagggacatttaccagcgatgtttcctcatatttggaggagcaagcagcaaaagagttcattgcatggttggtcaagggaaggggccatggggagggaacgttcacatctgatgtatcatcctacctcgaggagcaagcagccaaggagttcatcgcatggctggtgaagggaagaggccacggcgaggggacctttacttccgatgtttccagttacctcgaggaacaagccgccaaggaatttatcgcatggttagtgaaaggccggggaggtggaggggggggagggagcggtgggggaggaagcggtggcggcggatccgcagagagcaagtacgggcctccttgccctccgtgtcccgcacctgaggcggcaggcggaccaagcgtcttcctgtttccacctaaaccaaaggacactctaatgattagcagaactcctgaagtgacgtgcgtcgtcgtggatgttagtcaggaggatccagaagtgcagtttaattggtacgtggacggcgtggaagtacacaatgccaaaacaaaaccgagggaagagcagtttaattctacctaccgtgttgtctctgttctcaccgtgctccaccaagattggctgaacggcaaggaatacaaatgtaaggtaagcaataaagggttaccttccagcattgaaaaaacaatcagcaaggcaaaaggccagccaagagaaccccaggtgtacaccttgccgccttcccaggaggagatgacgaaaaaccaggtcagcctgacctgtctggttaagggtttctacccctccgatatagccgtcgaatgggaatcaaacggtcaacctgagaacaactacaagacaaccccaccagtcctggattcagatggctccttctttctgtacagtaggcttactgtggataagtcacggtggcaggaaggtaatgtgttttcatgttcagtcatgcatgaggctttacataaccactacacccagaagtctctatctcttagtctggga

SEQ ID NO: 15751 - DNA, 1740 bp, Artificial Sequence
  Description of Artificial Sequence: Synthetic coding sequence
atgaagtgggttagcttcatcagcttgctgttcctctttagttccgcctactccggcagtctggacaagagacatggtgagggaacgttcacctcggatgtttcgtcgtaccttgaggagcaagcagctaaggagttcattgcatggctcgtcaagggcaggggtcatggtgaaggaacattcactagcgacgtctcatcctacttggaggaacaggctgcaaaggaatttatcgcatggctggtgaaaggtcgcggtcacggcgagggcacttttacctccgatgtttcgtcctatctagaggagcaggcggcgaaagagttcattgcttggctggttaagggccgcggccacggcgaaggaaccttcacgtccgatgtttcttcctacttagaagaacaggcagccaaggaatttatcgcgtggctggtgaagggccgcggccacggtgaaggaacgttcacctccgatgtgtctagctacctggaggagcaggcagctaaagagttcatagcctggctcgtcaaaggcaggggacacggtgaaggcacgttcacctcggatgtgtccagctacctggaagagcaggccgcgaaggaatttatcgcgtggctggttaagggccgtggccacggtgaaggaaccttcaccagtgacgtttccagctatctggaggagcaagcggccaaggagttcatagcatggctggtgaagggtcggggtcatggcgagggcacttttacgagcgatgtctcctcctatctcgaagaacaggccgctaaggaattcattgcttggctcgtgaagggccgtggccatggagagggcactttcacatccgatgtatccagctatttggaggagcaagcagctaaagagttcatcgcctggctggtgaaaggcaggggccatggggaaggcacattcacgtcagacgtgtcctcgtacttggaggagcaggctgccaaagaatttatcgcctggctggtaaagggtcgaggcggtggaggcggaggtggctctggcggcggaggaagcggaggcggcggtagcgccgagtccaagtacggcccaccctgtcctccatgcccggccccagaggccgcaggaggtccaagtgtgttcctgtttccgcccaagcccaaagacacactgatgatcagccgtacaccggaggtgacgtgtgttgtggtcgatgtgtcccaggaggacccggaggtccagttcaattggtacgtggacggcgtggaggtccataacgcgaaaacaaaaccgcgtgaggagcagttcaatagcacctaccgagtagtgtccgtgttgacggtgttgcatcaggactggctgaatggaaaggagtacaaatgtaaggtgtcaaataagggcttgccgtcgagcattgagaaaaccatctccaaagcgaagggtcagccccgcgagccgcaagtgtacaccctgcccccaagccaggaagagatgaccaaaaaccaagttagtctaacttgccttgtgaagggattctatccgtcagatatcgctgtcgagtgggagagtaatggccagcccgaaaacaactacaagaccacgccgcctgtgctagactctgacggttctttcttcctctattccagactgacagttgataaaagccggtggcaggagggaaatgttttctcatgttcagtgatgcacgaggctctgcacaaccactacacacagaagtcgcttagtcttagtctgggc

SEQ ID NO: 15752 - DNA, 1740 bp, Artificial Sequence
  Description of Artificial Sequence: Synthetic coding sequence
atgaagtgggtctctttcatcagcctgcttttcctgttcagcagcgcgtattctggctctctggacaaacgccatggtgaaggtacctttacgtccgatgtcagcagctatctggaggaacaagcagctaaagaatttatagcgtggctggtcaagggccgcgggcacggtgagggcacgtttactagcgacgtatcatcttatctggaagagcaggccgcgaaggagttcatcgcttggcttgtgaaaggtcgcggacacggtgagggtacatttaccagcgacgtcagctcctatctggaagagcaagcggctaaggaatttattgcttggctggtcaagggccgcggtcatggtgaaggcacttttacgtctgatgtgagcagctatttggaggaacaagctgcgaaggaatttattgcgtggctggtaaagggccgcggccacggtgaagggaccttcacgagcgacgtgagctcatatctggaggagcaagcagcgaaggagttcatcgcatggctggtgaaaggtcgtggtcacggtgaggggacttttacgtctgacgtgtctagctatctggaggagcaagccgccaaggagtttatcgcgtggttggtgaagggtaggggtcatggtgagggaactttcaccagcgacgtcagtagctacctggaagagcaggctgctaaagagtttatcgcttggttggtaaagggccgaggccacggtgaggggactttcacttcggacgtgagctcctacctggaggaacaggcagcaaaggagttcatagcatggctagtgaagggtcggggccatggggaggggacattcaccagcgacgttagcagctacctcgaggagcaagctgccaaagagtttattgcttggctcgtcaaaggtcgcggccatggggaaggtaccttcacctccgatgtatccagctacctggaggaacaggctgctaaggaatttatcgcctggctggtgaaagggcgcggcggcggtggtggcggtggttctggcggtgggggtagcgggggtgggggtagcgcagaaagcaaatacgggccaccctgcccgccatgcccagcaccggaagctgcgggcggaccaagcgtgttcctgtttccaccaaagccgaaagataccctcatgattagccggaccccagaagtgacctgcgtcgtcgtggacgttagccaggaagatcctgaggtccagtttaactggtatgtagacggtgtggaggtgcataacgcaaagacaaagccacgcgaggaacagtttaacagcacctatcgtgtggtgtcggtcctgaccgttctccaccaggattggttgaacggaaaggagtacaagtgtaaagtgagcaataagggactcccgtcaagcattgagaagactatctccaaagcaaagggtcagccgcgcgagccgcaagtctatacgctgcctccgtcacaagaagagatgaccaagaatcaggtcagcctcacttgtctggtcaaaggcttctatccaagcgacattgccgtggaatgggagtcgaatggccagccggaaaacaactacaagaccactccaccagttctggacagcgacggttcttttttcctgtactcacggttgaccgttgacaagagccgttggcaggaaggcaatgtgttcagctgcagcgtgatgcacgaagcactgcacaatcattacacccaaaagagcctcagcctgagcctgggt

SEQ ID NO: 15753 - DNA, 1740 bp, Artificial Sequence
  Description of Artificial Sequence: Synthetic coding sequence
atgaaatgggtgtcgttcatttccttactgtttctgttcagttcagcttattcaggcagccttgacaagcggcatggggagggaacattcacctcagatgtgagctcttacctcgaagaacaggccgcgaaggaattcatcgcatggctggttaagggacgcggccacggagagggaacctttaccagcgacgtgagctcctatctcgaagagcaggccgccaaggaatttatcgcttggctcgtgaagggcaggggccacggggaaggcacgttcacgtctgatgtttcctcttatctggaggagcaggcagcaaaggagttcatcgcttggttagtgaaagggcgcggccatggcgagggaaccttcactagtgacgtaagttcatatctcgaagagcaagctgccaaggaatttatagcatggttagtcaagggacggggacacggagagggcaccttcacatcggatgtatcctcttatctggaggagcaagcggccaaagagtttattgcctggcttgtcaagggcagaggacacggagaggggacatttacctccgacgtgagcagctatttagaagaacaagctgccaaagaatttatagcctggcttgtaaaaggaaggggacatggggaagggacctttacaagcgatgtgagctcatacttagaggaacaagcggctaaagaatttattgcttggttggttaagggccggggccatggggaaggaacgtttacctcggatgtgtcgtcctaccttgaggagcaggccgcgaaagagttcatcgcgtggctagtcaaaggccgtggccatggagagggaacattcacttcagatgtgtcctcttacttagaagagcaggccgcaaaagagtttatcgcatggcttgtcaaaggacgcgggcacggtgagggaacattcacatcagacgtgagttcctacctggaagaacaagccgcgaaagaatttattgcctggttggtcaaggggcgtggaggaggtggagggggagggagcggaggaggtggcagcggaggaggcggttccgcagagtccaagtacggacctccttgccctccgtgccctgccccagaagcagccggaggtccctctgtgtttctgttccctccaaaacccaaggatactctgatgataagtcgaacaccggaggtaacctgtgtggtagtagatgtttcgcaggaggatcctgaagtccaatttaactggtatgtcgatggggttgaagtgcacaatgccaaaaccaagcccagggaggagcagtttaactcaacatacagagttgtgagcgtactgacggttttgcaccaggactggctcaatgggaaggaatataaatgtaaggtaagcaataagggtctgccatctagcatcgagaagaccatcagcaaggccaaggggcagccacgagagccccaggtgtatacactgccaccttctcaggaagagatgactaagaaccaggtttcgctcacatgtctcgtgaagggtttctatccatccgatattgccgtggaatgggagagtaatggtcagccagagaataattataagacaacacccccggtgctggacagtgatggtagcttttttctgtacagtcggctgaccgtggacaaaagtagatggcaggaaggaaacgtcttttcctgttcagtcatgcacgaagccctgcataatcactatacacagaagagtctgtctctctctctggga

SEQ ID NO: 15754 - DNA, 1740 bp, Artificial Sequence
  Description of Artificial Sequence: Synthetic coding sequence
atgaaatgggttagcttcattagcctgctgtttctattcagctcagcttactcaggctctcttgataagagacacggcgaggggactttcacttcagatgtctcttcatacctggaggagcaggctgcaaaagagtttattgcttggctggtaaaaggaagaggccatggagaagggacgttcacaagcgatgtgagcagttacctcgaggagcaggccgccaaggagtttatcgcttggctggttaaagggcggggacacggcgagggaacctttacaagcgatgtgagcagctatttggaggagcaggcagctaaggaatttatcgcatggctggtcaaagggcgggggcatggggaggggacatttacttccgatgtgagctcctacttggaggaacaggccgccaaggaatttattgcctggttagtgaagggtcgaggacatggagaaggaactttcacatccgacgttagttcatatctggaagagcaggctgcgaaggaattcattgcctggctcgtcaaaggccggggccatggtgaaggcaccttcaccagtgacgtgagctcctacttggaagagcaggccgccaaagaattcatcgcctggctcgtgaagggacgtgggcacggcgaaggcactttcactagcgacgttagcagttatctcgaagagcaggctgccaaagagttcattgcctggctagtgaagggcagaggacatggggagggcactttcacaagtgacgtatcctcctacctggaagagcaagccgccaaagaattcatcgcctggttggtgaaaggaagaggccacggcgaagggacattcacctctgatgtgagctcctaccttgaggaacaagctgcaaaagaattcatagcctggttggtcaagggccggggtcatggagaggggacctttacctccgacgtctcatcataccttgaagaacaggctgccaaggaatttatagcttggctggtgaagggcagaggtgggggtggaggtggcggttctgggggcggagggtctggtgggggagggagtgctgaatccaagtatggacccccttgtcccccttgtcccgcccccgaagccgccggcggaccttccgttttcttgttcccaccaaagcctaaagatacactgatgatttctcgaaccccagaggtgacctgcgtggtcgtcgatgtgagccaagaagatccagaggtgcagtttaactggtatgtagatggagtggaggtgcacaacgcgaaaactaaaccaagagaggagcagttcaatagtacttatagagtggtgagcgtacttacagtgctgcaccaggactggctgaatggaaaagaatataagtgtaaggtgtccaacaaaggactgcctagcagcattgaaaagacaatcagcaaggcaaaaggacagccccgggagccccaggtgtacactttgcctcctagccaggaagagatgaccaagaatcaggtaagtcttacgtgtttagtgaagggcttctacccgtcggacatcgccgttgagtgggagagcaatgggcagccggaaaacaattacaagactacccccccagtactcgattctgatggcagcttctttctgtactccaggttgaccgtcgacaagtctagatggcaggagggcaacgtgttttcttgcagcgtcatgcacgaagcattacataatcattatacacagaagtcacttagtttgagcctgggc

SEQ ID NO: 15755 - DNA, 1740 bp, Artificial Sequence
  Description of Artificial Sequence: Synthetic coding sequence
atgaagtgggtttccttcatcagcttgctgttcctctttagctccgcctatagcgggagcctcgataagaggcatggggagggaacatttacctcagacgtgtcgtcctaccttgaagagcaggccgcgaaagagtttatcgcctggctggtgaaaggccgcggccatggcgaaggcacctttacctctgatgtgagttcctatctggaggagcaagcagccaaagagtttatcgcctggcttgtgaagggccgcggccatggagagggaaccttcacaagcgacgtttcctcctacctcgaagaacaggctgccaaagaatttattgcctggctggttaaggggcgggggcacggagagggcacctttacctccgatgtctcatcttatctggaagagcaggcggctaaggagtttatcgcatggctggtgaaggggaggggccacggagaggggacgttcacatccgatgtctccagctacctggaggagcaggcggccaaagaatttatcgcctggctggtgaagggccgcggacacggcgaggggacctttacatccgacgtgtcaagttatctcgaagaacaggccgctaaggagttcatagcatggctagtgaaagggagggggcacggtgaagggacattcacatccgacgtaagctcctacctggaagaacaggccgcaaaggagttcattgcttggctggtaaagggaagaggacacggcgaagggaccttcacaagtgatgtatcttcgtaccttgaggagcaagcggcaaaggagttcatcgcctggcttgtgaagggccgggggcacggtgaggggacatttacctctgatgtttctagctacttagaggaacaggccgccaaggaattcatcgcttggttggtaaaaggccgtggtcatggagaagggacgtttacgtccgacgtgagtagttatctggaggagcaggctgccaaggagttcatcgcttggttagtgaaaggccgtggcggaggaggcgggggcggatctggagggggaggttccggcggaggcgggagcgctgagtccaaatacggtcctccctgccctccttgtcctgccccagaagccgctggaggcccctccgtgtttctctttccaccaaagccaaaggacaccttaatgatctcaaggacgcccgaggttacatgcgtggtcgtggatgtcagtcaagaggatccagaggtgcagtttaattggtatgtggatggcgttgaggtccacaacgctaagactaaacctagggaggaacaatttaacagtacctacagggtagtgtccgtgttgacagtgctccaccaagactggctaaacggcaaagaatacaagtgcaaagtatccaataaagggcttcccagttcaatcgagaaaaccatcagtaaggctaagggtcagccacgagaaccccaggtctacaccctgcccccttcccaggaggagatgaccaagaatcaagtctctctgacctgtcttgttaaaggattctatccttccgatatcgcagtggagtgggagtccaatggccaaccggaaaacaactacaagaccaccccccccgtgctggatagtgacggctcctttttcttatactctcggttgacagtggacaaaagcaggtggcaggagggtaacgtgttctcttgcagtgttatgcacgaagcgctgcacaatcattatacacagaaaagtttgagcctatctttgggg

SEQ ID NO: 15756 - DNA, 1740 bp, Artificial Sequence
  Description of Artificial Sequence: Synthetic coding sequence
atgaagtgggtttcctttatttcactgctctttttgttcagcagtgcatacagtggcagcttggataagcggcatggggaggggacatttacctccgatgtgtcatcttacctggaagaacaggcggccaaagaattcatcgcttggctggtcaagggcagagggcatggcgaaggcactttcacctccgatgtgtcctcctacctggaggaacaggccgccaaagagtttatagcgtggctggtgaagggccgaggccacggcgagggcactttcacatcagatgttagcagctatctggaggaacaggctgcaaaggaattcatagcttggctcgtgaaaggcagaggccacggcgaggggactttcacctccgacgtgagttcctacctagaagaacaggccgcaaaagaattcatcgcgtggctggtcaaaggcagagggcacggagaaggcactttcacctccgacgtgagctcgtacctcgaagagcaagctgccaaagaattcatcgcatggctcgttaagggaagagggcacggggaggggaccttcacatccgacgtgtcttcctatctggaagagcaggcggccaaggaatttatagcctggctggtcaaaggtcgagggcacggagagggcaccttcacatccgacgtgtcctcttacttggaagagcaagcagccaaggagttcatagcttggctcgtgaagggcagaggccacggggagggcacttttacttccgacgtatcctcttatctggaagagcaagccgccaaggagtttatcgcatggctcgtaaaggggaggggacacggggaggggacctttacatccgacgtgtctagctacctggaggaacaggccgcaaaagaattcatcgcatggctggttaaaggacgcggccacggtgaggggacctttacctcagatgtatccagttatctggaagagcaggcagccaaggaattcattgcttggttggtgaagggtagaggcgggggcggcggtggtggatctggcggtggcggatccggtggtggaggatccgctgagagtaaatatggtcccccatgcccaccttgccctgctcctgaggcagctggagggccgtccgtgtttctcttcccgccaaagcctaaagacaccctaatgattagtcgcacacctgaggtaacttgcgtcgtggtggacgtgagccaggaggaccccgaagtacaattcaactggtatgtggacggcgtggaagtgcacaacgccaaaaccaagcccagggaagagcaattcaatagtacttaccgggtggtcagcgtactgacagtgctccaccaggattggctgaatggaaaggagtataagtgtaaggtctctaacaaggggctgcctagctctatcgaaaaaacaattagcaaggccaagggtcagcctcgggagccccaggtgtacacactgcctccatcacaggaggaaatgacgaagaaccaggtgtcccttacatgtcttgtgaagggcttttacccatctgacatcgcagttgagtgggagtcgaacggacagcctgaaaacaattacaagactacgcctcccgtgctcgattcagacggttcctttttcctgtatagcagactgaccgtcgataagagccggtggcaggagggtaacgtgttttcttgcagtgtgatgcacgaggccctgcataaccactatacgcaaaaaagcctgtcattgagtttagga

SEQ ID NO: 15757 - DNA, 1740 bp, Artificial Sequence
  Description of Artificial Sequence: Synthetic coding sequence
atgaaatgggtgtctttcattagcctactcttcttgtttagttcggcgtattcaggtagcttggacaaacgccacggggaagggaccttcacctctgacgtatcctcttaccttgaggaacaggcagccaaggagtttatcgcgtggttggttaaagggcggggccacggggagggcaccttcacttccgacgtgtctagttatcttgaagagcaagctgccaaggagttcatcgcatggttagtaaaggggagagggcacggtgaaggcacgtttacatccgacgtgtcaagctaccttgaggagcaggccgctaaggagtttattgcttggctggttaagggcagggggcatggagagggcacctttaccagcgatgtgagtagttacctggaagagcaggctgcgaaagagttcattgcatggctggtaaagggaagggggcacggggagggaaccttcacctccgacgtgagcagctatctagaggagcaggccgcgaaagagttcattgcctggctagtgaaaggcaggggccatggcgaaggaacgttcacttctgacgtttcatcctatttagaggaacaggctgctaaagagtttattgcctggcttgtcaaaggccggggacacggagagggcacttttacttctgacgtctcttcatacctagaggaacaggctgccaaggaatttatcgcttggctggtgaaagggaggggccacggagaaggtacctttacatccgatgtatctagctatctcgaggagcaggccgccaaggaattcatcgcatggcttgtgaaaggcagaggtcatggcgagggcacattcacttctgacgtctcatcatacctcgaagaacaggccgcaaaggaatttatcgcctggctcgtgaaggggaggggacacggggaaggaacattcacgtctgatgttagttcttacctggaggagcaggccgccaaggagtttattgcctggctcgtaaagggcaggggcggcggtggaggaggcgggagtggcggcgggggaagcggcggggggggttctgccgaatccaaatacgggccaccctgccctccttgtccagcccccgaggccgcgggcggcccgtccgtgttcctcttccctcctaaaccaaaagatacactcatgatttcccgcactcctgaggtcacctgcgttgttgttgacgtttcccaagaggacccagaagtccagttcaattggtacgtcgatggcgtagaggtccacaacgctaaaaccaaaccaagggaggaacagtttaactccacttaccgtgtggtatccgtgctaacagtgctacatcaagactggttgaacggtaaggagtataagtgcaaggtctctaataaggggctcccttcctcgattgagaagaccatctccaaagcaaagggccagccaagggagccgcaagtgtacactctgcctccctcccaggaggaaatgactaaaaaccaagtgagccttacttgcctcgtgaagggcttctacccatctgatatagctgttgaatgggagtcaaacggccaacctgagaacaactacaaaactacacccccggtgctggattctgatggctccttctttctctattctcggctcaccgtggacaaatcaaggtggcaggaagggaacgtgttttcgtgctcagtgatgcatgaggcactgcacaaccactacacacaaaagtcgttgtctctgtccctaggc

SEQ ID NO: 15758 - DNA, 1740 bp, Artificial Sequence
  Description of Artificial Sequence: Synthetic coding sequence
atgaaatgggtgtcttttatcagtcttctgtttctgtttagctccgcctacagcggcagtctggataagaggcatggcgaggggacatttacaagcgatgtgagcagctatttggaagaacaggccgctaaggaattcattgcttggctggtgaagggaagggggcacggtgagggtaccttcactagtgacgtgtcatcttaccttgaggaacaggcggctaaggagtttattgcatggctcgtgaagggccgaggacatggtgaaggcacattcacttctgatgtcagtagctatctggaagaacaggccgcaaaggaattcatcgcctggctggtcaagggtcgcggacacggcgagggtaccttcacaagtgatgtgagttcatacttggaagaacaggctgccaaggaattcattgcttggctggttaaaggcagggggcacggagaggggacctttacatctgacgtaagctcttaccttgaggagcaagccgcgaaagaatttatcgcctggcttgtgaagggcagaggacacggtgaaggaaccttcactagcgacgtgagcagctacttggaggagcaggcagccaaagagttcatcgcctggctcgtgaagggtagaggtcacggcgaaggtaccttcacatccgacgtttcttcatacttggaggagcaggctgccaaagaatttattgcgtggctggtcaaggggcgcggtcacggtgaaggcacattcacctctgatgtttcatcttatctcgaagaacaagcagccaaggagttcatcgcctggttggtcaagggaagagggcacggtgaaggaacattcactagtgatgtgagtagttaccttgaggagcaggcggcaaaagaatttatcgcctggctcgtgaaaggccggggccatggggagggaacatttacttccgacgtgtccagctaccttgaagaacaggccgccaaggaatttattgcttggctggtcaagggccgcgggggagggggcggaggcggttctggcggggggggttccggtggtggcggctccgccgagtccaagtatggacctccttgccctccttgccctgcaccagaggccgctggggggccttccgttttcctttttccaccaaagcctaaggacacccttatgatcagcagaacacccgaggtaacttgtgtggtcgtcgatgtgtctcaagaggaccccgaagtccagttcaattggtacgtggatggagtggaggtgcataacgctaaaacgaagcccagggaagagcagttcaacagcacttatagggttgtgtctgtgctgaccgtcctccaccaggattggctcaacgggaaagagtacaagtgcaaggtcagcaataaggggctcccctccagcatcgaaaaaacaatttctaaggcaaaggggcagcctagggagccgcaggtgtacactctgcccccatcccaggaagaaatgacgaaaaatcaggtcagtctcacttgccttgtcaaggggttttacccgtcagatatagcagttgaatgggaaagcaatgggcagccggagaacaattataaaacaactccacctgtgctggatagcgacggtagcttctttctgtattccaggctgacagtggacaagtccagatggcaggaggggaatgtgttcagctgtagcgtgatgcatgaagccttgcacaatcactacactcagaagtccctgagcctctcactgggg

SEQ ID NO: 15759 - DNA, 1740 bp, Artificial Sequence
  Description of Artificial Sequence: Synthetic coding sequence
atgaaatgggtgtcatttatctcgctgctctttctcttttcgtcggcctactccgggagccttgataagcgccatggagagggtacctttacctcagacgtctcgtcatacctcgaagaacaagcagctaaagagtttatcgcttggctggtcaagggtcgcggtcatggagaaggaacctttacttcggatgtgagttcctatttggaagagcaggcggcgaaagagtttatagcctggcttgtcaagggcagagggcatggggaaggcacgtttacttctgatgtgtcatcatacttggaagaacaggccgcgaaggaattcatagcatggcttgttaagggacggggtcacggagaagggacgtttacgagtgacgtgagttcatacctcgaggaacaagcagcgaaggagttcatcgcctggctggtaaaaggaagaggtcacggggaagggacctttacttccgatgtctcctcctaccttgaggagcaggcagctaaagaattcattgcctggcttgtgaagggtcgaggccacggggaggggacttttacgtcggacgtctcctcgtatctcgaggaacaggccgctaaggagtttattgcctggctcgttaagggtaggggtcatggtgagggaacctttaccagcgatgtgtcctcctatctggaagaacaagccgcaaaagaattcatcgcatggcttgtaaaagggagaggtcatggcgagggaactttcaccagtgatgtcagctcctacttggaagagcaagcggccaaagagttcattgcttggcttgtaaagggtcgtggtcatggtgaaggcaccttcacctcggacgtgagcagctacctcgaagagcaggcagcaaaggaattcattgcatggctggtgaagggcagaggacacggcgaagggactttcactagcgatgtgtcgtcatacctggaggagcaagcagcaaaggagtttatcgcctggttggtgaagggccgaggaggtggaggaggagggggctcgggcggaggaggttccggaggtggcggatccgcagagtccaagtacggacccccttgccctccctgtccagcaccagaagcagccggaggtccgtcggtctttctctttcccccaaagcctaaggacactctgatgattagcagaactcctgaggtgacgtgtgttgtggtcgatgtgagccaggaagatcccgaagtccaattcaactggtacgtggacggtgtcgaagtgcacaacgcaaaaaccaaaccacgcgaagaacaattcaactcgacctaccgggtcgtgtccgtgctgacggtcctgcatcaggattggcttaatgggaaagaatacaagtgtaaggtgtcgaacaaggggctgcctagttctattgaaaagaccatatccaaggcaaagggtcagcctcgggagccgcaagtgtacacccttccgccttctcaagaggagatgactaagaatcaggtgtccctgacctgtttggtgaaaggattttacccatcagatattgcagtggaatgggaatcgaatggacaaccagaaaacaactacaaaactactcctccagtgctggacagcgacggttcgttctttctgtactccaggctcaccgtggataaaagcaggtggcaagaaggcaacgtgttctcctgctctgtcatgcacgaagcacttcataatcattacacccaaaagagcctttcactgtcgcttgga

SEQ ID NO: 15760 - DNA, 1740 bp, Artificial Sequence
  Description of Artificial Sequence: Synthetic coding sequence
atgaagtgggtgtccttcatctccctgctgtttttgtttagtagcgcctattcaggctccctggataaaaggcacggcgaggggacattcactagcgatgtctcttcctatttggaggaacaggctgcgaaagagttcattgcgtggctggtgaaggggcgaggccacggcgagggaaccttcactagtgacgtctcgtcttatctcgaggagcaggccgctaaggaattcattgcctggcttgttaaaggccggggacatggagaggggaccttcacttcagacgtgtcctcatatttagaggagcaggccgccaaagagttcatagcttggttagtcaaaggacggggtcacggcgagggcacctttacaagcgacgttagctcttacctcgaagaacaggctgcgaaagagttcatcgcctggttggtcaagggccggggccacggtgaagggacgttcacaagtgacgtcagctcttacctagaggagcaggccgccaaggaattcattgcctggttagtgaaaggtagggggcatggagaaggcacttttaccagcgacgtgtcttcgtacctggaggaacaagcagctaaagaatttatcgcatggctcgtcaagggtcgcgggcatggcgaaggaacattcaccagcgatgtctcaagctatctggaagaacaagccgcgaaggagtttattgcttggctggtgaagggtagggggcacggcgaagggacatttacaagcgatgtttcctcgtatcttgaggaacaggcagcgaaagaattcatcgcctggctcgtgaaggggcgcggccacggagagggaaccttcacatctgatgtctcctcttacttggaagaacaggccgctaaggagttcattgcctggttagtcaaaggccgagggcatggggagggaacatttacctcagacgtgtccagctatctggaagagcaggcagctaaggaattcatcgcgtggttagtaaaaggtaggggcggaggagggggcggcggatctggcggaggcggaagcggtgggggcgggagtgctgaatccaagtatgggccaccttgtccgccatgtccagcacctgaggcagccggtgggccttctgtgttcttgttcccccccaaaccaaaagacactctgatgatatctagaacccctgaagtcacatgcgtggtggttgacgttagccaggaggaccccgaggtgcagtttaactggtacgtggatggcgttgaggttcataatgctaagacaaaaccgagggaagagcagttcaattctacatacagggtcgtttcagttctgaccgtgctacaccaggattggttaaatgggaaggagtacaaatgcaaggtgagcaacaaaggtttacccagctccatcgaaaagaccatttccaaggccaaggggcaacccagggagccacaagtatacactttgccccctagtcaagaagagatgactaagaatcaggtcagtctcacttgcctggtgaaggggttttacccctccgacattgccgtcgaatgggagagcaacggacagcccgagaacaactacaagactactccccccgtgctcgactctgatgggagcttcttcctttactcacggctgactgtggataagagccgctggcaggaagggaatgtcttctcctgcagcgtgatgcatgaggctctgcacaaccattatacccagaaaagtctgtccttgtcgctgggt

SEQ ID NO: 15761 - DNA, 1740 bp, Artificial Sequence
  Description of Artificial Sequence: Synthetic coding sequence
atgaaatgggtaagttttatctcccttttgttcctcttcagctcagcttattccggttctttggacaaacgtcacggagagggaaccttcactagtgacgtgagctcctacctggaggagcaggccgccaaggaatttatcgcctggctggtcaagggaagaggccatggcgaaggaaccttcacatccgatgtgtcttcatacctggaggaacaggcagccaaggagttcattgcctggcttgtcaagggaaggggtcatggtgagggcactttcaccagtgacgtttcatcttacctggaggagcaagccgcaaaggagttcatagcctggctggtaaaaggcaggggacacggtgaaggcacattcacatccgatgtaagtagttaccttgaagagcaagccgccaaggagtttatcgcttggctggtcaagggccgtggccacggtgaaggaactttcacctcagacgtctcatcatacctggaggaacaggccgctaaagagttcatcgcctggctggtcaagggacgcggccacggtgaaggcacattcacatctgacgtgtcctcatacctggaggaacaggctgctaaggagtttattgcctggttggtcaagggtcgcggccacggtgagggtaccttcacttcagatgtcagcagttatttggaggaacaggctgcaaaagagtttattgcttggctcgtaaagggtaggggacacggcgaaggaactttcacatccgacgtcagctcctacctggaggagcaggctgcaaaggagttcattgcatggctcgttaaaggtaggggtcacggcgagggaacattcacttctgatgtaagcagttacctggaagagcaggccgccaaagagttcatcgcttggcttgttaaaggccgcggccacggagaaggtactttcacttcagacgtttcatcctacttggaggagcaggctgctaaggagttcatcgcatggcttgtgaagggaagaggtggaggaggtggaggcggcagcggcggaggcggctctggtggaggcggctctgccgagagcaagtacggaccaccctgccctccctgtcctgctccagaggctgccggaggaccatctgtttttctcttcccacctaaacctaaggacacacttatgatatcccgcacccccgaggtaacctgcgttgtcgtcgacgtctcacaggaggatccagaggtgcaattcaactggtacgtggatggagtggaggtacataacgccaagaccaagcccagagaagaacagtttaatagcacctaccgcgtagtcagcgtgctgactgtactgcaccaagactggctgaatggaaaggagtacaagtgtaaggtgtccaacaagggcctgccatcctccatcgaaaagaccatctctaaagccaaaggacaacccagggagccacaggtgtatactctgccccccagccaagaagagatgactaaaaaccaagtgtccctcacttgccttgtgaagggattttacccttctgacattgccgtagagtgggaatctaacggccagccagagaacaactacaaaaccacaccaccagttttggacagtgatggaagtttttttctgtattcacgcctgacagtggataaatcccgctggcaggaaggaaacgtcttctcttgctcagtaatgcatgaggctcttcataaccactatacccagaaatctttgtcactctcccttgga

SEQ ID NO: 15762 - DNA, 1740 bp, Artificial Sequence
  Description of Artificial Sequence: Synthetic coding sequence
atgaagtgggtgtcgttcatttctctcttgtttctgttttcaagtgcctacagcggttccctggacaagcgtcatggagaagggacctttacaagcgacgtgagttcgtaccttgaggagcaggccgcgaaagaatttattgcttggctcgtgaaagggaggggacacggagagggaacattcaccagtgacgtaagtagttacctggaggaacaggcggcaaaggagttcattgcctggttggtcaaaggacgtggacacggtgagggcacctttacaagcgacgtctcttcatacttggaggagcaggccgctaaagagtttatcgcctggttggtgaaagggcgcggtcatggggaaggtacattcacatcagatgtttcttcgtacctagaagagcaagccgccaaggagtttattgcctggcttgtcaaagggcggggccacggagagggaacatttacatcagacgtgtcgtcctaccttgaagaacaagcggccaaggagtttattgcctggctagtgaagggtcgtggccacggagaggggacatttacttctgatgtaagcagttatctggaggaacaggccgccaaagaatttatcgcgtggctggtcaagggaagaggccacggggaaggaacatttacaagcgatgtctcatcctacctggaggagcaggccgcaaaagaatttattgcttggctcgttaagggccgtggacatggtgagggaaccttcacaagtgatgtgagctcctacttagaggaacaagcagccaaagagtttatcgcctggcttgtcaaaggacgggggcacggagagggcacatttaccagcgatgtgagctcttacctcgaggagcaggcagctaaagagttcatcgcctggctggtgaaagggaggggccacggggaggggaccttcacaagtgatgtctcgagttatctggaggagcaggccgctaaggaattcatcgcctggctagtaaaagggcgcggaggcggaggcgggggaggctccggcggtggagggtcggggggcggagggtctgctgagtccaagtatgggccgccttgtcccccatgtccagcacctgaggccgccggcggtccttccgtcttcctgttccctcccaaacccaaagatactctgatgattagcaggaccccagaggtgacttgtgttgtggtagatgtatcacaagaagaccctgaagttcaattcaactggtatgttgatggggtcgaggtgcacaacgcaaaaaccaaacctcgagaggaacagtttaactcaacctacagagtcgtcagcgtgctgactgtcctgcaccaagactggctgaacggaaaggagtacaagtgtaaagttagcaataagggacttccgagttccatagaaaagactatttctaaggcgaagggccagcctagggaaccacaggtgtatacattgccaccaagccaggaggagatgaccaaaaaccaagttagtctgacttgcctggtaaagggtttctacccaagtgatattgctgttgagtgggagtccaacggtcagccagagaataattacaaaaccactccccctgtactggactctgatgggtcattcttcttgtactctaggctgactgttgataagtctcggtggcaggaaggaaacgtgtttagttgcagtgtcatgcacgaggccctgcacaatcactatacccagaagtcactttcactgagcctcggg

SEQ ID NO: 15763 - DNA, 1740 bp, Artificial Sequence
  Description of Artificial Sequence: Synthetic coding sequence
atgaaatgggtgagcttcatttctcttctgttcctcttcagctctgcttattctggctcactggataaaagacacggagagggtacatttaccagcgacgtgtcatcatatctggaggagcaagctgccaaggagtttattgcctggctggtcaagggccgaggccatggagaaggaactttcaccagtgacgtgtcgtcgtacctggaggagcaggcagcgaaagagttcatcgcttggttagtgaagggacgcgggcacggggaaggcacattcacctcagacgtgtcgagctacttggaagagcaggccgccaaagaattcatagcttggctggtgaaagggcgcggtcatggcgaaggcacctttactagcgatgtgtcttcctacctggaggagcaggccgccaaggagtttatcgcttggctggtaaaaggcaggggccacggcgaaggcacgttcaccagtgacgtgtcatcttatttggaggagcaggcagcgaaagagttcatcgcctggctagtgaaaggtcgcggtcatggtgagggaacattcactagcgacgtctcatcttatctcgaagagcaggccgcgaaagaattcatcgcctggctagttaagggcagaggccatggcgagggcacattcacctccgacgtatcatcatatttggaagagcaagcagcgaaagagttcattgcttggctggtcaaagggcgcggtcacggcgaggggactttcacaagcgatgtctcgtcatacttggaggagcaggccgccaaagagttcatcgcctggcttgtgaaaggccgggggcatggggagggcacatttactagcgacgtgagttcctacctcgaggaacaggcagcaaaggaattcatagcttggcttgtcaagggaaggggtcatggcgaggggactttcacttcggatgttagttcgtacctggaagaacaggctgctaaggaattcattgcttggcttgtgaagggacggggcgggggtggcggcggtggaagcggaggtggcggatccggtggggggggcagcgcggaaagcaaatatggtcctccctgccctccctgccctgcaccggaagctgccggaggcccaagcgtatttcttttcccacccaaaccgaaggacactctgatgattagcagaactcctgaagtgacatgcgtggtggtggacgtctctcaggaggatccagaggttcagttcaactggtatgtagatggcgtggaggtacacaacgcaaagacgaagccgcgcgaggagcagttcaacagcacctaccgggtggtctccgtcctcactgttctgcatcaggactggttgaacggtaaggaatataagtgcaaagtctccaacaagggtttgcccagttccatcgagaaaaccatcagcaaggcaaaggggcagcctagggaaccccaggtgtacaccctccctccaagccaagaggaaatgaccaagaaccaagtgagccttacttgcctggtcaaagggttttacccctcggacatcgctgtggagtgggaatctaatggtcagcccgaaaataattacaagaccactccacccgtcctggattcagacggatccttcttcctctactctcgactgaccgtggacaagtctcggtggcaagaggggaacgtgttctcttgctctgtaatgcacgaagcattgcataatcattacacacagaagtctctgagtctgagtttggga

SEQ ID NO: 15764 - DNA, 1740 bp, Artificial Sequence
  Description of Artificial Sequence: Synthetic coding sequence
atgaagtgggtgtccttcatctcgttgctgtttttgttttcctccgcatacagcggttccttggataaacgccacggggagggtacttttacgtcggacgtgtcgtcataccttgaagaacaagctgcgaaggaattcatcgcctggctggtgaaaggaagaggtcatggtgaaggtacctttacctcggacgtgtcatcttaccttgaggaacaagcggcgaaggagtttatagcatggttggtcaaggggcgtggacatggcgaaggaacttttacttcggacgtcagctcctatctcgaagaacaagctgcaaaggagttcatcgcgtggctcgttaagggtaggggtcatggagagggaacttttacctcggatgtctcgtcatacctcgaggaacaggcagcaaaggaattcatagcatggctggttaagggacgcggacacggggagggaacctttaccagcgacgtgtcctcatatctggaagagcaggccgcaaaagagtttatcgcatggttggtgaaagggcgcggtcatggggagggaacgttcacctcagacgtgagctcctatctggaagagcaggctgccaaggagtttatcgcgtggctggttaagggccggggacacggcgaaggaacctttacgtcggacgtttccagctacttggaagaacaggctgcaaaagagtttatcgcatggctcgtcaagggtcgggggcatggagagggcaccttcacgtctgatgtgtcctcataccttgaggagcaggcagctaaggagttcatagcctggctggttaaaggtaggggtcatggcgaagggacttttacctcagacgtctcttcgtacctcgaagagcaggcggcaaaggagttcatagcgtggctggtcaaaggtcgaggacacggcgaaggtactttcacttctgatgtctcgtcgtacctcgaagagcaggcagcaaaagaattcatcgcatggcttgtgaagggtcgtgggggaggtggcggcggaggctcagggggaggaggatcgggaggaggaggatccgcagaatcaaagtacgggccaccatgtcctccttgccctgcccccgaggccgcgggcgggccttccgtgttcctgtttccgcccaaacctaaagatacccttatgatttcgagaaccccagaagtgacttgtgtggtggtggatgtgtcccaggaagatcccgaagtccagtttaactggtatgtcgatggtgtggaagtccataatgccaagaccaagcctcgggaagaacaattcaactctacctaccgggtggtgtccgttcttaccgtgctgcaccaagattggcttaatggaaaggaatacaagtgtaaggtgtcaaacaagggtctgccatcctcaattgaaaagaccatttcgaaggccaaaggacagccaagagaaccgcaagtgtacaccctgccgccctcgcaagaagaaatgactaagaatcaagtgtcactgacttgcttggtcaaaggcttttaccctagcgacattgcagtggaatgggaatcgaacggccaacccgagaataactacaagactactcctccagtgcttgattccgatggttcgttttttctttactcaagactcactgtggataagtccagatggcaagaaggtaacgtcttttcgtgttctgtgatgcacgaagcccttcataatcattacactcaaaagagcctgagcctgtcccttgga

SEQ ID NO: 15765 - DNA, 1740 bp, Artificial Sequence
  Description of Artificial Sequence: Synthetic coding sequence
atgaagtgggtgtccttcattagccttctgtttcttttttcctcggcatactcaggcagcttggacaaacggcatggagaaggcacctttacctcggatgtgtcctcataccttgaggaacaagcggccaaagagttcatcgcttggctggtcaaaggacgagggcatggtgaaggcacttttacttccgacgtctcatcgtaccttgaagaacaggcagcaaaagagtttatagcctggttggttaaaggtagaggacacggtgagggtacgtttacgagcgatgtctcctcctacctggaggagcaagctgctaaggaattcattgcatggctcgtgaaggggcgcggccatggagaaggtacctttacctcagatgtctcatcatacttggaagagcaagcggctaaggagtttatcgcctggctcgtgaaaggtcgaggacatggtgaaggaacttttacctcggacgtgtcctcgtatctggaggagcaggcagccaaagaattcatagcatggctcgttaagggaagagggcacggtgaaggaacctttacgtcagacgtgtccagttaccttgaagagcaggccgcaaaagaattcattgcctggctggttaaggggagaggacatggagaggggactttcacctcggatgttagctcgtatctcgaagagcaggcagctaaagagtttattgcgtggttggtcaagggtcgcggacacggggagggcaccttcaccagtgatgtgagcagctacctcgaagaacaagccgcaaaggagttcatcgcgtggcttgtcaaaggtaggggtcatggcgaggggacgttcaccagcgacgtatcgagttacttggaggaacaggctgccaaggagttcattgcttggctggtgaaaggaagaggccacggtgagggaacttttactagcgacgtgtcgtcctatcttgaagaacaagcagcgaaggaattcatcgcatggctggttaaaggaaggggtggaggaggtggaggaggaagcggcggcggcggctccggaggaggtgggtcggccgaatcgaagtacggtccaccttgtcctccctgccccgcacctgaagccgcaggtgggccatccgtgtttctttttccaccgaagcctaaggacactctgatgatcagcagaaccccggaagtcacgtgtgtggtggtggatgtgagccaagaagatcctgaggtgcaattcaactggtacgtggacggcgtggaggtacacaacgcaaagactaagccacgggaagaacaattcaattcgacttaccgtgtcgtctcagtgcttaccgtgctccatcaagattggcttaacgggaaggaatacaagtgtaaggtttcaaacaagggactcccctcgtccattgaaaagaccatctcaaaggcaaagggacaaccacgtgagcctcaggtctacacccttccacccagccaggaagaaatgactaagaaccaggtgtcgctcacctgtctcgtcaagggcttttatccttcggacattgccgtggaatgggagagcaatgggcaacccgagaacaattacaagactacccctccagtgctcgattcagatggaagtttctttctctactcccgcctgactgtcgataaaagccggtggcaggaaggaaacgtcttttcatgctctgtgatgcatgaggcactgcataatcactacacgcaaaagagcctgtccctgtcccttggc

SEQ ID NO: 15766 - DNA, 1740 bp, Artificial Sequence
  Description of Artificial Sequence: Synthetic coding sequence
atgaaatgggtttctttcatttcacttctatttctgtttagtagcgcctattcaggttcgcttgataaaagacatggagaggggacgtttacgtccgatgttagttcatacctcgaagaacaagctgcaaaggaattcattgcctggcttgtcaaaggacgaggacatggagagggaacgttcacgtcagacgtttcatcatatctcgaagaacaagctgctaaagaattcatagcatggctggttaaaggcagaggccatggcgagggaacgtttacgtcagatgtttcatcgtacctggaagaacaagcagccaaagaattcattgcctggttggtgaaagggaggggacatggagagggaactttcactagtgatgttagtagctacctagaagagcaggcagcgaaagaattcattgcgtggcttgtaaaaggtcgagggcatggagaaggtactttcacttctgatgtttcgtcttacttggaagagcaagcggccaaggagttcatcgcctggttggttaagggacgaggacatggagaaggaacgtttactagcgatgtttcatcttaccttgaagaacaagcagcaaaagagtttattgcttggcttgttaagggcagaggacatggggaaggaacattcacgagtgatgtgtcaagctacctcgaggagcaggccgccaaggagtttatcgcttggttggttaaaggtcgcggacatggtgaaggaacattcacctcagatgtttcgtcgtatttggaagaacaagccgctaaagagttcattgcctggctggtcaaagggagaggacacggcgagggtacatttaccagtgatgtatcgtcgtaccttgaagaacaagctgcaaaggagtttattgcgtggttggttaaaggtcgaggtcatggagaaggaacctttacgtctgatgtttcatcttatcttgaagaacaagctgcgaaagaatttatagcgtggttggtcaaagggcggggaggtggaggaggaggaggctcaggaggtggtggaagcggaggaggaggatccgctgagtccaaatatggtcctccatgccccccgtgcccagcaccagaagcagcggggggcccatcagtgttcctgtttccacctaaaccaaaagatactcttatgatatcaagaactccggaggtcacttgcgtagtggtagatgtatcacaagaagatcctgaggttcagtttaattggtatgttgacggtgtcgaagttcacaacgcaaaaaccaagccacgtgaggaacaatttaatagtacttatcgcgtcgtttctgttcttacagtcctacatcaggattggctaaacggcaaagagtataaatgtaaagtttccaacaaaggattgccatcatcgatagagaagacaatcagtaaggccaagggccaacctcgggaacctcaggtgtacacgcttcctccatcgcaagaggaaatgaccaaaaatcaagtctcgttgacgtgtcttgtgaagggattctacccgtcggacattgctgtagagtgggagtcaaatggccaaccggaaaataactacaagactaccccgcctgtactcgattcagatggttcgttcttcctgtattcaagactcaccgtggacaaatcccggtggcaagagggcaatgtcttcagttgttccgtgatgcatgaagcactccataatcattacactcaaaaatccttatcgcttagtttggga

SEQ ID NO: 15767 - DNA, 1740 bp, Artificial Sequence
  Description of Artificial Sequence: Synthetic coding sequence
atgaagtgggtttcctttatctcactcttgttcctgttttcctcagcctacagcggatctctggacaagagacacggtgaaggcacatttacgagtgatgtcagcagctatctggaggaacaggccgctaaagaattcatcgcgtggttggtgaaaggtcgcgggcatggggagggtacctttacaagcgacgtgtcttcttatttggaggagcaggcagcgaaagagttcatcgcctggctggtaaagggtcggggacatggcgaggggacctttaccagcgatgtcagttcttacttggaggagcaggcggctaaggagttcatcgcctggctggttaaagggaggggccacggcgagggcacatttactagcgatgtgagctcttacttggaagagcaggctgcgaaggagtttatcgcatggctggtcaaaggcagaggccatggcgagggcaccttcacctcagatgtgtcttcatacctggaagaacaggccgctaaagaatttatcgcttggctcgtgaagggcaggggacatggtgaagggacatttacttccgacgtgtccagctatcttgaggaacaggcagccaaagaatttatcgcctggctggtgaaagggcgaggccatggggaagggacattcacgagcgatgtttcttcttacctggaagagcaagctgcgaaggagtttatcgcatggctcgtcaagggtcggggtcatggagaaggcaccttcactagcgacgtgagtagttatttggaagagcaggcagctaaagagttcatcgcttggctggtaaagggccgggggcacggcgagggcactttcacttctgacgtgtcatcatacctggaggagcaggcagccaaggaattcattgcttggctggttaagggaagagggcatggagaagggaccttcacctctgatgtgagttcttacctggaagagcaggcagcaaaggaattcatagcgtggctggtgaagggtagaggaggaggtggggggggtgggagcggagggggcggttcagggggcgggggctcagcagagtccaaatacgggccaccctgcccaccctgtcccgctcctgaggcagctggcgggccctccgtgtttctcttccccccgaagcccaaagatacactgatgatcagccggacaccagaagtgacttgcgttgtggtcgatgtatctcaggaggatccagaagttcagtttaactggtacgtggacggagtcgaggtccacaacgcaaagacaaagcctagagaagagcaatttaattccacctatcgcgtcgtgtctgtgctcaccgttctgcatcaagattggctcaatggcaaagagtataaatgcaaggtgagcaataaagggcttcctagctctatcgagaagactatatccaaagcaaaggggcagccaagggagccccaggtgtatactctccccccgtcacaggaggagatgacaaaaaaccaggtaagtctgacttgtctggtgaagggtttttacccgagcgacatagccgtggagtgggaaagcaatggccagccagaaaacaattataagactacaccacctgtattggatagcgacggatcattcttcctgtacagtcgactgactgtcgataaatccagatggcaggaaggcaatgtgtttagttgtagcgtaatgcacgaggctcttcataaccactacacacagaagtctctgagcctgagtctcgga

SEQ ID NO: 15768 - DNA, 1740 bp, Artificial Sequence
  Description of Artificial Sequence: Synthetic coding sequence
atgaagtgggtgagcttcatctcgctgctgtttctgttctcgagcgcctactccggatccctggataagcgccatggtgaagggaccttcacgagcgatgtatcatcatacctcgaggaacaggccgcaaaagaattcatagcatggcttgtgaaaggccgcggtcacggcgaaggcacttttacctcggacgtatcatcctacttggaggaacaagcagctaaggagttcatcgcttggctcgttaagggtagaggacatggcgaggggactttcacttcggacgtgagcagctacctggaggaacaggctgccaaggagtttattgcttggcttgtcaaagggcgggggcatggcgaaggcacctttacctctgatgtctcgagctatttggaggagcaggcggcgaaagagtttattgcctggctcgtgaaggggcgcggacacggcgaaggaacctttacctcagacgtgtcgtcgtatctggaagaacaggccgctaaagagttcatcgcgtggctggtcaagggacgtggccacggggaagggactttcacctcagatgtgagtagttacctggaagagcaggccgcgaaggaattcatcgcatggctggtaaagggccgaggacatggagaaggtacgtttaccagcgacgtttcctcgtatcttgaggagcaagccgctaaggaattcattgcatggttggttaagggacggggtcacggtgagggaactttcacttccgacgtgtcatcataccttgaggaacaggcagccaaggagttcattgcgtggctggtgaaaggtcgcggtcacggagaaggaaccttcaccagcgatgtgagtagctacttggaagaacaagcggccaaagagtttatcgcgtggttggtcaagggccggggacacggggagggaaccttcacttcagatgtcagcagctacctcgaggagcaggccgccaaagaattcatcgcctggctggtcaaaggaagagggggaggcggaggaggagggtccggaggaggcggctcaggtggagggggatcggccgaaagcaagtacggtccgccgtgtcctccgtgcccggcgcccgaggctgcaggaggcccgtctgtgtttctgttccctcctaagccaaaggacaccctgatgatctcgaggactcctgaagtgacgtgtgtcgttgtggacgtgagccaggaagatccagaagttcagttcaattggtacgtggacggtgtggaagtgcataacgcaaagaccaagccacgcgaagaacagttcaacagcacctaccgggtggtgtccgtgctcactgtccttcaccaggactggctcaatggaaaagagtacaagtgcaaggtgtcgaataaaggactcccctcctccatcgagaaaaccatctcgaaggccaagggccaaccgcgggagcctcaggtctacacgctcccaccgtcacaggaagaaatgactaaaaaccaagtgtccctgacctgcctggtcaaaggcttttacccgtcggacatcgcggtggagtgggaatcaaacggacaaccagagaacaactacaagactactcccccagtgctggactccgacggatccttcttcctgtactccagactcacggtggataagtcccgctggcaggaggggaatgtgttctcgtgctctgtgatgcacgaggcgcttcacaaccattacactcaaaagtcgttgtccctgtccctcggg

SEQ ID NO: 15769 - DNA, 1740 bp, Artificial Sequence
  Description of Artificial Sequence: Synthetic coding sequence
atgaagtgggtcagcttcatctcgctcttgtttctgttctcaagcgcatactcaggatccctggacaaaagacatggggaagggacctttacgtcagacgtttcatcataccttgaggaacaggcggcaaaggagtttatcgcctggttggtcaagggcaggggacatggcgagggcaccttcacttccgatgtgagctcgtacctcgaggaacaggcagccaaggagttcatcgcatggctcgtcaagggtcgcggacacggcgaaggaaccttcacgtccgacgtgagctcatatttggaagaacaagccgcaaaggaattcatcgcatggctcgtgaaggggcggggacacggagaaggaaccttcacctcagacgtttcctcatacttggaagagcaggccgcgaaagagtttatcgcatggctggtgaaaggacggggacacggagaaggaacctttactagcgatgtctcatcttatctggaagaacaggccgccaaggagttcatcgcgtggcttgtcaagggtcgaggacatggagaaggtacctttacctccgatgtctcctcctacctcgaagaacaggcagcaaaagaattcatcgcctggctcgtgaagggaaggggacatggagaaggaacctttacctcggatgtgtctagctacctcgaggagcaggccgccaaggagtttatagcctggctggttaaaggccgcggacacggggaaggaaccttcacgtccgatgtctcaagctatctggaggagcaagcggcaaaggagtttatcgcttggcttgtcaagggccggggtcacggtgagggaactttcacttccgatgtgagctcctacttggaggagcaagccgctaaggagttcatcgcatggctggtgaagggccggggacatggcgaaggcactttcacctccgacgtcagctcctaccttgaggagcaagcggccaaggagttcatcgcctggctggtgaaaggacgcggaggaggcggagggggcggatccggtggcgggggctcaggtggtggaggaagcgcagagtcgaagtacggacccccatgtccaccgtgcccggctccggaagcggcgggaggaccatcggtgttcttgttcccgccgaaaccgaaagacactctcatgatttcgagaaccccagaggtgacttgcgtggtggtcgacgtttcacaagaggacccggaagtgcagttcaattggtatgtggacggggtggaagtgcacaacgcgaaaactaagccacgcgaagagcaattcaactccacgtatcgcgttgtgtccgtcctgactgtcctccaccaagactggctcaatgggaaagaatacaagtgcaaggtgtccaataagggactgccgtccagcatcgaaaagactatctcgaaggccaagggccagcctcgggaaccgcaggtgtacacgctgcctccatcgcaggaggaaatgacgaagaaccaagtgagcctgacttgcctggtcaaaggattctacccttcggacatcgcggtggagtgggaatccaacggccaaccggagaataactacaagactacccctccggtcctggactccgacggatcgttttttctctacagccgcctcaccgtcgataagagcagatggcaagagggtaacgtgttctcctgcagcgtgatgcatgaggccctgcacaaccactacacccaaaagtcgctgtcgctttccctggga

SEQ ID NO: 15770 - DNA, 1740 bp, Artificial Sequence
  Description of Artificial Sequence: Synthetic coding sequence
atgaaatgggtgagcttcatcagcctgttgttcctcttctccagcgcgtattcgggatcactcgataaacggcatggagaaggaacgttcacctcggacgtctcttcataccttgaggagcaggccgcgaaagaattcatcgcgtggctcgtcaagggacgcgggcacggcgaaggaacctttacttccgacgtatcctcgtacctggaagaacaggccgccaaagagtttattgcctggctggtgaagggacgcggacatggtgagggcacgtttacctcggacgtaagctcctacctcgaagaacaagcggctaaagagttcatcgcatggctggttaaaggaagaggccacggcgaagggacttttacttccgatgtctcgtcttacttggaggaacaagcagctaaggagtttatagcatggttggtaaaggggcgcggacatggcgaaggcactttcactagcgacgtttcatcctacctggaggagcaggctgccaaggagtttatcgcgtggctggtcaagggtagaggccatggcgagggtaccttcacctcggatgtgtcgtcatatcttgaagaacaggctgcaaaagagtttatcgcctggcttgtgaagggacggggacacggagaagggactttcaccagtgatgtgtcgagttaccttgaggaacaggcggccaaagaattcattgcatggctcgtgaagggtcgggggcatggggagggcacctttaccagcgacgtctctagctaccttgaagaacaagctgctaaggagttcatcgcttggttggtgaagggtcgcggacacggagagggaactttcacgtctgacgttagctcctatttggaagagcaggcagcaaaggaattcattgcctggcttgtcaagggccgtggtcacggtgagggaaccttcacttcagatgtgtcaagctacctggaagagcaagccgcgaaggaattcatcgcctggttggtcaaaggtcgcggaggaggcggaggtggaggtagcggcggaggagggagcgggggcggcggatcagccgaatccaagtacggtccaccgtgcccaccttgcccggctcctgaggcggccggcggaccctcggtctttctcttccctccgaagccaaaggacactctgatgatctcccgcactccggaagtcacctgtgtggtcgtcgatgtgagccaagaggacccggaggtgcagttcaactggtacgtcgacggggtggaggtgcacaatgcaaagaccaaaccaagagaagaacagttcaacagcacttaccgggtggtgtcggtgctcactgtgctgcatcaggactggttgaatggaaaagagtacaagtgcaaggtgtccaacaaggggctgccgtcctccatcgaaaagaccatctcgaaggcgaagggacaaccgcgggagccacaggtgtacacgttgcctccctcccaggaagagatgaccaaaaatcaagtgtccctgacgtgtctggtgaagggcttttacccgtccgacatcgccgtggaatgggagtcgaacggtcaaccagagaacaactacaagaccacgcccccggtgctggacagcgatgggtcgttcttcctttactcaaggctgaccgtggataagtctaggtggcaggaaggcaacgttttctcgtgcagtgtcatgcacgaagccctgcacaatcactacactcagaagtcgctgtccctctcactggga

SEQ ID NO: 15771 - DNA, 1740 bp, Artificial Sequence
  Description of Artificial Sequence: Synthetic coding sequence
atgaagtgggtgtctttcatttcactactgttcctgtttagctccgcctactctggatcacttgacaagcgacacggcgagggtactttcacgagtgacgtgtccagctacctcgaggaacaggctgccaaagaatttattgcgtggctcgtgaaaggccgtgggcacggggaaggaacctttaccagtgatgtttcgagttatctggaggagcaggctgcaaaagaatttatcgcttggttggtcaaagggcgaggacatggagaaggcaccttcacatccgacgtgtcctcatatttggaggaacaggctgcaaaggaattcatcgcctggttagtcaaaggtagagggcatggggagggcacgtttacgtcggatgtgtcttcctatctcgaagagcaggctgcaaaagagttcatcgcttggctagtcaaaggcagggggcatggggaggggacatttacaagtgacgtgtcttcatatcttgaggaacaggcagccaaagagttcatagcttggttggtcaaagggcgaggccatggtgaaggcacatttacttccgacgtgtctagttacctagaggaacaggccgccaaagaattcatcgcctggctcgtgaaagggcgtggccatggggaagggacctttacctctgatgtctccagctacctcgaggagcaggcagctaaagagtttatagcttggctggtgaaagggcgcggccatggcgaaggaaccttcacttccgatgtctcctcttatcttgaggaacaggctgcaaaagaattcattgcgtggttggtcaaggggcgcggccatggagaggggacattcacctcagacgtgtcgtcttatctcgaggaacaagcggctaaagaatttatagcctggctcgtgaagggcagggggcacggagagggaacctttacatcggacgtgtctagctatctggaggagcaagcagccaaggaattcatcgcctggctagtgaaggggaggggaggcggaggaggaggagggtccggaggcggaggaagtggcggcggcggctccgctgaaagcaaatatgggcccccctgcccaccctgccccgcacctgaagccgcgggcggtccttctgtgtttctgtttcccccgaagcccaaagataccctaatgatttccaggacccccgaggtgacttgtgtagtcgtggacgtaagccaggaggaccctgaagtgcagttcaactggtacgtggatggcgtagaagttcataatgccaagacaaaacctcgagaagagcaattcaacagcacgtaccgggtcgtctcagttttaacagttctgcaccaggattggctcaatggtaaagaatacaaatgtaaggttagtaacaaaggcctgccatcgtctatcgagaaaactatcagtaaggctaaggggcagcctcgagagccccaagtttatactcttcctcctagccaggaggaaatgactaagaaccaagtctccctgacgtgtctcgttaaggggttttacccatcagatatagccgtggagtgggagagtaacggtcagccggagaataactataaaactactccccctgtgctcgactctgatggttctttcttcctctattctaggctgacagtagacaaaagtcgatggcaggaaggtaatgtgttttcttgcagcgtgatgcacgaagccctccacaaccattatacacagaaatctctatctttgagcctggga

SEQ ID NO: 15772 - DNA, 1740 bp, Artificial Sequence
  Description of Artificial Sequence: Synthetic coding sequence
atgaaatgggtgtctttcataagcctgttgtttctgttctcttctgcgtattctggatctctcgacaaacgacatggtgagggaacatttaccagtgacgtctcgagttatctcgaagagcaggccgcaaaagagtttatagcttggcttgtaaaggggcgcggccacggcgaggggaccttcaccagcgatgtctccagttacctggaggagcaggcagcgaaggagttcattgcttggttggtgaaaggccggggccatggtgaagggactttcacctccgacgttagctcttatttggaagagcaggccgccaaggagttcatcgcttggcttgtcaaaggccgggggcatggcgaggggaccttcacctccgatgtctccagctacctagaagagcaggcagctaaagagttcatagcctggctggtcaaggggcggggccacggcgagggcacatttacgagtgatgtcagtagttatctggaggagcaggctgctaaagagttcatcgcatggctggtgaaaggcagaggacacggtgagggaaccttcacctctgatgtaagctcgtatctggaagagcaggccgcaaaagaatttatagcatggctcgtcaaaggccgcggtcatggcgaagggaccttcacatcggatgtatcctcctatttagaggaacaagccgccaaggagtttattgcatggttggtcaagggacgcgggcacggcgaaggcacctttaccagcgatgtgtccagctaccttgaagaacaggctgcgaaagagttcatcgcatggctcgtgaagggtcgggggcacggagagggtacatttacttcagatgttagctcctacctagaggagcaagcagctaaggaatttatcgcttggctcgtgaagggccgagggcacggggaaggtacctttaccagtgacgtgtcatcctacctcgaagaacaggcggctaaggagtttatcgcatggctagtgaaaggacgaggaggagggggcggcggtggatcgggtggcggtgggagtggcggcggtggcagcgccgagagtaaatatggacctccctgtccaccctgtccagcccccgaagcagctggcggcccaagcgtgttcctgtttccccctaaaccgaaagatactctgatgatttcccgcacccccgaggtgacatgcgtcgtggtggatgtcagtcaggaagaccctgaggtgcagttcaattggtatgtagatggggtggaagtgcataacgctaagacgaagcctagagaggaacagttcaattccacctaccgtgtggtgtccgtgttaaccgtgcttcaccaggattggctcaatggtaaggagtacaagtgcaaggtctccaataagggattgccaagcagcatcgagaaaacaatcagtaaggccaaaggacagccaagagagccacaggtctatacgttgcccccctctcaggaggagatgacaaagaaccaggtttccttgacgtgtctggtgaagggcttttacccatcggacattgctgtggagtgggagagcaatggacagcctgaaaacaattacaaaacaaccccgcccgtcctcgactccgacggctcttttttcctgtactcacgcctcaccgtcgataagagccgatggcaggagggtaatgtattttcctgctctgtaatgcatgaggctttgcataaccactatacccagaaatccctctctctgagtctgggg

SEQ ID NO: 15773 - DNA, 1740 bp, Artificial Sequence
  Description of Artificial Sequence: Synthetic coding sequence
atgaagtgggttagcttcatatcactcctgtttctcttttcttctgcgtacagtggcagcctagataaacgccatggggaggggacctttaccagcgatgtgagctcctatctggaggagcaggctgcaaaggagtttatcgcgtggttggttaaagggcgtggtcacggagagggaacctttacgtccgacgtatcttcctatctagaggaacaggctgcgaaggaattcattgcctggctggtcaaggggcgagggcatggcgaagggaccttcacctccgatgtatcctcatacctggaagagcaggcggccaaagagtttatcgcctggctcgtgaagggtaggggtcatggagagggtacattcactagtgatgtgtccagctacttagaggagcaagcagcaaaggaattcattgcttggttagtaaaagggcgcgggcatggagagggaaccttcacaagtgatgtttcttcttatctcgaggagcaagcggccaaggagttcatcgcatggttggttaaagggagaggccacggggagggaacttttaccagtgacgtaagctcctacctcgaagaacaggctgcaaaagaattcatcgcgtggctagtgaaaggtagagggcacggggaaggcacattcacttccgatgtgtcaagctacctggaagagcaggctgctaaggaattcatcgcatggctcgtgaaaggccgaggccacggtgagggaacgttcacctcagatgtgagttcctacctggaagagcaggccgccaaggagttcattgcctggctcgtcaaaggacgcgggcacggggaaggcacatttacgtccgacgtatccagctatctcgaggagcaggcggcgaaagagttcatcgcatggctcgtgaaaggccgggggcacggagagggaaccttcacctccgatgtgtcatcgtatctggaggagcaagccgctaaggagtttatagcatggctagttaaaggccgtggaggtggcggcggagggggttccggtggcggagggtcaggtggcggagggagtgcggaaagcaagtatggaccgccctgtccaccttgtcctgcccctgaggcagcaggaggcccttcggtgtttctgtttccccctaaacccaaagacacactgatgatatctaggactcctgaagtgacatgcgttgtggttgacgtatcgcaggaagatcccgaggtccagttcaattggtatgttgacggcgtcgaggtgcataacgcaaagactaaacctcgagaggagcaattcaactctacataccgcgtcgtatcagttctgaccgtgcttcatcaggattggcttaatggcaaggagtacaagtgcaaggtctctaacaaagggttgccttcatctattgagaagacgattagcaaagccaagggccaacctcgggaaccacaggtgtacacactcccgcctagccaagaagagatgacaaaaaaccaagtctccttaacttgcttggtgaagggattttacccttctgatatagcagttgagtgggaatcaaatggacagccagagaataattacaagaccacaccgcccgtattggacagcgacggttcgttctttctttactcccgcctcaccgtagataaatccaggtggcaggagggtaatgttttcagctgtagtgttatgcacgaagctctgcacaaccactatacccaaaagtccttgtccttgtccctgggg

SEQ ID NO: 15774 - DNA, 1740 bp, Artificial Sequence
  Description of Artificial Sequence: Synthetic coding sequence
atgaagtgggtgtccttcattagcctgctgtttctgtttagctccgcttacagcgggagccttgacaagcgtcatggggaagggacctttacttccgacgtgagttcatacctggaggaacaagccgccaaggaattcattgcctggttggtcaaagggcggggccacggggagggcacctttacgagcgatgtttctagctatttggaagaacaggcggccaaggaattcatcgcctggttagtgaagggcaggggtcacggagaaggcaccttcacttcggatgtgtcctcttatttggaagaacaggcagcgaaggaatttatcgcctggctcgtgaaaggaaggggacacggtgaaggtacctttactagtgacgtatcatcctacctggaggaacaggctgctaaggagtttattgcctggctagttaaagggcgaggacatggtgagggaacttttacttcagacgtctctagctaccttgaagagcaagctgcaaaggagttcattgcctggctggtaaaaggacgaggtcatggtgaaggtaccttcaccagcgacgtaagttcatacctcgaagaacaggccgccaaggaatttatcgcttggctggtgaagggcagaggacacggcgaaggcacttttacgtctgatgtgagctcatacctggaggaacaggccgctaaggagttcatcgcctggctcgttaagggcagaggccatggggagggcacatttacgtccgatgtgtcatcttatctggaggaacaggctgccaaggaatttatagcgtggcttgtgaaagggagaggtcatggggaagggactttcacaagtgatgtgagtagttacctggaggagcaggcggcaaaagaattcatcgcgtggctggtgaagggacgaggccatggcgagggcacatttacatcagatgtgagtagttacctggaagagcaggccgccaaagaattcatagcttggctggtgaaaggtaggggcggcggcggtggggggggtagtggtggaggggggtctgggggaggaggaagcgctgaaagtaaatacgggccaccttgccccccatgcccggctccggaggccgccggaggtccaagtgtgtttctatttccaccaaagcccaaagataccctgatgatatcccgaaccccagaagttacgtgtgtggtggtcgacgttagccaggaagatcctgaggttcagttcaactggtacgtggatggagttgaggtgcacaatgcgaagactaaaccacgagaagagcagtttaattcgacatacagggtcgtgtctgttcttacagtgcttcaccaggattggctgaacgggaaggaatataaatgtaaagtcagtaacaaaggactgccatctagcatagaaaaaaccattagcaaggctaagggacagcctagagagccccaggtgtatacgttgcccccctcccaggaggaaatgacaaagaaccaggtaagtttgacctgcctagtgaaggggttctatccttccgacattgcggtggaatgggaatcaaacggccagcctgaaaacaattataagactactcctccagtactggatagtgacggatctttttttctgtattcccgacttactgtagacaaatccagatggcaagagggaaatgtattttcatgcagtgtcatgcacgaagccctccataatcactatacccaaaagagtctctccctaagtctcgga

SEQ ID NO: 15775 - DNA, 1740 bp, Artificial Sequence
  Description of Artificial Sequence: Synthetic coding sequence
atgaagtgggtgagctttatctctcttctttttctcttctcctcagcttactcgggatcgctggacaaaagacatggggaaggtacctttactagcgatgtgtccagctacctggaagaacaggcggccaaggaattcattgcgtggttggtaaagggtcggggtcacggcgaagggacgtttaccagcgacgtcagctcttacttggaggaacaagcagctaaggagtttatcgcctggctcgtaaagggaagaggccatggcgagggtacctttaccagcgatgtttcatcctaccttgaagagcaggcggctaaggaattcatcgcttggttggttaaaggccggggtcatggagaaggtacgtttacctccgacgtgtcgtcgtatctggaagagcaagcagcgaaagagttcattgcctggctggtgaaagggcgtgggcacggtgaaggcaccttcacttccgacgtaagcagctacctcgaagagcaggccgcaaaagagtttattgcatggcttgtcaagggacggggtcacggagaaggcactttcacctccgacgtctcgtcatacctcgaagaacaagcagcaaaggagtttatagcgtggctggtcaagggccgcgggcatggagaaggaacgttcacctcggatgtttcctcatacctcgaggagcaggccgcgaaggagttcatcgcctggcttgtgaaaggacgagggcatggcgaagggacctttacgagtgacgtctcctcctatctcgaagagcaagctgccaaggagtttattgcgtggcttgttaaaggacgcggtcacggtgaaggaactttcacgtctgatgtgtcctcataccttgaggaacaggcagcaaaagaattcatagcgtggttggttaagggccgggggcatggtgaggggacctttacctctgacgtttcctcatatctcgaggagcaagccgccaaagagtttatagcatggctcgtgaagggaagaggtggtggcggcggaggtgggagcggaggtggtggtagcggtggaggaggttcagcagaaagcaaatacggacctccctgtcctccatgcccagcacctgaagccgcaggcggaccgagcgtgtttctgtttccgcctaagcctaaagatactcttatgatctcgagaacccccgaagtgacgtgcgtggtggtggatgtctctcaagaagatcccgaagtccagtttaactggtacgtggacggggtcgaagtgcacaatgcaaagactaagccaagagaagagcagtttaactcgacctaccgtgtggtgtcggtgcttaccgtgctccatcaagattggttgaacggaaaggaatacaagtgtaaggtgtcaaataagggcttgccaagctccattgagaaaaccatttccaaggctaagggacaacctagagaaccccaggtgtacaccctgccaccgtcgcaggaagaaatgactaaaaaccaagtgtcgcttacttgtctggtgaaggggttctacccttcggatattgcagtcgagtgggagtccaacggacaacctgagaacaattacaaaactactccacccgtccttgattcggacggatcgttttttctgtactcacgacttactgtggataagtcaaggtggcaggaaggaaatgtgttcagctgttcggtcatgcatgaggcactgcacaaccattacactcagaaatcactgagcctgtccttggga

SEQ ID NO: 15776 - DNA, 1740 bp, Artificial Sequence
  Description of Artificial Sequence: Synthetic coding sequence
atgaagtgggtttcatttatcagtctgctttttttgttttctagtgcctactccgggagcctggacaaaagacacggagaggggaccttcacgtctgatgtgtcatcttacttggaggaacaagcagctaaagagttcatcgcctggcttgtgaaaggcaggggacatggggagggaaccttcacttctgatgtaagctcctatctggaggagcaggccgcaaaggagttcatagcctggctcgttaagggacgcgggcatggcgaaggcaccttcaccagcgacgtgtcaagttatctggaagagcaagctgcaaaagaattcatcgcttggttggtcaaaggccgggggcacggggaaggcactttcacttctgatgtatcctcctatctcgaagagcaagctgctaaagaattcatcgcctggctggtcaagggcaggggtcacggcgagggaacctttacctccgacgttagctcctacctggaggagcaggcagccaaggagttcattgcttggctagtcaaaggcaggggacatggcgagggcacatttacctccgacgtgagcagctacctggaagagcaagcagccaaggaatttattgcttggctggttaagggccggggccatggtgagggcaccttcacaagtgacgtgagctcctacttggaggagcaagccgcaaaggagtttatcgcatggctggtgaaagggcggggacatggagaggggacgtttacgtcagatgtgagttcctacctggaggagcaggccgccaaggagttcatcgcgtggctcgtgaagggacggggacacggcgaaggcacttttacttccgatgttagcagttacttggaagagcaggccgccaaagaatttattgcttggctggtgaaggggagaggccacggggagggcacgtttacttctgacgtctcctcttacctggaagagcaggcggctaaggagttcattgcctggttagtgaagggacgcggaggcggggggggcggcggcagcggtgggggcgggtccggcggcggcggtagcgccgagagcaaatatggtcccccttgcccaccctgtcctgcacctgaggcggccggcggcccaagcgttttcctgttcccaccgaaacccaaggacactctgatgatatccagaacccctgaagtcacatgtgttgtggtggacgtgtctcaggaagacccagaagtgcagttcaattggtatgtcgacggcgtggaggtccacaatgctaaaacgaagcccagagaggagcagttcaatagcacctatcgcgtggtgtccgtccttaccgtgctccatcaggattggctgaacgggaaggagtataagtgtaaagtttcaaacaaggggctgccatcttcaattgagaagacaatttccaaagccaaaggtcagccccgcgagcctcaggtatatacgctgccacccagtcaagaagagatgacaaagaaccaggtgagtctgacctgcctggtgaaagggttttaccctagcgatattgcggtcgagtgggagtctaacggccagccagaaaataattataaaactacaccccctgttttagatagtgatggttccttctttctgtattcccgtttgactgtggataagtcacgctggcaggaaggaaatgtcttctcttgttccgtgatgcacgaagctctccataaccactacacccagaaatccttaagcctgagtctcggc

SEQ ID NO: 15777 - DNA, 1740 bp, Artificial Sequence
  Description of Artificial Sequence: Synthetic coding sequence
atgaagtgggtctcattcatttccctcttgtttctgttcagctccgcctactccggtagcctggacaagaggcacggcgagggtactttcacctccgacgtttcctcttacctcgaggaacaggcggcaaaggaattcatcgcttggctggtgaagggaagggggcatggcgaaggcacgtttacatctgacgtatctagctatcttgaggaacaggcggccaaggaatttattgcttggctggtgaaaggaagaggccacggagagggaaccttcacatcagatgtgtcctcttacctcgaggagcaggccgccaaggagttcattgcgtggttggtaaaaggaagagggcatggggaagggaccttcaccagtgacgtttcatcctatctggaagagcaggctgcaaaggaattcattgcttggctggtcaaagggcggggacatggagagggaacatttacaagcgacgtgtctagctatcttgaagaacaggcagccaaagaattcatagcatggctggttaaaggaagagggcacggcgagggaacctttacctccgatgtttccagctacctggaggagcaggcagccaaagagttcattgcttggctcgtgaagggccggggccacggagaggggacatttacctcagacgtttcctcttaccttgaagaacaagcagctaaagaatttatcgcctggctggtcaagggtagggggcatggtgaaggtaccttcacaagtgacgtgagctcttacctggaggagcaggctgccaaggagtttattgcttggcttgttaagggtcgcggacacggagaggggactttcacctctgacgtttcatcctatcttgaggagcaggccgccaaggaattcatcgcttggttggttaagggccggggtcacggcgaagggacatttacctccgacgtgtcatcttaccttgaggaacaggcagctaaggagttcattgcctggctcgttaaaggacggggaggtggaggagggggcggctctggtggtggagggagtggaggaggaggcagcgctgaatctaagtacggccctccgtgccccccttgtcctgcccccgaagccgctggcggacctagtgtattcctctttccgccgaaacctaaggacacactcatgatatctcggacacctgaagtgacctgtgtcgtggtggacgtgagccaggaagatcccgaggtgcagttcaattggtatgtggatggcgtagaggtgcataatgccaaaactaagccgcgggaggagcagtttaactccacctatcgggtggtatccgtgctgacggtgctccatcaggactggctcaatggtaaggagtataagtgtaaggtttccaataaaggtcttccttcctctatcgaaaaaactatcagtaaggcgaaaggccagccacgcgaaccgcaggtgtatactctgcctccatcacaggaggaaatgacgaagaatcaggtgtctctgacttgcttggtgaagggcttctatccctctgacatcgcggttgagtgggagagcaatggacagcctgaaaacaactacaagaccacgcctcctgtcctggactccgatggttcctttttcctctacagtcgattgaccgttgataagtctagatggcaggagggaaacgtgttctcatgtagcgttatgcacgaagcccttcataaccattatacacagaagagtctttcactttccctcggc

SEQ ID NO: 15778 - DNA, 1740 bp, Artificial Sequence
  Description of Artificial Sequence: Synthetic coding sequence
atgaagtgggtgagcttcatcagcttgctgttcctcttcagctctgcatattccggtagtcttgataaacggcatggcgaaggtacctttacctccgatgtaagcagctacctggaagagcaagctgccaaagaatttatcgcctggcttgttaaaggaaggggacacggggagggcacctttacctccgatgtttccagctacctggaggaacaagcagcaaaggaattcatagcatggctagtgaagggacgtggccacggggaaggcactttcacctctgatgttagttcctacctcgaagaacaggctgctaaggagttcatcgcatggttggtgaagggcaggggccatggcgagggaacttttacttctgacgtgtcatcctacctggaagaacaggcggctaaggagtttattgcatggctggtcaagggaagaggccacggtgaaggcaccttcacaagcgatgtgtcatcatatctcgaagagcaggctgctaaagaattcattgcttggctggtgaaaggcagaggccacggcgaaggaacattcacttccgacgtcagcagctacctggaagaacaagctgctaaggaatttattgcttggctggtgaagggacgcggccacggagagggcacctttaccagcgatgtttctagctatctggaagagcaggcagctaaagaattcatcgcttggctggtgaaggggagaggccacggagaagggacctttacatcagatgtgtcaagctacctggaagagcaggcagcaaaagaatttatcgcttggttagtgaagggacgtgggcacggagagggcacatttacttccgacgtcagctcatacctcgaagagcaagcggccaaagaatttatcgcctggctcgttaagggacgcggacacggcgaaggcacctttacaagcgatgtttcttcttatcttgaggagcaggccgctaaggaattcatcgcctggttagtcaaaggccgagggggaggcggaggtggaggatctggagggggcggcagtggcggaggagggtctgctgagagtaaatacggcccaccatgtccaccatgccccgcacccgaggcagcaggaggacccagcgtctttctttttccgccgaagcccaaggacaccctcatgattagccgcacccctgaggtgacctgtgttgtggttgacgtcagccaggaagatcctgaggtgcaattcaactggtacgtggacggtgttgaggtccacaacgcgaagactaagccccgggaggagcagttcaactctacctatcgagttgtgagtgtgcttacggtgctgcaccaagactggctgaacggcaaggagtacaagtgtaaagtatcaaataaagggctgccaagttcaatcgaaaaaaccatctcaaaagccaaagggcagcctcgggagcctcaagtttacacccttccaccatcccaggaggagatgactaagaaccaagtctctctgacatgcctcgtaaagggattctatccttcagacatcgctgtggagtgggaaagcaacggacaacctgagaacaactacaaaaccacacccccagtgcttgacagcgatgggagtttctttctgtacagcaggcttaccgtggataagtcccgctggcaggagggcaacgtgttttcgtgctccgtgatgcatgaggccctccataaccattatacacagaagtccttgtcactgtccttgggc

SEQ ID NO: 15779 - DNA, 1740 bp, Artificial Sequence
  Description of Artificial Sequence: Synthetic coding sequence
atgaagtgggtttcgttcatctcactcctgttcctgttttcgtccgcctacagcggctcgctcgataagcgccacggtgaagggacgttcacgtccgacgtctcgagctacttggaggaacaggcagcgaaagaattcatagcctggctggtgaaaggacgtgggcatggagagggcaccttcacttctgacgtgtcgtcatatctggaggaacaggcggccaaggagttcatcgcatggctggtgaagggaagaggccacggagaaggaactttcacctcggacgtgagctcctacttggaagagcaagcagccaaagagttcatcgcgtggctcgtgaagggaaggggacacggagaggggacgttcacttccgatgtgagctcgtatctggaggaacaagccgcgaaggaattcatcgcctggttggtcaaaggacggggacacggagaaggaactttcacttccgacgtcagctcgtacctcgaagagcaggcggccaaagagtttatagcttggctcgtcaagggccggggtcacggtgaaggcacgtttacttcagatgtgtcatcatatctggaggaacaagcggcaaaggagttcatcgcctggctcgtgaagggaagagggcatggcgaaggtaccttcactagcgatgtgtcctcatatctggaagagcaggccgcaaaggagttcatcgcttggctcgtcaagggcaggggtcatggcgaaggcaccttcacctcagacgtgagctcgtaccttgaagagcaggctgccaaagaattcatcgcgtggctggtcaaaggtcgggggcacggtgaaggcaccttcacttcagacgtgtcgtcgtatctcgaagagcaagcggctaaggagtttatcgcctggctggtcaagggacgcggacatggagaaggaacttttaccagcgacgtctcctcctacctcgaggaacaggctgcgaaggaattcatcgcatggcttgtgaagggaagaggagggggcggagggggaggctccggtggtgggggatcggggggcggcggtagcgcagaatctaagtacggccctccgtgcccgccatgtccagctccggaagccgccggaggaccgagcgtctttctgtttcccccgaaaccgaaggacaccctgatgattagccgcacccctgaggtgacctgcgtggtcgtggacgtgtcgcaggaggatcctgaagtgcaattcaactggtatgttgacggagttgaggtgcataacgcgaaaaccaagccacgagaggagcagtttaacagcacttatcgcgttgtgtccgtgcttaccgtcttgcatcaggattggctcaatggaaaggagtacaaatgtaaagtctctaataagggactgccgtcctcaatcgaaaagactattagcaaagctaagggacagccccgggaaccgcaagtgtacaccctgccgccgtctcaagaagaaatgaccaagaaccaggtgtccctgacttgcctggtcaagggtttctacccctccgatatcgctgtcgagtgggaatcgaacggccaaccagaaaacaattacaaaaccactccacctgtgttggactccgatggatcattctttctgtactcgaggctcacggtcgacaagtccagatggcaggagggaaacgtgttctcgtgctcggtgatgcacgaagccctgcacaatcactacacccagaagtcactgtccctttccctgggc

SEQ ID NO: 15780 - DNA, 1740 bp, Artificial Sequence
  Description of Artificial Sequence: Synthetic coding sequence
atgaagtgggtgagttttatctccctgctctttctatttagttcagcatacagtgggtcactggataagcggcacggggaaggcacttttacatctgacgtgtcttcctacctggaggagcaggccgcgaaggagttcatcgcctggttggtgaaagggcgcgggcacggtgaaggtactttcaccagcgacgtctctagctacctcgaggagcaagctgctaaggagtttatcgcctggctagtgaaaggacggggacacggcgaaggaacctttacttcagatgtatctagctatctcgaggagcaggctgctaaagaattcatagcatggctggttaaaggtaggggccacggcgaggggacctttacgtcagatgttagctcctacctggaggaacaagcggccaaagagtttattgcctggctcgtgaagggaaggggccacggggaaggcacatttacctcagatgtgagcagttacctagaagagcaggctgcgaaggagtttatcgcctggctggttaaaggcaggggacatggcgagggcacctttacatcagacgtcagctcttatctggaggaacaggctgcgaaagaattcatcgcgtggttggtgaaagggcgcggccatggggaaggcaccttcaccagcgacgtttccagctatttggaagagcaggccgcaaaggagtttattgcctggttagtgaagggtcgcggtcacggcgagggcacgtttacctccgatgtaagctcctacctggaggagcaggcagcaaaagagttcatcgcctggctggtcaagggccgtggacacggtgagggcacttttacgagcgatgtgagctcctatcttgaagagcaggcagctaaggagttcatcgcatggctggtgaaagggagaggccatggtgagggcactttcacctcagacgtcagctcatacctcgaggagcaggctgcaaaagagttcattgcctggttggtcaaggggcgggggggcggaggaggaggaggcagtggaggtgggggctccggaggtggagggtctgccgaatctaaatacgggccgccgtgtcctccatgtcccgcgcccgaggcggcaggggggccaagtgttttcctattccctcctaaacctaaggatacccttatgatatccagaacccccgaggtcacatgcgttgtcgtagatgtgtctcaagaagacccggaggtacagttcaactggtacgtagatggcgtcgaggttcacaacgccaagacaaaaccgcgggaggagcaattcaactctacataccgagtcgttagtgtgctgaccgtgctgcatcaagactggttgaacggtaaggaatataagtgtaaggtttccaacaaaggcttacctagttctatagagaaaaccatctcaaaggccaaggggcaaccgcgtgagcctcaggtttataccctccctccaagtcaggaggaaatgaccaagaatcaagtttctctaacttgcttggtgaagggtttttacccttccgatatcgcagtggagtgggaaagtaacggtcagcctgagaacaactacaaaaccacaccccctgttcttgactcagatgggtcatttttcctgtattccaggttgaccgttgacaagtcccggtggcaggaagggaatgtgtttagctgttcggtgatgcacgaggctctgcataatcattacacacagaaatctcttagcctgtctctgggc

SEQ ID NO: 15781 - DNA, 1740 bp, Artificial Sequence
  Description of Artificial Sequence: Synthetic coding sequence
atgaaatgggtttcgtttatatcgttattatttctattttcgtcggcgtattcgggttcgttagataaacgacatggtgaaggtacgtttacgtcggatgtttcgtcgtatctagaagaacaagcggcgaaagaatttatagcgtggttagtaaaaggtcgaggtcatggtgaaggtacgtttacgtcggatgtttcgtcgtatttagaagaacaagcggcgaaagaatttatagcgtggttagtaaaaggtcgtggtcatggtgaaggtacgtttacgtcggatgtttcgtcgtatttagaagaacaagcggcgaaagaatttatagcgtggttagttaaaggtcgtggtcatggtgaaggtacgtttacgtcggatgtttcgtcgtatttagaagaacaagcggcgaaagaatttatagcgtggttagttaaaggtcgaggtcatggtgaaggtacgtttacgtcggatgtatcgtcgtatttagaagaacaagcggcgaaagaatttatagcgtggctagtaaaaggtcgtggtcatggtgaaggtacgtttacgtcggatgtttcgtcgtatttagaagaacaagcggcgaaagaatttatagcgtggctagtaaaaggtcgaggtcatggtgaaggtacgtttacgtcggatgtatcgtcgtatttagaagaacaagcggcgaaagaatttatagcgtggctagttaaaggtcgaggtcatggtgaaggtacgtttacgtcggatgtatcgtcgtatttagaagaacaagcggcgaaagaatttatagcgtggctagtaaaaggtcgtggtcatggtgaaggtacgtttacgtcggatgtatcgtcgtatttagaagaacaagcggcgaaagaatttatagcgtggttagtaaaaggtcgaggtcatggtgaaggtacgtttacgtcggatgtttcgtcgtatttagaagaacaagcggcgaaagaatttatagcgtggttagtaaaaggtcgaggtggtggtggtggtggtggttcgggtggtggtggttcgggtggtggtggttcggcggaatcgaaatatggtccgccgtgtccgccgtgtccggcgccggaagcggcgggtggtccgtcggtttttctatttccgccgaaaccgaaagatacgttaatgatatcgcgtacgccggaagtaacgtgtgtagttgtagatgtatcgcaagaagatccggaagtacaatttaattggtatgttgatggtgtagaagttcataatgcgaaaacgaaaccgcgagaagaacaatttaattcgacgtatcgtgtagtatcggtactaacggttttacatcaagattggctaaatggtaaagaatataaatgtaaagtatcgaataaaggtttaccgtcgtcgatagaaaaaacgatatcgaaagcgaaaggtcaaccgcgtgaaccgcaagtatatacgttaccgccgtcgcaagaagaaatgacgaaaaatcaagtttcgttaacgtgtttagttaaaggtttttatccgtcggatatagcggtagaatgggaatcgaatggtcaaccggaaaataattataaaacgacgccgccggtactagattcggatggttcgttttttttatattcgcgattaacggtagataaatcgcgttggcaagaaggtaatgtattttcgtgttcggtaatgcatgaagcgttacataatcattatacgcaaaaatcgttatcgttatcgttaggt

SEQ ID NO: 15782 - DNA, 1740 bp, Artificial Sequence
  Description of Artificial Sequence: Synthetic coding sequence
atgaagtgggtgagctttatcagcctgctgtttcttttttcgtccgcatactcaggctcgctggacaagaggcatggtgaggggacttttactagcgatgtgtccagctaccttgaagagcaagcagcgaaggagttcatagcctggttggtgaaaggtagaggtcatggagaaggcacttttacctccgacgtgtcgtcctacttggaagaacaagcggcaaaagaattcatcgcttggctggtgaaggggaggggacatggggaaggaaccttcacgagcgacgtttcgtcatacttggaggaacaagctgcaaaagagtttatagcatggctcgtgaaaggccgcggtcatggtgagggaacttttacttcggatgtcagctcttacctcgaggaacaagccgcgaaagagttcatcgcatggctggtcaagggccgaggacacggagaaggtacctttacttccgacgtctcatcgtacttggaagagcaggcagcaaaggaattcatcgcgtggctcgtcaagggtaggggacatggagaagggaccttcacctcggacgtttcctcgtatcttgaagagcaggctgctaaagaattcatagcatggcttgtcaaaggccggggacacggcgagggaacctttacctcagatgtgagctcctatcttgaagaacaggccgccaaagagtttatcgcgtggctggtgaaagggagaggtcacggtgaaggcacgtttacctccgatgtttcgagctacctcgaagaacaggcggcaaaggagtttatcgcttggttggtcaagggacgagggcacggcgaaggcaccttcacttccgacgtttcatcatatctggaggaacaggccgcaaaagagttcatagcttggcttgtcaagggaagaggccacggcgagggcacttttacttccgatgtgtcgtcttacctcgaagagcaggcggccaaggaattcatagcgtggttggtgaagggccggggtgggggtggtggcggaggttccggagggggaggatccggaggaggaggatcagccgaatctaagtacggtcccccttgtccaccatgtcctgcccccgaggcagccggaggtccatcggtctttttgtttccgcctaaacctaaggatacgctcatgattagcagaacccctgaagtgacttgtgtggtcgtggatgtgagccaagaagatcctgaggtgcagttcaattggtatgtggacggagtggaggtgcataatgcaaagactaaaccgcgtgaggaacaattcaattccacctaccgcgtggtgtcggtccttaccgtcctccatcaagattggcttaacgggaaggaatacaagtgcaaggtgtcaaacaagggactgccttcatccattgaaaagaccatttcgaaggcaaagggacaaccacgcgaaccacaagtgtacactctgcctccttcccaagaagagatgaccaagaaccaggtttctcttacgtgtctggtgaagggtttttacccttcagatattgccgtggagtgggaatcaaacggccagccggagaacaactacaaaacgacgccaccagtgcttgattccgatggttcctttttcctgtactcccggcttaccgtcgacaaatcgagatggcaagaaggtaatgttttctcatgcagcgtgatgcatgaagcacttcacaaccattacactcaaaagtctctctccctcagcctggga

SEQ ID NO: 15783 - DNA, 1740 bp, Artificial Sequence
  Description of Artificial Sequence: Synthetic coding sequence
atgaagtgggtgagcttcatttcgctcctgtttctgttttcgagcgcatattccggatcacttgacaagagacatggggagggaacgtttacgtcggatgtgagctcgtatctggaagaacaggctgctaaggagttcatcgcgtggctcgtgaaagggcgcggtcacggcgaaggtacttttacctcagacgtaagcagctaccttgaggaacaagcagccaaagagtttattgcgtggctggtcaaggggcgcggacacggagaaggcacttttacttctgacgtatcttcgtaccttgaagaacaagccgctaaggagttcatagcttggctggttaaaggtaggggacacggggaaggtacctttacttctgatgtgtcctcatacctggaggaacaggccgctaaagaattcattgcctggctggtgaaaggtcggggacatggtgaagggacctttacttctgacgtgtcaagttacttggaagaacaggcagcaaaggagtttatcgcttggttggtcaaaggccggggccacggcgaaggaactttcacctccgatgtatcatcctatctggaagagcaagccgcaaaagaattcattgcttggctcgtgaaggggcgtggacatggcgaaggaacttttacgtcggatgtctcaagctacttggaagagcaggccgcaaaggaattcatagcctggctggtgaagggccgggggcacggggagggcacttttacgtccgatgtgagttcgtatcttgaagagcaagcagcgaaagagtttattgcatggctggtcaagggaagaggacatggagagggcaccttcactagcgatgtgagttcctaccttgaagaacaggcagccaaggaattcatcgcctggttggtgaaaggacgtggtcatggggaggggaccttcacctccgatgtgtccagctacctcgaagaacaagccgcgaaggagtttatagcttggctggtgaagggtagaggcggtggaggaggtggtggatcgggtggcgggggtagcggaggcggaggatcggcggagtccaagtacggtcccccttgtccaccctgccccgcacctgaggcggcaggcggtccaagcgtgtttttgtttcccccgaaacctaaggacactcttatgattagccgaaccccagaagtgacttgtgtcgtggtggatgtgtcacaagaagatcctgaagtgcagtttaactggtacgttgacggcgtcgaagtgcataatgcaaaaacgaagccaagagaagagcagttcaactcaacctacagggtggtcagcgtcctcaccgtgcttcatcaggactggcttaacggaaaggaatacaaatgcaaggtgagcaacaagggactcccatcgtcgatcgagaaaaccatcagcaaggcaaaaggtcaacctagagagccacaagtttacaccctcccgccttcgcaagaagaaatgaccaagaatcaagtctcccttacctgtcttgtcaaggggttctaccccagcgacattgcggtggaatgggagtccaacggtcagcccgaaaacaattacaagactacgcctcctgtgctggattcggatggttcctttttcctctactcgagactgactgtcgataagtctcgctggcaagaagggaatgtttttagctgttcagtcatgcacgaagccctgcataaccattacacccaaaaatcactttcgctttccctgggt

SEQ ID NO: 15784 - DNA, 1740 bp, Artificial Sequence
  Description of Artificial Sequence: Synthetic coding sequence
atgaagtgggtctcctttatctccctgctattccttttttctagtgcctattctggctcactcgataagcggcatggtgagggaacctttacctcggatgtgagttcatatctagaggagcaggccgcaaaagaattcatcgcgtggttggtgaagggccgcggccatggcgagggcacgtttactagcgacgtgagctcctatctcgaggaacaggctgcaaaggaatttatcgcgtggttggtgaagggcagaggccacggagagggaacttttacttcggatgtctcaagctacctggaggagcaggctgccaaagaattcatcgcatggcttgttaaaggtaggggccatggcgagggcactttcacctccgacgtttcttcctacctggaagaacaggccgccaaagagttcatcgcctggctcgtgaaagggcgcggtcatggagaaggcacctttacatctgacgtgtccagctatctggaggaacaagcggcgaaagaatttatcgcttggctggtgaaaggacgaggtcatggggagggcacattcacctctgatgtatcctcatacctggaggaacaagcggccaaggagttcatagcttggctggtgaagggccgaggccatggcgaaggaacctttacctctgatgttagctcttacctcgaagagcaggccgctaaggagtttatcgcttggctggttaagggtcgaggccacggcgaaggcacctttaccagtgacgtttcttcttatctggaagaacaggccgctaaggagttcatcgcctggctcgtgaagggcaggggacacggcgaagggactttcacatctgatgtctccagctatctggaagagcaggctgcgaaagaattcatcgcatggctagttaaaggacggggtcatggcgagggtacttttactagcgatgtgtcaagttacctggaagaacaggccgccaaggagtttatcgcctggctagtgaaagggcggggcgggggggggggcggaggttcgggcggtggaggttcaggcgggggtggcagtgccgagagtaaatatggaccgccgtgtccaccttgtcctgctccagaagcagccggtggtccctccgtcttccttttccctcccaaacccaaggacactctgatgattagtcgcacccccgaggtaacctgtgtcgtggtggatgtgagccaggaggaccccgaggtccagttcaactggtatgttgatggcgtggaggtgcataacgctaaaaccaaaccccgggaagagcagtttaattccacatatcgtgtggtgagtgtgctaaccgtgctgcaccaggactggttgaacgggaaagaatataagtgtaaggtatctaacaagggcttgccctccagcattgagaaaactatctccaaagcgaaagggcagcctcgagaacctcaagtgtacaccctacccccttcccaggaagaaatgactaaaaaccaggtctccctgacttgtttagtcaaaggtttttaccctagtgacatcgccgttgagtgggagtctaatggccagccggaaaacaattataaaacaacccctccagtacttgactccgatgggtcatttttcttgtatagcaggttaactgtagacaaatctcggtggcaagagggcaacgttttctcctgttctgtcatgcatgaggccttgcataatcactacacccaaaagagccttagcctgtcgctgggg

SEQ ID NO: 15785 - DNA, 1740 bp, Artificial Sequence
  Description of Artificial Sequence: Synthetic coding sequence
atgaagtgggttagttttatcagtctgttattcctgttctctagtgcctactccggctctctggacaagcggcacggggagggtaccttcacaagtgacgtgtcaagttacctcgaagagcaggctgcaaaggagttcattgcatggctggtcaaaggcaggggacatggagaggggactttcacatcggatgtatcctcgtatctggaggaacaagccgccaaggagttcatagcatggttggtgaaaggacgaggtcatggggaaggaaccttcacaagcgacgtttccagctatcttgaagaacaggctgcgaaagagttcatcgcatggcttgtgaaggggagaggccacggggagggtactttcacgtccgacgtgtctagttacctcgaagaacaggctgcgaaagaatttatagcttggcttgtgaaaggccgggggcatggtgaaggtacattcacttccgatgtgagctcctatttagaagagcaggccgcaaaggaatttatagcgtggctcgttaagggccggggacatggcgagggaactttcacatctgacgtgtcttcctacttggaggagcaagcggccaaagagtttatagcatggttggtcaaagggcgcgggcatggagaggggactttcacaagcgatgtgtcttcttatcttgaggagcaggccgccaaagagttcattgcgtggctcgtgaagggacgcggccacggcgaaggaacatttacctccgatgtgagctcctacttggaagagcaggccgctaaggaatttatcgcctggcttgtgaaaggtaggggacacggggaaggaaccttcaccagtgatgtctcctcttacctcgaggaacaagctgctaaggagtttatcgcttggctggtcaaggggcgaggccacggcgaggggacattcacttcggatgtgtcctcgtatcttgaagaacaggcagcaaaggaattcatcgcctggttggtcaagggccggggaggcggaggcggagggggcagcggaggcggaggcagcggcggagggggtagtgcggagagtaaatatggtccaccatgccccccgtgtcctgccccggaagcagcgggcggaccctctgtcttcctctttccacctaagccaaaggacacactcatgattagtcgaactcctgaggttacatgtgtggtcgtagatgtgtctcaggaggatcctgaagtgcaatttaactggtacgttgatggagtcgaagtgcacaacgcaaagacaaaaccccgagaggaacaattcaacagtacctatcgcgttgtttctgtgctgaccgtgttgcatcaagattggctgaatggcaaagagtacaagtgtaaggtgtcaaataaggggctgccaagttccattgagaagactatatccaaggcaaaagggcagccaagggagccccaggtttatacactgcctcccagccaggaggaaatgaccaaaaatcaggtctccctcacttgcctggtaaaagggttttatccatccgacatcgctgtggagtgggaatccaatggacagcccgagaataattacaagaccacgccacccgttctggattccgatgggtccttctttctgtactcccgtctgacggtggataaaagtagatggcaagagggcaacgtgttttcgtgctcagtgatgcacgaggccctgcataaccattacactcagaagtctctgtctttatctttaggt

SEQ ID NO: 15786 - DNA, 1740 bp, Artificial Sequence
  Description of Artificial Sequence: Synthetic coding sequence
atgaagtgggtgagcttcatatctctgctgttcctgttctcgtccgcctactccggtagccttgacaagagacatggagagggtactttcacctcggatgtatcgtcatacttggaagaacaagcagctaaagagttcattgcgtggctcgttaaaggccgcggacatggcgaaggaaccttcacctctgacgtcagctcctacctcgaagaacaggccgccaaggagtttatcgcttggcttgttaagggtagaggacacggagagggaacgtttacctccgatgtgtcgtcgtaccttgaagaacaagccgcaaaggagtttattgcgtggctggtcaagggtaggggtcatggagagggaactttcacctcagacgtgtcatcctacctcgaggaacaagcagcaaaggaattcatagcctggttggtaaaaggccggggacacggtgaagggactttcacttccgatgtgagcagctaccttgaagagcaggcagccaaagagtttatcgcatggcttgtgaagggacgcgggcacggcgaaggaacgttcacttctgacgtgtcaagttacctggaggagcaggcggccaaggaattcatcgcctggctggtcaaagggcgggggcacggcgaggggacctttaccagcgatgtgtctagctatcttgaagagcaagcggccaaagaattcatagcttggttggtcaagggtcgtggccatggggaaggaacttttacctcggatgtctcgtcctacctggaggaacaggccgcgaaggaattcattgcctggctcgtgaagggtcgcggccatggagagggcacgtttactagtgacgtctcctcctacttggaggaacaagctgcaaaagaattcatcgcatggctggttaagggaagaggccacggagagggcactttcacgtcggacgtgtcgtcctatctcgaagagcaggctgctaaagagtttattgcctggctggtgaaaggacggggcggaggaggaggcgggggatcggggggaggagggtcaggcggtggagggtcggcggagtcgaagtacggacctccatgtcctccgtgcccagccccggaagcggccggcggaccgtcggtctttctgttccctccaaagccaaaggacaccctgatgatcagcaggacccctgaagtgacttgtgtggtggtcgacgtcagccaggaggaccccgaggtgcaattcaactggtatgtcgacggtgtggaggtgcacaacgccaaaaccaagcccagggaagaacagttcaattctacttaccgggtcgtctccgtgctgaccgtgttgcatcaggattggctcaacggaaaggagtacaagtgcaaggtgtcaaataaggggctcccctcaagcatcgaaaaaactatctcaaaggccaagggacagccgcgcgaaccgcaagtctacaccctgccgccaagccaagaggaaatgaccaaaaatcaggtgtcactgacttgcctggtgaagggattctacccgtcagacatcgcggtggagtgggaaagcaacggacagcctgagaataactacaagaccaccccgccagtgctcgatagcgatggatccttcttcctgtactcgcgcctgactgtcgacaagtcccggtggcaggaaggtaacgtgttctcgtgctcggtgatgcacgaagctctccacaaccactacactcagaagagtctgagcctctccctggga

SEQ ID NO: 15787 - DNA, 1740 bp, Artificial Sequence
  Description of Artificial Sequence: Synthetic coding sequence
atgaagtgggtgtcgttcatctccctgcttttcctgttctcaagtgcctattcgggatcgctcgacaaacgacacggggaaggaaccttcactagtgacgtgtcatcataccttgaagagcaggccgcgaaagagttcattgcgtggcttgttaaaggacgaggtcacggtgaggggactttcacttcggacgtgtcgtcgtacctcgaggaacaggcggccaaggaattcatagcatggcttgttaagggccgcggacacggcgagggcacctttaccagcgacgtcagctcttatctggaagagcaagcggcaaaggagttcattgcttggctcgtgaaggggaggggtcacggcgaaggcacgttcacttcggatgtgtcctcgtacctggaagaacaagctgcaaaagagttcatcgcctggctcgtcaagggtagaggccacggcgaagggacctttacctcggatgtcagcagctacttggaggaacaagctgccaaggagttcatcgcatggctggttaaaggccggggccatggagaggggaccttcacctcagatgtgtcgtcctaccttgaagaacaggcagcaaaagagtttatcgcttggttggtaaagggacgtggccatggagaaggtacgtttacgagtgatgtctcctcatacctcgaagagcaagccgctaaggagtttatcgcctggctggtgaagggtcggggccacggagaaggaacctttacctccgacgtgtccagctacctggaggagcaagccgccaaggagtttattgcctggcttgtaaagggccgcgggcatggcgaggggacctttacgtctgacgtgagctcgtatctcgaagagcaggctgctaaagaattcatcgcgtggctggtgaaaggtcggggacacggagagggtactttcacttctgatgtgagctcataccttgaggaacaggcagcgaaggaattcattgcctggttggtgaagggaagaggaggaggaggtgggggaggcagcggagggggaggatcgggaggaggaggctccgccgagtcgaagtacggaccaccttgcccgccatgcccagcgccagaggccgcgggaggcccgtccgtattcctgttccctccgaagccgaaagatactctcatgatctccagaactccggaagtgacttgtgtggtggtcgatgtctcgcaggaggacccggaggtgcagttcaattggtacgtcgacggtgtagaggtgcacaatgcgaaaacgaagccccgggaagagcagttcaactccacctaccgcgtggtgtcggtgctgactgtgctgcatcaggattggctgaacggaaaggaatacaagtgtaaggtgagcaacaaaggcttgccctcgtcaatcgaaaagactatctccaaggcgaagggacagccgcgcgagccacaggtctacaccctccctccctcacaggaggaaatgaccaagaatcaagtctccctcacctgcctggtgaaaggattctacccgagcgacatcgccgttgagtgggaaagcaatggacaaccagaaaacaactacaagaccactcctccggtgcttgacagcgacgggtcattcttcctgtactctcgcttgactgtcgataagtcaaggtggcaagaaggaaacgtgttctcctgctcggtgatgcatgaagcactgcacaaccattacactcagaagtcgctgtccctgagcctcggc

SEQ ID NO: 15788 - DNA, 1740 bp, Artificial Sequence
  Description of Artificial Sequence: Synthetic coding sequence
atgaagtgggtgtcattcatttcgctgctttttctttttagctcggcctactccgggagccttgataagcggcacggcgaaggcacctttacttcagatgtttcttcgtatcttgaggaacaggcagcaaaagagttcattgcctggctcgtgaaaggacggggacatggcgaggggacgtttactagtgatgtgtcgtcatacctcgaagagcaagccgccaaggaattcatcgcatggttggttaaggggaggggtcacggagagggcaccttcacttcagacgtgtcctcctatctggaagaacaggcggctaaggaattcatagcgtggttggtcaagggaaggggtcatggagagggtacctttacgtcggatgtgagctcctaccttgaggaacaagcagccaaagagtttatcgcatggctggtcaaaggccggggccatggagaagggacctttacctccgatgtgagctcgtaccttgaagagcaggcagcaaaggaattcattgcatggcttgtcaagggtcgcggtcacggcgaaggtacttttacctctgatgttagctcttacctggaggaacaggccgcgaaggagttcatcgcctggctcgtcaagggacgcgggcatggcgaaggcacgttcacttcggatgtgtctagctacctggaagaacaagcggccaaagaattcatcgcttggctggtgaagggtcgggggcatggagaaggaacctttactagcgacgtgtcatcatacctcgaggagcaagctgcaaaggagtttatagcatggcttgttaaagggagaggacacggagaagggacgtttacctctgacgtgtcaagttaccttgaggagcaggcagccaaggagttcattgcttggctggtaaaaggtcgcggacacggtgaagggacttttacttccgacgtcagctcatacctggaagagcaagcggcgaaagagtttattgcttggcttgtgaaaggacgtggtggaggaggaggcggaggttcgggtggaggtggatcagggggtggagggtcggcggaatccaagtacggacctccttgccccccgtgcccagcacctgaagccgcaggagggccgagcgtgtttttgtttcctcccaagccaaaggacaccctgatgatttccagaacccctgaggtcacctgtgtggtagtggatgtgtcgcaggaagatccggaggtccagttcaattggtacgtcgatggagtggaggtgcataatgcaaagaccaagccccgtgaagaacaattcaactcaacctaccgagtggtatccgttctgacggtcctccaccaggattggctgaacggaaaggaatacaagtgtaaagtctcgaacaagggcctgccatcgtcaatcgaaaagacgatctcgaaagcaaagggtcagcctcgagaaccacaagtctatactctcccaccttcacaggaggaaatgaccaagaatcaagtgagcctcacttgtcttgtgaagggcttttacccttcggacattgctgtggaatgggaaagcaacggtcaaccagaaaacaactacaaaactactcccccagtcctcgactccgacgggtcttttttcctgtactccagacttaccgtggataagtccagatggcaagaaggtaacgtgtttagctgttcggtaatgcatgaagcactccataatcattacactcaaaagtccttgtcactttcgctcgga

SEQ ID NO: 15789 - DNA, 1740 bp, Artificial Sequence
  Description of Artificial Sequence: Synthetic coding sequence
atgaaatgggtgagcttcatctcgctcctgttcctgttctcctctgcttactctggctccctggacaagcggcacggagaaggaacgtttaccagcgatgtctcctcctacctcgaagaacaggccgccaaggaattcatcgcctggcttgtgaagggacgcggtcatggtgaaggaacttttacctccgacgtttcttcttacctggaggaacaagcagccaaggaattcattgcctggctggtgaaaggcagaggacacggcgaaggcaccttcacgtcggacgtcagttcatatctggaagagcaggcagcgaaggaattcatcgcttggttggtaaagggaagagggcacggcgagggaacgtttacctcagacgtttcctcgtatttggaggaacaagcggcgaaggagtttatagcctggctggttaagggtcgcggccacggtgagggtaccttcactagcgacgtgtcgtcgtacctcgaagagcaagcagccaaagagttcatcgcttggctggtgaaggggcggggccatggcgagggtactttcacctcagacgtgtcatcgtacctggaagaacaggcggcaaaggagttcattgcttggctcgtcaagggtaggggacacggagagggaacttttacttcagacgtgtcatcatacttggaggagcaggcggccaaagaattcatcgcttggttggtcaagggacgcggacatggagaaggcactttcactagcgacgtgtcaagctacctcgaggaacaggcagccaaggagtttattgcatggcttgtaaaggggcgaggacatggggagggcaccttcacctcggatgtgtccagctacctggaagaacaagccgccaaagagttcatcgcgtggttggtgaagggaagaggtcacggagaggggaccttcacttcggacgtgagctcctatctcgaggaacaggcagcgaaagagtttatcgcatggctggtcaagggacgcgggggaggaggaggtggagggtcgggtggaggaggatctggcggaggaggcagcgctgaatccaagtacgggcccccgtgccccccatgcccggcccctgaagcggccggaggcccatcagtgttcctgtttccccctaagccgaaagatactcttatgatctctcggactccggaggtgacctgcgtcgtggttgatgtgtcgcaggaggaccccgaagtccagtttaactggtacgtggacggagtcgaggttcacaacgctaagaccaaaccgcgggaagagcaattcaactccacctaccgggtggtcagcgtcctgactgtgctccaccaggattggctgaatggcaaggaatacaagtgcaaggtgtcgaacaaaggcctcccgtcgtcgatcgaaaagaccatctccaaagctaagggacaacctagggagcctcaagtctacaccctgccaccatctcaggaagagatgacgaagaatcaggtgtcacttacttgtctggtgaaaggattctacccgtcggacatagcagtcgaatgggagagtaatggacaacctgaaaacaactacaaaaccactccgccagttctggattcggatggatcctttttcctgtacagccgcctgactgtggataaatcaagatggcaggaggggaacgtgttcagctgttccgttatgcatgaggctctgcacaatcattacacgcagaagagcttgagcctgagccttggc

SEQ ID NO: 15790 - DNA, 1740 bp, Artificial Sequence
  Description of Artificial Sequence: Synthetic coding sequence
atgaagtgggtcagtttcattagtctgttgtttctgttttcttcagcttactccggttccctggataagaggcacggggagggcactttcacctctgacgtgtcctcatacttggaggagcaggccgctaaagagttcatcgcttggctggtgaaggggaggggtcatggcgaggggacgttcacctctgacgtgtcaagctacctcgaggaacaggcggcaaaagagttcattgcctggcttgttaagggaagaggccatggtgaaggaaccttcacctccgatgtatcctcctatctggaggagcaggcggccaaggaattcatcgcatggctggtgaagggccgcggccatggcgaaggcacttttacttccgacgtgtcttcctacctggaggaacaagccgcaaaagagtttattgcctggctggtgaaagggcggggtcacggcgaggggacattcacgtctgacgtctcttcctacctggaggaacaggcggcgaaggagttcattgcttggttggtgaagggtcggggccatggagaaggcacattcacaagcgatgtctcctcctatctggaggaacaggcggcaaaagagtttatagcatggctggtcaaaggacgagggcacggggagggcacattcacaagcgatgtctcatcctatctggaagaacaggccgcaaaggagttcatcgcttggctggtgaaaggcagaggccatggcgaaggcaccttcacctccgacgttagctcatatctggaggagcaggccgctaaagagtttatcgcatggctggtcaaaggacgcggacacggagaaggcacctttacaagcgacgtgagctcatacctagaagaacaggctgctaaggaatttattgcatggcttgtcaaaggccgggggcacggtgaagggactttcacctctgacgtatccagctacctagaggaacaagccgccaaagagttcatcgcctggctggttaagggccgaggcggtgggggcggaggaggttccggagggggaggaagcggggggggaggatctgcggagtccaagtacgggcccccctgtcccccatgtcctgctcctgaggccgccggcgggccttctgtgtttctctttcctcccaagcctaaggataccctgatgatcagtcgcaccccggaggtcacctgcgtggtcgtcgatgtctctcaggaagatcctgaagtccagttcaattggtacgtggatggagtggaagttcacaacgcaaagacgaagccaagggaggaacagtttaactccacgtaccgggtggtatcagtgctgactgtactccaccaggactggctgaacgggaaagaatacaaatgtaaggtatccaataagggccttccgagtagtatcgaaaagacaatttctaaagcgaagggccagcctcgggagcctcaggtatacaccctccccccgtcgcaggaggagatgaccaaaaaccaggtatcactcacttgtctagtgaaagggttttaccccagtgatattgccgtcgaatgggagtccaacggacagccagagaataattacaagaccacccctccagttcttgatagcgacggttcttttttcttatattcgcgcctaacagtcgataaatcgaggtggcaggaagggaacgtgttctcatgctctgtgatgcatgaagctctgcataatcactatacccagaaaagcctaagcctttctctgggc

SEQ ID NO: 15791 - DNA, 1740 bp, Artificial Sequence
  Description of Artificial Sequence: Synthetic coding sequence
atgaaatgggtctcattcatatccctgttattcctattttcctccgcttattccggtagcttagacaaaagacacggagaaggtaccttcacttctgacgtatcttcataccttgaagagcaggctgcaaaggaatttattgcttggttagtcaaggggagaggtcatggtgaaggtaccttcacctctgatgttagttcctacttagaggaacaggcagccaaggagttcatcgcttggttggtcaaaggtcgtggacatggggaaggcactttcacgtccgatgtttcgagctatctcgaagaacaagctgcaaaggaatttatcgcatggttggttaagggacgtgggcatggggagggtacgttcacttcagatgtgtcaagctatctagaagagcaagcggctaaagaattcattgcttggctggttaagggaaggggtcatggggaaggtacttttacatccgatgtttcatcttatttggaggagcaggccgctaaggagtttattgcttggcttgttaaggggagaggacacggggagggaaccttcacttccgatgtgagctcttatttagaggagcaggcagccaaggaatttatagcttggttagtgaagggtaggggacatggtgaaggcacatttacatccgacgtatcatcttatctagaggaacaagccgctaaggagtttatcgcatggcttgttaagggacgtggacacggcgaggggacttttacctcagacgtgtcgagctatttggaggagcaggctgctaaggaattcattgcttggttagttaaaggaagaggacatggcgaagggacattcacgtccgatgtttcttcctacctcgaggagcaagctgcaaaggagtttatagcttggctcgtcaagggaagaggtcatggcgaggggacattcacatctgatgtttctagttatttggaggaacaggccgcaaaggagtttatcgcatggcttgttaagggtaggggcggtgggggaggcggcggttccggtggcggcggcagcgggggaggtggaagcgccgagagcaagtacggacccccttgtccaccatgtccggctcctgaagctgctggcggaccatccgttttcctcttccctccgaagcctaaggatactcttatgatttctcggaccccagaggtgacttgtgtagtcgtagatgttagtcaagaggacccggaagtgcagttcaattggtacgttgatggtgttgaagttcataacgcaaagaccaagcctagagaagagcaatttaactccacttacagggtggtgtcagttcttactgtattgcatcaggattggctgaacggaaaggaatataagtgtaaagtgtccaataagggactcccttcaagcattgaaaaaactatctctaaggcgaagggacagcccagggagcctcaggtctacacgcttcctcctagtcaggaagagatgactaagaatcaagtgtctttgacctgcctggttaaaggcttttatccatcagatattgctgtggagtgggaaagcaacggtcaacctgagaataattataaaacaactccgccagttctcgattcagacggttcgttcttcctttatagccgattgaccgttgataaatcacggtggcaggaaggaaacgtttttagctgcagcgttatgcatgaggcccttcataaccactacacccaaaagtcgctttcactatccctagga

SEQ ID NO: 15792 - DNA, 1740 bp, Artificial Sequence
  Description of Artificial Sequence: Synthetic coding sequence
atgaagtgggtatccttcatcagcttgctgtttctgttttcaagcgcttattccgggagtttggataagcgccatggagaaggaacgttcacctcagatgtcagctcttacctggaagaacaggccgctaaggagttcatagcctggctcgtgaaagggagaggccacggagagggcaccttcacctctgatgtgtccagctatttagaagaacaggcagccaaggagttcatagcctggctcgtcaaagggagaggtcacggcgaagggacctttactagtgatgtatctagctatctggaggagcaagcggctaaagagttcatcgcttggttggtcaaaggacgggggcacggagaagggaccttcacttcggatgtctcgtcctacctggaagaacaggccgccaaggagtttattgcatggctggtcaaaggtcggggacatggggagggaacctttaccagcgacgtgtcttcatacttggaagagcaggcagccaaggaattcatcgcttggcttgttaaagggaggggccatggcgagggcacattcactagtgacgtgtcctcctaccttgaagaacaggcagctaaggaattcatcgcatggttggtgaaaggacgcggtcacggcgagggcactttcacatcggacgttagctcttacctggaggagcaagctgccaaagagttcatcgcctggcttgtgaagggaagaggtcatggcgaggggacgttcacttcagatgtttcaagctatctggaggagcaggcggccaaagagttcattgcgtggttagtgaaggggcgcggacatggggaaggcaccttcacctcagatgtcagctcttatcttgaggagcaggcagcaaaagagtttattgcctggttggtcaaggggcgcggacacggcgagggcaccttcaccagtgacgtgagtagctatctggaggagcaggccgctaaggagttcatagcgtggctcgtgaaggggaggggaggcggggggggggggggatcaggcggaggcggctctggtggggggggtagcgctgaatcgaagtatggtccgccatgtccaccttgccctgctcccgaggccgctggtgggccatccgtctttctctttccccctaaacccaaggatacccttatgatctcacgtaccccagaagtgacctgcgttgtcgtggatgtctcacaggaagatcccgaggttcagtttaattggtatgttgacggtgtcgaagtgcataatgcgaagacaaagcctagagaggagcagttcaactctacatatcgggtggtgagtgtgctcactgtgttgcaccaggactggctcaatggaaaagagtacaagtgcaaggtgtccaacaaaggcctgccatcctccattgaaaaaacaatctcaaaagccaagggtcagccccgcgagccgcaggtgtatactctgcccccatctcaggaagagatgaccaaaaaccaagtctcgctgacttgtctggtgaagggattctacccctctgacatcgctgtagaatgggagtcgaatggacaacccgagaacaactataaaacgacccctccggttctggattctgacgggtcgtttttcttgtattctcggctgaccgttgacaagagcagatggcaggaaggaaatgtttttagttgcagcgtcatgcatgaagcactccataaccattacacacagaaatccctctctttgagcttagga

SEQ ID NO: 15793 - DNA, 1740 bp, Artificial Sequence
  Description of Artificial Sequence: Synthetic coding sequence
atgaagtgggtctcatttatcagccttttattccttttttctagcgcgtattcaggatcattagacaagcgacatggtgaaggtacgtttacatcagatgtaagcagctatctggaagagcaagccgctaaagaattcattgcctggttagtcaaaggccgtggacacggggaaggcaccttcacaagtgatgtcagttcatacttggaggaacaggccgcaaaagagtttatcgcgtggctggtcaagggacgtggccatggcgaggggactttcacgtctgatgtctcctcatacctcgaagaacaagctgctaaggagtttattgcgtggctggtaaaagggaggggtcatggagagggaacgttcacgagcgatgtctcttcgtacctagaggagcaagctgctaaggaatttattgcatggttagtgaagggacgcggtcatggagaaggaacttttacatcagacgttagtagctatctggaagagcaagcggctaaggaatttatcgcctggttggtaaaagggaggggacacggagaaggcacctttacctcagacgtctcaagctatctggaagaacaggcagctaaagaatttatcgcatggctggtcaaaggtaggggtcatggtgagggaacatttacatcggacgtttcaagctacttagaggaacaggcagcaaaggaatttatcgcatggcttgtgaaaggtcggggccatggagaaggtacatttacatcagacgtatctagctacttagaggagcaagcagctaaagaatttattgcctggcttgtaaaagggcgcggccacggagaaggaacgtttacaagtgatgtttcgtcatatctggaagaacaagcagctaaagaattcatcgcatggctcgtgaaaggacgcggccatggcgaagggacattcacatctgatgtgagcagctacctcgaagaacaagctgcaaaagaattcattgcatggttggtgaagggccgagggggagggggcggaggtggctcgggtggaggaggttcaggtggaggcggctctgccgagagtaaatatggtcctccttgccctccttgcccggctccggaagcggcgggaggtccttctgtgtttttgttccctcctaaaccgaaagatacattgatgattagccggaccccagaagttacatgtgtcgtggtggatgtgtcccaagaggatccggaagttcaatttaattggtatgtggatggagtggaagtccataatgcgaaaaccaagccacgtgaagaacaatttaattctacttatagggtcgtctccgtccttacagtcttacatcaggattggttaaatggaaaagagtataaatgtaaagtctctaataagggccttccgagtagtattgaaaaaacaattagcaaagcgaaaggacaacccagggaaccgcaggtgtatacgcttccaccatcccaggaggaaatgactaaaaaccaagtgtctttgacatgcctcgtgaagggtttctacccgagcgatatcgctgtcgaatgggagagtaatggacagccagagaataactataaaacgaccccaccagttctggactcggatggctcattttttctttattctcgcctgacagtggataaatcaagatggcaagagggtaatgtgttctcatgcagtgtaatgcatgaagcactgcataaccattatacacagaagtctttgagcctgtccctggga

SEQ ID NO: 15794 - DNA, 1740 bp, Artificial Sequence
  Description of Artificial Sequence: Synthetic coding sequence
atgaagtgggtgtcgttcatctcgctgctgttcctgttctcatcggcctactcgggaagcctggacaaacggcatggtgaggggactttcacgtccgacgtgtcgtcgtaccttgaagaacaagcagcgaaggagtttatcgcctggttggtgaaaggtcggggacatggcgaaggaaccttcaccagtgacgtatcctcctacctggaggagcaagccgccaaggagttcatcgcgtggctggtcaagggacgggggcacggagaaggaacctttactagcgatgtttcctcatacctcgaagaacaggctgccaaggagtttattgcgtggcttgtcaagggacgaggtcacggagagggcacgtttactagcgacgtgtccagttacctcgaggaacaagccgctaaagagttcatcgcttggttggtaaagggtcgcggacacggtgaagggaccttcacctccgatgtgtcgagctacctcgaagagcaggcggctaaggagttcatagcttggctcgttaagggaaggggacacggagaaggtactttcacctcagacgtttcttcgtatctggaagaacaggcggcaaaagagttcatagcatggctcgtgaagggccggggccatggtgaaggaactttcaccagtgatgtcagctcgtatcttgaggaacaagcggcgaaggaattcatcgcctggcttgtgaaagggcgcggtcatggagagggtacctttacctccgatgtttcgtcatacctggaggaacaggcagcaaaagagtttattgcttggctggttaagggtagagggcacggggaaggcacctttacttccgacgtctcttcttatctcgaggagcaggccgccaaggaattcattgcctggttggtcaaggggaggggtcatggagaaggcactttcacttccgacgtgtcatcgtacctggaagagcaggcagctaaagagtttatcgcatggctggtgaagggacgcggcgggggcggcggcggaggctcgggaggtggcggatccggcggagggggaagcgccgaatccaagtacgggcctccttgtcccccgtgccccgccccggaggccgcaggggggccgagcgtgttcttgttcccaccgaaaccaaaagacaccctcatgatcagccgcactccagaagtcacgtgtgtggtggtggacgtcagccaggaagatccggaggtgcagttcaactggtacgtggatggcgttgaagtccacaacgcgaaaaccaagccgagagaagaacagttcaactctacctaccgggtggtgtcggtgctgacggtgctccaccaagactggcttaatgggaaggaatacaagtgcaaggtgtcaaacaagggactgccctcctcgatcgaaaaaactatctctaaggctaagggacagccacgcgagccgcaggtgtacacgctgccgccgagccaggaggagatgactaagaatcaagtctcattgacctgcctcgtgaagggattttacccgtcagatatcgccgtcgagtgggaaagcaatggacaaccagagaataactacaaaaccacccctcctgtcctggactcggatggttcgtttttcctgtacagccgcctgactgtggacaagtcaagatggcaggaaggaaacgtgttctcctgctccgtgatgcacgaagcgctccacaaccattacacgcaaaagtccctgtccctgagcctcgga

SEQ ID NO: 15795 - DNA, 1740 bp, Artificial Sequence
  Description of Artificial Sequence: Synthetic coding sequence
atgaagtgggtttcttttatctccctgctcttcctgttttcgtccgcatactccggcagcctggataagcgccatggagagggtacctttaccagcgatgtatcctcatatctggaggagcaagcagcgaaggagtttattgcctggcttgtgaaagggcggggacatggagaaggcacttttacttcggacgtctcgtcgtacctggaggagcaggcagctaaagagtttattgcatggcttgtgaagggccgtggtcacggagaggggactttcacctcggacgtctcctcataccttgaggagcaggccgccaaagagtttatcgcatggctggtaaaggggcgggggcatggcgagggcacgtttaccagtgatgtttcgtcgtacctcgaggaacaagccgcgaaagagttcattgcatggttggtgaagggtcgcggacatggggaggggaccttcaccagtgacgtgagcagttacctggaagaacaggctgccaaggaattcatcgcgtggctcgtcaaagggagaggccacggtgaaggaacgtttacgtccgacgtgtcatcataccttgaagaacaagcagcgaaagaattcatagcctggctcgtaaaaggaaggggacacggcgagggaacttttacctcggatgtctcctcatatcttgaagaacaggcagcaaaagaattcatcgcctggctcgtgaaggggcgagggcatggagaagggacctttacctcagacgtgtcatcctacctggaggaacaagcagcaaaggagtttatagcttggctcgttaagggaagagggcacggagaaggaacctttacttccgatgtcagctcgtatctcgaagaacaggccgcgaaggagttcatcgcttggttggtcaaaggcagaggtcacggtgaaggcacgtttacttctgacgtcagctcgtacctcgaagagcaagctgcaaaggaattcattgcctggttggtgaaaggacgaggcggtggagggggtgggggctccggtggcggcggttcaggaggaggaggatcagccgaatcgaagtacgggccaccttgtcctccctgccctgcacccgaagcagctggtggtccatccgtgtttctttttccgccaaagccaaaggatactctcatgataagcagaacccctgaggtgacttgtgtcgtggtcgacgtctcacaagaagatcctgaagttcaattcaattggtacgtggatggagtggaagtccataatgcaaaaaccaagccgcgtgaagagcagtttaactcaacctaccgggtcgtgagcgtgctgaccgttcttcatcaagattggcttaacggcaaggaatacaagtgtaaagtgtcaaacaagggacttccctcgtctattgaaaaaactatttccaaggcaaaaggacaaccacgcgagccccaagtgtacaccctgccaccatcacaggaagaaatgactaagaaccaggtgagcctgacctgccttgttaagggcttttaccccagcgatattgcagtggaatgggaatctaacggtcaacctgagaataactacaagactaccccacctgtgctcgactctgatggctcgtttttcctgtacagcagactgactgtcgataagtcccggtggcaggaaggtaatgtgttctcgtgctccgtcatgcatgaagcgctgcataaccattacacccagaagtccctgtcgttgtcccttgga

SEQ ID NO: 15796 - DNA, 1740 bp, Artificial Sequence
  Description of Artificial Sequence: Synthetic coding sequence
atgaaatgggtcagtttcataagtctcctgttcttattcagctctgcgtacagtggctctctggacaagcggcacggtgaagggacattcactagcgatgtgtcatcctatctggaagagcaggccgccaaagagtttattgcctggctcgtaaaggggcgcgggcacggggagggaacattcacatccgatgtgagctcttatctggaggagcaagccgccaaagagtttatcgcctggctggtcaagggtagaggacatggggaaggtacttttacctctgacgtgagttcttatttagaggagcaggctgccaaggagtttatcgcctggcttgttaagggccgggggcatggagaaggaaccttcactagcgatgtgtccagctacctggaggagcaggcagccaaagagtttattgcatggctagtgaaagggaggggtcacggggagggtacatttacgagtgatgtctcctcctacctagaggagcaggcagcaaaggagttcatcgcatggctcgtgaaaggcagaggacacggagagggtacattcacgagtgatgttagctcatacctggaagagcaggcggccaaggagtttattgcttggttggttaagggtcgaggtcatggagaaggtacttttacctccgacgtaagcagttacctggaagaacaggccgcaaaggagttcattgcctggctggttaaggggaggggccacggagagggcacgttcaccagcgatgtaagcagctacctggaggaacaggccgccaaagagtttattgcttggcttgtcaaagggaggggacacggagagggtacatttacgtctgacgtctcgtcttacctggaagagcaagctgcgaaagagttcatcgcgtggctggttaaagggcggggacacggtgaaggcaccttcacctcagatgtgagttcctacctcgaagaacaagcggctaaggagtttatcgcatggctggttaaagggcgtggtggtggtgggggcgggggcagcggtggggggggctctggtggcggcggatccgcggagagcaagtatgggcctccctgccctccgtgccctgcccctgaggcagccggggggccgtcagtctttctcttcccacccaagccaaaagataccctgatgatatccagaactcctgaggtgacctgcgtggtagtggatgtgtcacaggaagacccggaagttcagtttaattggtatgtggacggggtggaggtacataacgccaagacaaagccgagggaggagcagttcaacagtacctaccgagttgtgagcgtgttaactgtgctccatcaggattggctgaacggtaaagagtataaatgtaaagtgagtaataaggggcttcctagcagtatcgagaagacgatttctaaggctaaggggcaaccgagagaacctcaggtctataccttaccaccatcccaggaggaaatgacaaagaatcaggtctcccttacttgcttggttaagggattttacccatctgatattgctgttgaatgggagagtaatggtcagccagagaataactataagactaccccacccgtgttggattctgatggttctttttttctatattcccgcttgaccgttgataagtcgagatggcaggagggaaatgtattctcctgttcagtcatgcatgaagccctgcacaaccattacactcagaaaagtctctcactcagcctgggt

SEQ ID NO: 15797 - DNA, 1740 bp, Artificial Sequence
  Description of Artificial Sequence: Synthetic coding sequence
atgaaatgggtgagcttcatctcactcctcttcctcttctcgagcgcctactcgggatcactggataagcgacatggggaaggaacttttacctccgatgtctcctcttacctggaagagcaggcagctaaagagttcattgcctggcttgtgaagggacggggccacggcgaagggacttttacctcagatgtatcctcctacttggaggagcaggccgctaaagaattcatcgcatggcttgtcaaaggacgcgggcacggtgagggaacttttacgagcgacgtgagctcgtacctggaggaacaggccgcaaaggagtttatcgcctggctcgtgaaggggcgcggccacggagagggaaccttcacctccgatgtatcaagctatctggaggaacaagcagcgaaggaattcatcgcctggctggtcaaggggaggggacatggtgaggggaccttcaccagcgacgtgtcaagctacctggaagaacaggccgccaaagaattcatagcgtggctcgtcaagggacgcggacacggcgaaggcaccttcacctcagacgttagtagctaccttgaagaacaggcggccaaggaattcattgcgtggttggtaaagggacgggggcacggtgaaggcactttcacttccgacgtgtcctcttacctcgaagaacaggcagcgaaggagttcatagcctggctggtgaaaggcagaggccatggcgagggtaccttcacttcggatgtgtcgtcctaccttgaggaacaagctgctaaggagtttatagcgtggttggtcaaaggacggggtcatggtgaagggacgtttactagcgatgtctcgtcgtatctcgaggagcaggcagcaaaggagttcattgcttggctggtgaagggaagaggacatggagagggcactttcacctccgacgtctcatcataccttgaagagcaagccgctaaggagttcatcgcttggctggttaaaggacgcggaggaggaggtggaggaggatccggaggagggggatcggggggtggcggcagtgcggagtcgaagtacggcccaccatgcccgccctgccccgcgccggaggccgccggaggcccttccgtgttccttttcccaccaaaacctaaagacacgttgatgatcagccgtactccggaagtgacctgcgtggtggtcgacgtgtcgcaagaagatccagaagtgcaattcaattggtacgtggacggggtcgaggtgcataacgcaaagaccaagcccagggaagaacagttcaattcgacttaccgcgtggtttcggttctcactgtcctgcaccaagactggctgaatggaaaggaatacaagtgtaaggtgtccaacaagggactcccgtcctcgatcgaaaagacgatctccaaggccaaaggacagccgcgggaacctcaggtgtacacgctgcctccgtcgcaggaagaaatgactaagaaccaggtgagcctgacttgtctggtgaaggggttctacccgtctgatatcgccgtggagtgggagtctaacggccagccggaaaacaactataagactaccccaccggtgctggactccgacggatcgtttttcctctactcgagactgaccgtggacaagtctaggtggcaagaaggtaacgtcttttcatgcagcgtgatgcacgaggcgctgcacaatcactacactcaaaaatcgctcagcttgtcccttggc

SEQ ID NO: 15798 - DNA, 1740 bp, Artificial Sequence
  Description of Artificial Sequence: Synthetic coding sequence
atgaaatgggtctcttttatctccttgcttttcttgtttagctctgcttactccggctctctggacaagaggcatggtgaaggcacattcacgagcgatgtgtctagttatctcgaagagcaggccgcgaaggagttcatagcttggctcgttaagggccgcggacatggagaaggaaccttcacctccgacgtatctagttaccttgaggagcaggctgccaaggagttcatagcgtggctggtgaagggacgcggccatggcgagggcacattcacctcagacgtgtcaagctacctcgaggaacaagccgccaaggaattcatcgcttggcttgtcaaaggtagaggccacggtgaaggtactttcacttctgatgtgtcttcatacctcgaagaacaggctgctaaggagtttattgcttggttggtcaagggtaggggccatggcgagggtacattcacctccgatgtaagcagctacctggaggagcaggctgcgaaggagtttatcgcctggcttgtgaagggcaggggacacggtgagggaactttcactagtgacgtgtcttcctaccttgaggagcaagcagcgaaagagttcatagcttggctcgtgaaaggaaggggacacggtgagggcacattcacgagcgacgtgtcttcctatctcgaggaacaggccgccaaggagttcatcgcatggcttgtcaagggaaggggtcacggagaaggaacttttacaagcgacgtgtcatcttaccttgaggagcaagctgccaaagaatttatcgcttggctcgttaagggaaggggccacggcgagggcaccttcacctccgatgtaagctcatacctggaagaacaggcagcaaaagaattcatcgcttggctcgtgaagggtaggggccatggtgaaggaacatttacttcagatgtcagtagttatctggaggagcaggcggccaaggaattcatcgcttggttggtcaaaggcagaggaggcggtggcggtggaggatccggtggcggtggttctggcggtggcggaagcgctgaatccaaatacggtccaccctgccctccatgcccggcaccagaggcggctggaggtccatccgtgtttttgttcccgccaaagcctaaggataccctgatgatttctagaactccagaagtcacttgcgtcgtggtagacgtctcccaggaggacccagaggtgcagttcaactggtatgtcgacggtgtcgaggtccataatgctaagactaaaccaagggaggaacagtttaactccacatatagagtcgtgtccgtactcaccgtgttgcatcaagattggctgaatggcaaggaatacaagtgcaaagtctctaacaaaggactgccgtctagcattgaaaagacgatcagtaaggctaagggacagccgagagagcctcaggtgtatacactcccacctagccaggaggaaatgactaaaaaccaagtatccctgacctgcctcgtgaaaggattctatccgtccgatattgcagttgagtgggagagtaatggccagccagagaacaactacaaaaccacgccgcccgtgctcgactctgatggtagcttctttctgtattcacgccttactgtggataagtctagatggcaggagggtaatgtgttctcctgctctgtcatgcatgaggcactgcacaatcactatactcaaaagtccctgagcctctctttgggt

SEQ ID NO: 15799 - DNA, 1740 bp, Artificial Sequence
  Description of Artificial Sequence: Synthetic coding sequence
atgaaatgggtatcgtttatatccctcctgtttctgttctcaagtgcatacagtggaagtcttgataaaaggcacggggagggaacttttacgtctgacgtttcgtcctatttggaagaacaggcagcaaaagagttcattgcctggctcgtaaaagggcggggacatggggaagggactttcacttccgatgtgtcgtcatatctagaagaacaggccgccaaagaattcattgcttggttagtcaaagggcggggacacggggaaggaacatttacttcagatgtgtcttcctatctcgaagagcaggctgcaaaagaattcatcgcttggcttgtcaaaggacgaggacacggagaggggacattcacatctgatgtttcatcttatttggaagaacaggcagccaaggaattcatagcctggctagtgaaagggaggggacatggagaaggaacattcacaagtgatgtttcttcttacctcgaggaacaggctgctaaagaattcatagcctggctggtaaaagggcgagggcatggggaagggacatttacatccgatgtgtcatcatatctagaggaacaagctgcaaaagaatttattgcttggctcgtcaaaggacggggacatggagaagggacattcacatctgatgtctcttcatatctggaagaacaggctgccaaagaattcatcgcctggctggtgaaggggagggggcatggggaagggactttcacttccgatgtatccagttacctggaagaacaggccgctaaagaatttattgcatggttggtaaaggggaggggacatggagaaggaacattcacgagtgatgtgtcatcgtacctggaagaacaggctgctaaagagttcatcgcctggttggtgaaaggacgggggcacggggagggaacattcacatctgatgttagttcttatctggaagaacaggccgcgaaagagttcatcgcttggcttgtgaaagggcgggggggagggggggggggggggtctgggggaggaggatctgggggaggaggaagtgctgaatcaaaatacgggcccccctgtcccccatgcccagcccctgaagccgccgggggaccttctgtatttctctttcctcccaagcccaaagatacactgatgatctctaggacacctgaagtgacatgtgtagtcgtggatgtgtcacaggaagatccagaagtgcagtttaattggtatgttgatggagtggaagtgcataacgctaaaactaaaccccgagaagaacagtttaactccacatacagagtggtatctgtgcttacagtgctccaccaagactggctcaatggaaaagagtataaatgtaaagtctcgaataaaggactcccctcctccattgaaaaaacaatctcaaaagcgaaaggacaacccagggaaccccaggtatatacactccctccctctcaggaagaaatgacaaaaaaccaggtttctcttacttgccttgtcaaagggttttacccctcagatatagctgttgaatgggaatctaatggacagcccgaaaataactataaaactacaccccccgtactagattcagatggatcattttttctttattctagactcactgtggacaaatcccggtggcaggaagggaacgttttttcctgcagtgtgatgcatgaagctctacataatcattacacgcagaaatctctttctctgagtctcgga

SEQ ID NO: 15800 - DNA, 1740 bp, Artificial Sequence
  Description of Artificial Sequence: Synthetic coding sequence
atgaaatgggtcagttttatcagtctgctttttctcttttcctcagcatatagtggatctctagataagcggcatggagaaggaacatttacatccgatgtatcatcatatttggaagagcaggctgctaaggagtttatcgcctggttagttaagggaagggggcatggagaaggaacattcacttccgatgtgtcaagttatctagaagagcaggccgccaaagagtttatcgcctggctggtgaaggggcgaggacatggggagggaactttcacatcggatgtttctagttatcttgaggagcaggctgccaaggaatttattgcgtggctcgtgaaagggagggggcacggagaggggacttttacatctgacgtaagtagttacctcgaagaacaggcagcgaaggaattcatcgcatggctcgtcaaaggaagaggacatggggagggaacatttacgtctgatgtgtctagttatctggaagaacaggcggcaaaagaattcatcgcatggctggttaaaggacgcggacatggggaaggaacttttacttctgatgtgagttcttacctcgaagaacaggccgccaaagagttcatagcctggttagtgaaaggaagagggcatggagaggggactttcacatccgacgtaagttcctatctggaagaacaggcggcaaaagaattcatcgcttggctggtcaaaggacggggacacggggagggaactttcacatctgatgtatcctcataccttgaagaacaggcagccaaagaattcatagcctggctggtcaaagggcggggacacggggagggaactttcacatccgatgtgtcaagttatctggaagaacaggccgccaaggagtttatagcttggctggttaaaggaagaggacacggggaggggacttttacttccgatgtcagttcctatctggaagagcaggccgccaaagaattcatagcctggctcgttaaagggcgcgggggaggaggggggggaggatccgggggaggagggtctggaggaggaggaagtgctgagtctaaatacggacctccatgcccaccatgtcctgcccctgaagcagcgggagggccttccgtttttctgttccccccaaaacctaaggatacactgatgatctcaagaacaccagaagtaacttgtgtggtggtggacgtttcacaagaggatcccgaagtgcagtttaattggtatgtggatggggtcgaggtacacaatgccaaaactaaaccccgcgaagaacagtttaacagtacttatcgggtcgtatccgtactcacagtgctacatcaggattggctcaacggaaaagaatataaatgcaaagtgtcaaataagggactgccaagttccatagaaaagactatctccaaggccaaggggcagccacgggagccacaggtctatacactccctcccagtcaggaagaaatgacaaagaatcaggtgtctttaacatgccttgtaaaaggattctacccctcagacatagcagtcgaatgggaaagtaacgggcagcccgagaacaattataaaactacacccccagtgttggattctgatgggagtttctttttatattccaggcttactgtagacaaaagtagatggcaggaggggaacgtgttcagttgctctgttatgcatgaagccttacacaaccactatacacagaaatcactttccctcagtctgggg

SEQ ID NO: 15801 - DNA, 1740 bp, Artificial Sequence
  Description of Artificial Sequence: Synthetic coding sequence
atgaaatgggtatctttcatttcattattatttttattttcatcagcatattctggatctttagataaaagacatggtgaaggaacatttactagtgatgtttcatcatatttagaagaacaagctgctaaagaattcattgcatggcttgtaaaaggaagaggacatggagaaggaactttcacttctgatgtttcttcttatttggaagaacaagcagcaaaagaattcattgcttggttggttaaaggacgtggtcatggagaaggaactttcacatcagatgtttcatcatatttagaagaacaagcagcaaaggaatttattgcatggttggttaaaggtagaggacacggagaaggaacttttacatctgatgtatcatcatatttagaagaacaagcagcaaaagaatttattgcatggttagttaagggtagaggacatggagaaggaacatttacttcagatgtttcatcatatcttgaagaacaagcagccaaggaatttatagcttggcttgtgaaaggaagaggacatggagaaggaacatttacaagcgatgtttcatcgtatttagaagaacaggctgcaaaagagtttattgcatggttagttaaaggaagaggacacggagaaggaacttttacttcagatgtttcatcatatttagaagagcaagcagctaaagaatttatagcatggttagttaaaggaagaggacatggtgaaggaacatttacttctgatgtatcttcatatcttgaagaacaagctgcaaaagaatttatagcatggttagtaaaaggacgaggacatggagaaggtacatttacgtctgatgtaagctcttatttagaagaacaagcagctaaagaatttattgcttggcttgttaagggaagaggacatggagaaggaacttttacatctgatgtatcatcatatcttgaggaacaagcagctaaagaatttatcgcatggttagtaaaaggaagaggaggaggtggaggggggggaagcggaggtggaggatctggggggggaggtagtgcagaatctaaatacggaccaccatgtccaccatgtccagcacctgaagctgcaggaggaccatctgtatttttgtttcctccaaaacctaaagatacattaatgatttcaaggaccccagaagttacatgtgttgttgttgatgtttcacaagaagatcctgaagtacaatttaattggtatgtagatggagttgaagttcataatgcaaaaacaaaaccaagagaagaacaattcaattcaacatatagagttgtatctgtacttacagtccttcatcaggattggttaaatggtaaggaatataaatgtaaagtaagtaataaaggtttaccaagtagtattgaaaaaactataagtaaagctaagggtcagcctagagaaccacaagtttatactctcccaccatctcaagaagaaatgacaaagaatcaagtatctttaacttgtttagttaaaggattctacccatccgatatagcagttgaatgggaatctaatgggcaaccagaaaataattataaaactactccaccagttttagatagtgatgggagtttttttttatatagtcgtttaactgtagataaatctagatggcaagaaggaaatgttttctcttgttcagtaatgcatgaagcattacataatcattatactcaaaaatctctttctttatctcttgga

SEQ ID NO: 15802 - DNA, 1740 bp, Artificial Sequence
  Description of Artificial Sequence: Synthetic coding sequence
atgaagtgggtgtcttttatctccttgctgtttctgttctcttcggcatactccggttcgctggataaaaggcacggtgagggtaccttcacctcggatgtgagtagttacctggaagaacaagctgcaaaagagtttatcgcatggctcgtgaaaggccgtggtcatggcgagggaacttttacctccgatgtgtcaagctaccttgaagaacaggcggcaaaggagtttatcgcatggctggtcaaaggtagaggccacggggaaggtacttttaccagcgatgttagcagctaccttgaagaacaagcagcgaaagagtttatcgcctggctggtgaagggccgtggccatggtgagggtactttcacttccgacgtgtcctcttacctcgaagagcaggcagcgaaagaattcattgcgtggctggtgaaaggaagaggtcatggggaaggaacctttacgtccgatgtgtcaagttaccttgaagaacaggccgcaaaagaattcatagcgtggctggtgaagggacgcggtcatggcgaaggcaccttcaccagcgacgtgtccagttacctcgaagagcaagccgccaaagaattcatagcttggctcgtaaaggggcgagggcacggcgagggtacctttacctcagatgtgtcgagttacctggaagaacaggcagcaaaggagtttattgcatggttggtcaagggacgcgggcatggggaagggacctttacttccgatgtgtcctcgtatctcgaggaacaggcagcaaaggagttcattgcatggctggttaagggacggggtcatggagaaggcaccttcactagcgatgtttcatcttacctggaggaacaagcggccaaagagttcattgcttggcttgtcaagggacggggacatggcgagggcacgtttacgtcagacgtgtcctcataccttgaggagcaagctgcgaaggaattcattgcctggcttgtcaagggccggggagggggcggaggaggtgggtcaggcggaggaggttccggaggaggtggaagcgcagagagcaagtacggccctccttgccccccatgtcctgcccccgaagccgcaggtgggccatcggtttttctttttcctccaaagcccaaggacaccctcatgatttcgagaaccccggaagtgacttgtgtggtggtcgatgtgagccaggaggaccctgaagtgcagtttaactggtacgtcgatggagtcgaagtccacaatgccaagactaagcctcgagaagaacaattcaacagtacctacagagtcgtgtccgtgcttaccgtgctccatcaagactggcttaacgggaaggaatacaagtgcaaggtaagcaacaagggactgccctcctccattgaaaagactatcagcaaggcaaagggtcagcctagggaacctcaggtctacactctgccaccgagccaggaggaaatgactaaaaaccaagtgtcattgacgtgtctggtgaaaggattttacccatccgatatcgcagtggaatgggaatcgaatgggcaacccgaaaacaattacaagaccaccccaccagtgcttgattcggacggatcctttttcctgtattcgcgactcactgtcgacaaatcgagatggcaagagggaaacgtgtttagctgtagcgtcatgcacgaagcactccataatcactacactcaaaagtcgctttcgctttccctgggt

SEQ ID NO: 15803 - DNA, 1740 bp, Artificial Sequence
  Description of Artificial Sequence: Synthetic coding sequence
atgaaatgggtgagcttcatttctcttctgttcctgttttcttccgcgtattccggcagtctcgataaacggcatggggagggaaccttcacatccgatgtctcttcatacctggaagaacaagcagctaaagaattcatcgcctggctggtgaaaggcagaggccatggggagggaacatttacaagcgacgtctccagctacttggaggagcaggcagccaaagagtttatagcctggcttgtgaaaggtaggggacacggggaaggcacctttacctctgacgtgagctcttacctcgaggaacaagctgctaaagagttcatcgcatggttggtgaaggggcgagggcacggtgagggcacattcacttcagacgtgagcagttacctggaagagcaggcggccaaggaatttattgcatggctcgtgaaaggcagaggccacggcgaaggcacattcactagcgatgtcagcagttacctggaggagcaggctgcgaaagaattcatcgcctggctggtgaagggccgcgggcacggcgaaggtactttcacatccgacgtctcaagttacctcgaggaacaagctgccaaggagttcatcgcctggctagtgaagggacgtggacatggggaaggtacatttacaagcgatgtgtctagttatctggaggagcaagccgccaaggaattcattgcctggttagtcaaggggcgggggcatggtgagggcacatttacaagtgacgtgtcctcttatttggaggagcaagcggccaaggaattcatagcatggttggtcaaaggtcgaggacacggagaaggcacctttaccagcgatgtcagttcttacctcgaggaacaggcagcaaaggaattcatcgcgtggttggtaaagggacggggccacggcgagggcacgtttacttctgatgtctcgtcttatctagaggagcaggcagctaaggagttcattgcctggcttgtaaagggacggggaggaggtggcgggggaggctccgggggtggcggaagcggtggtggggggagtgccgagagtaaatatggaccaccttgtcctccctgtcccgcgccggaagcagccggcggaccgagcgtattcttattcccgcccaagccgaaggataccctaatgatcagccggaccccagaggtcacgtgcgtggtcgttgacgtgtcccaagaagacccagaagtacagttcaattggtatgttgatggggtggaagtgcataacgccaagactaaacctagggaagagcagttcaattcgacttaccgtgttgtgtccgttttgaccgtcttacatcaggattggctcaacggcaaggagtacaagtgtaaggtatccaacaaaggcctgccatcctcaatcgaaaaaacaatctctaaagctaaaggacagcccagggaaccacaagtatacaccctgccaccctcacaggaagagatgaccaagaaccaggtttctttgacctgtctggtgaaaggcttctatccttcagatatcgctgtggagtgggaatcaaatgggcagcccgaaaacaactataagactacaccacccgtgctggatagcgatggttctttctttttgtatagcaggctgaccgtggacaagtcccgctggcaagagggaaacgttttttcctgcagcgtaatgcatgaggcactccacaaccactatacccaaaagagcctgagcctctcgttggga

SEQ ID NO: 15804 - DNA, 1740 bp, Artificial Sequence; identical to SEQ ID NO: 15755
  Description of Artificial Sequence: Synthetic coding sequence

SEQ ID NO: 15805 - DNA, 1740 bp, Artificial Sequence
  Description of Artificial Sequence: Synthetic coding sequence
atgaagtgggtgagttttatctcgttgctgttcctgttttccagcgcctattccgggtcgctcgacaagcgacacggcgaaggcactttcacatcagatgtgagttcttatctggaggaacaggccgcaaaggagtttatcgcttggctagtgaaagggaggggccatggtgaaggcacgttcaccagtgacgtgtctagctatctggaagagcaggccgcgaaggaatttatagcgtggctggtgaaaggaaggggacacggggaaggaactttcacgtccgatgtgtcctcgtatctagaggaacaggccgccaaggagttcatcgcctggctggtcaagggccgtggccacggggagggaacgtttaccagtgatgtgtccagctacctggaggagcaggcagccaaggaatttatcgcttggcttgtgaaaggacgaggacacggagaggggacctttacaagcgacgttagtagctatctggaggaacaggccgctaaagaatttattgcttggctggtgaaaggacggggccacggcgagggaacatttacatcggatgtcagctcgtatctcgaggagcaggccgccaaagagtttatagcctggctggtgaagggccgcggccatggcgagggaaccttcactagcgatgtcagttcttatctggaggagcaggctgctaaagagttcatcgcgtggttggtaaagggtcgcggtcacggcgagggaacgttcacgtctgatgtttcctcttacctagaggagcaggccgccaaggagtttattgcctggcttgtaaaaggacgaggacacggcgaggggactttcacaagcgacgtatcaagctatctagaggaacaggccgcaaaggagttcattgcctggcttgtgaagggcagaggccacggcgaggggacctttactagcgacgtgagcagttacctggaagagcaggccgctaaggaattcatcgcctggctggtgaaaggcagaggaggcggtggggggggcgggtcaggcggtggcgggtccggggggggcgggtccgctgagtccaagtacgggccgccatgtccgccctgccctgccccggaagccgccggaggcccctccgttttcctgttccctccaaagccgaaggatacactgatgatttcacgtacccctgaagtcacgtgcgtcgttgtcgatgttagccaggaggatccagaggtccagtttaactggtacgtggacggtgtggaggtgcacaatgcgaagactaagccccgcgaagagcagtttaactcaacctatagagtggtttccgtgctgactgtactgcaccaggattggttaaacggaaaggaatacaaatgtaaagtgtcaaataaaggtttgccatcttcgatcgagaaaaccatcagcaaggccaaggggcaaccccgtgagccacaggtttacacactgccaccatctcaggaagaaatgactaagaaccaggtctctctgacatgcctggttaaaggattctatccatctgatatcgcagttgaatgggaatccaacggacagcctgagaacaactacaagactaccccaccagtcctggacagtgatggttccttcttcctttactccagactgactgtcgataagtcacgatggcaggaaggcaacgttttttcgtgttccgtaatgcacgaagctcttcataaccattatactcagaagagcctctctctgagcctaggt

SEQ ID NO: 15806 - DNA, 1740 bp, Artificial Sequence
  Description of Artificial Sequence: Synthetic coding sequence
atgaagtgggtgtcatttatctctcttctttttcttttctcgagcgcatactcgggctcccttgataagcggcatggtgaaggcacctttacctccgatgtttcgtcgtaccttgaggaacaagcagcaaaagagttcatagcatggcttgtcaagggtcgcgggcacggggaaggcacttttacctctgatgtgtcatcctacctcgaagaacaagcagccaaagagttcattgcatggctggtaaagggaagagggcatggagagggcacgtttactagtgacgtctcgagctaccttgaagagcaggctgcgaaagagtttatagcctggctggttaagggacggggtcatggcgagggtactttcacttccgatgtctcctcgtatctggaagaacaagccgcgaaggagtttatcgcctggctggtcaaaggtcgcggacacggagaggggacttttaccagtgatgtgagctcataccttgaagaacaggccgcaaaggaattcatagcttggctcgtcaagggcagaggccacggggagggtacgtttacttccgacgtctcgtcatatctcgaggagcaagcagctaaggaattcatcgcatggctcgtgaagggtagaggtcatggcgaaggtacctttacgagtgacgtgtcctcatacctcgaagagcaggcagcaaaagaattcattgcttggttggttaaggggcgtgggcatggagaaggaacttttacttccgatgtaagctcttacctggaggaacaagcggcgaaagaattcatcgcgtggcttgtgaagggtcggggtcacggggagggaactttcacttcggatgtctcgtcatacttggaagagcaagctgccaaggagtttattgcctggttggtcaagggaagaggacacggtgagggtacttttacctcagacgtaagctcatacctggaagaacaggctgcaaaggagttcatcgcctggctcgtgaaaggacgcggaggaggtggagggggagggtcgggtggaggtgggtccggaggaggcggatcggcagaatcgaagtacggccctccatgtccaccttgcccagcacctgaagctgccggaggaccatcagtgtttctctttccgcctaaacccaaagacaccctgatgatctcgaggaccccagaagtgacctgtgtggtggtggatgtgagccaggaagatccggaagtccagttcaattggtacgtggatggagttgaagtgcataacgcaaagaccaagccaagggaagaacagttcaattctacctaccgcgtcgtgtcggttcttaccgtgctgcatcaggactggcttaatgggaaggaatacaagtgcaaggtgtccaataagggcctgccctcgtcaattgagaaaacgatctcaaaggcgaagggccaaccacgagagccccaggtgtacaccctgcctccgtcgcaagaagagatgacgaaaaaccaggtcagcctcacctgtctggtgaaaggtttttaccctagcgatatagcagtggagtgggaatccaacggacaacccgaaaacaactacaaaactactcctcctgtgcttgattccgacggtagttttttcctgtactcacgattgacggtggacaagtcccgttggcaagaggggaacgtgttttcctgtagcgtcatgcatgaggcactgcacaaccattacacccaaaagtcgctttcgcttagcctgggc

SEQ ID NO: 15807 - DNA, 1740 bp, Artificial Sequence
  Description of Artificial Sequence: Synthetic coding sequence
atgaagtgggtgagcttcatctccctgctctttttgttctcgtccgcgtacagcggatccctggacaagcgccacggcgagggtacttttacgagcgacgtctcgtcatacctcgaagagcaagccgctaaagagttcatcgcctggcttgtgaagggacggggccatggggaggggaccttcacgtcggatgtgagttcctatctggaagaacaggccgcgaaggaattcatagcgtggctcgtaaagggaaggggtcacggggaagggacttttacctcagacgtctcctcttatcttgaagagcaagcagccaaggagtttatcgcgtggcttgtcaagggaagaggccatggagaaggtacctttacctcggatgtcagttcgtaccttgaagaacaggctgcgaaagagttcattgcttggctggtgaagggacgcgggcacggggaaggaactttcacctccgatgtaagctcgtacctggaagagcaggcggctaaggagttcatcgcttggttggtaaaaggacgagggcacggagaaggcactttcacctcggacgttagctcataccttgaggagcaagctgccaaagaattcatagcctggctggtcaagggtaggggtcacggagagggcacctttacttctgacgtgtcaagctacttggaggagcaggctgcaaaagaattcatcgcatggctcgtcaagggtcgcggacatggagaaggaaccttcaccagcgacgtcagctcttacctcgaggagcaggcagcgaaagagtttatcgcttggctcgtgaaaggtagaggacatggcgaagggaccttcacttctgatgtctccagctacctggaggaacaggcagcaaaagagtttattgcatggctggttaagggacgggggcacggcgaaggaacctttacttcggatgtttcttcatacctggaagaacaagccgccaaggaattcattgcctggctcgtgaaggggagaggcggaggagggggaggaggttcaggcggaggcggctccggaggcggaggctccgcggaaagcaagtacggcccgccttgtcccccttgccccgccccggaggccgctgggggcccgtccgtgttcttgttcccgccgaaacctaaggacaccctgatgatcagccgaactccagaggtgacttgcgtggttgtggatgtcagccaggaggacccggaagtgcagtttaactggtacgttgacggcgtcgaagtccacaacgccaagaccaaaccacgcgaggaacaattcaattctacctaccgcgtggtgagcgtcctcacggtcctgcatcaggactggctgaatggaaaggagtacaagtgtaaggtgagcaataaaggactcccctcgtcgatcgaaaagactatctcgaaggccaagggacaacctcgggaaccacaggtgtacactctcccaccttcacaagaagagatgacgaagaatcaggtgtcgctgacttgcctggtgaaaggattctacccatcagatatcgccgtggaatgggagtcaaacgggcaaccagaaaacaactacaagactaccccgccggtgctcgactcggacggctcgttcttcctttactcaagactgaccgtggataagtctcgctggcaggaaggaaacgtgttctcatgctcagtgatgcatgaggcgttgcacaaccactacacccagaagtcgctgtccctgtccctgggt

SEQ ID NO: 15808 - DNA, 1740 bp, Artificial Sequence
  Description of Artificial Sequence: Synthetic coding sequence
atgaagtgggtttccttcatctcactgctatttttgttctccagtgcatattccggtagcttggataaaaggcatggggaagggactttcacatctgatgtgtctagctatcttgaagagcaggcagcaaaggagttcattgcttggcttgtgaaaggcagaggtcatggtgagggaacgttcactagcgacgtgagctcatatctggaagagcaggccgcaaaggagtttattgcctggttagttaagggcagggggcatggggaaggcacatttacctccgacgtttcctcctacctagaagagcaggcggcgaaggagtttatagcttggttagtgaagggcagagggcacggagagggtacatttactagtgatgtttccagctacctggaagagcaagccgccaaggaattcattgcatggctggtcaaggggcggggacacggggaaggcacgtttaccagcgacgtgagttcatatctggaggaacaagccgccaaagaatttatagcttggttggtaaaaggtcggggccacggtgagggcacattcacatcagatgtgtcatcatacctggaggagcaggcagccaaagagttcatagcgtggctcgtcaaggggaggggacatggggaagggacattcacttctgacgtaagcagttatttagaagagcaggccgcgaaagaatttatcgcttggctcgttaaagggagggggcacggcgaaggcacatttacaagtgatgttagttcgtaccttgaggagcaggcagctaaagaatttatcgcttggctggttaaaggtagagggcatggtgagggcacattcacttcagacgtgagcagctacttggaggaacaggctgccaaagaatttatagcctggttagtgaaggggaggggacacggcgaaggtacgttcacatcggatgttagtagctacctcgaggagcaggctgcaaaagagtttatcgcctggcttgtgaaaggtaggggtgggggcgggggtgggggatctgggggaggcggtagcggggggggagggagtgctgaatctaaatatggacccccatgtcccccgtgtccggcacccgaggcagccggtggcccatcagtcttcttgttccctcctaaaccaaaggataccctgatgatttccaggaccccggaggttacatgcgtggtggtggatgtaagccaggaggaccctgaagtacagtttaattggtacgtagacggagtagaagtgcataacgctaagactaagccacgagaggagcagttcaactcaacttaccgagtcgtctcagttctgaccgtattgcatcaggattggctaaacgggaaggaatataagtgtaaggtgtccaataagggccttccaagcagcatcgaaaaaaccatctccaaggccaaggggcagccccgggaaccccaggtatataccctgcctccttcacaggaagagatgactaaaaatcaggtgagcctgacatgcctggttaagggattttacccttctgatatcgctgtcgagtgggagtctaatgggcagcccgagaataattataagacaacccctccggtgctggactcggacggatctttcttcctgtactctcggctgaccgtcgacaagagccgatggcaggagggaaacgttttcagctgcagcgttatgcatgaggctctgcataatcattatacccagaagtcactctctctttctttgggg

SEQ ID NO: 15809 - DNA, 1740 bp, Artificial Sequence
  Description of Artificial Sequence: Synthetic coding sequence
atgaagtgggtgtcttttatctcactcctgtttcttttttcctccgcatactcggggtcgcttgacaagagacatggggaaggtactttcacgtcagatgtcagctcttaccttgaagaacaagctgcaaaggagttcattgcgtggcttgtcaagggtagaggccatggcgagggaactttcacttcggacgtgtcgtcatacctcgaagaacaagccgctaaggagtttattgcatggctggtgaagggaagaggtcatggggaaggcacctttacgtccgatgtgtcctcataccttgaggagcaagcagcgaaggagtttatagcatggttggttaagggccggggccatggtgaggggacttttaccagtgatgtgtcgtcctatcttgaagaacaggccgccaaagaattcattgcatggctcgtcaagggtcgcggacacggcgaaggaacctttaccagcgatgtatcttcgtacctggaggagcaagcggcaaaggaattcattgcctggcttgtgaaaggcagaggccatggagaaggaactttcacctcggatgtgagctcatacctggaagagcaggcagccaaggagtttatcgcatggctcgtaaagggtcgcggtcacggagaaggaacgtttacgagtgacgtgagctcgtatcttgaggagcaggccgcgaaagagtttatcgcgtggctcgtgaaggggcggggacatggggagggaacttttacctcagacgtgtcgagctacctggaggaacaagcggctaaagaattcatcgcatggcttgttaaaggtcggggtcacggtgagggcacctttacctcggacgtgtccagttacttggaggaacaggccgcaaaagagtttatagcgtggctggtcaagggtcgaggtcatggagaaggtacttttacctcggatgttagcagttacctggaagaacaggcagcaaaagagttcattgcttggttggtcaaagggaggggcggaggaggaggagggggtagcggtggaggaggctccggtgggggaggcagcgcggaaagcaagtacggtccaccttgtcccccttgcccagcacctgaagccgccgggggaccatcagtgtttctgttcccacccaagccaaaggatacccttatgatcagccgtactcctgaagtgacctgtgtcgtggtggatgtttcccaggaagatccagaagtgcagttcaactggtacgtggacggtgtggaagtgcataatgcaaagactaagcctcgggaagaacagtttaactcgacttaccgagtcgtgtccgtcctgaccgtcctccaccaagactggctgaatggaaaggaatacaagtgtaaagtgagcaacaagggactcccctcgtccattgaaaagaccatctccaaggcaaaaggacaacctagagaaccgcaagtgtatactctccctccaagccaggaagaaatgactaagaaccaagtgtccctgacctgccttgtcaaaggattctaccctagcgatattgcagtcgaatgggaatccaacggacagcccgagaacaattacaaaactacccctccggtcctcgattcagacggcagtttctttctgtactcgcgccttaccgtggataagtccaggtggcaagaaggaaacgtattttcctgttcggttatgcacgaggcactgcataatcactacactcaaaagtctctgtctctgtcacttggg

SEQ ID NO: 15810 - DNA, 1740 bp, Artificial Sequence
  Description of Artificial Sequence: Synthetic coding sequence
atgaagtgggtaagttttatctccttgctgttccttttcagctccgcctactctggttcgctagacaagagacacggggaaggcacgttcacaagcgatgtgtcatcttatctcgaagagcaagcggccaaagagttcatcgcatggctggtcaaggggaggggccacggggaaggaacattcacctcggacgtctcaagctatctggaggagcaggcggcaaaagagttcattgcgtggctggtgaagggtagaggtcacggcgagggaaccttcacatcagatgtgtcctcttacttggaggagcaagcagcgaaagagttcatcgcctggttagttaagggaaggggccatggcgagggcacattcacctctgatgtctcctcgtacctggaggagcaggccgcgaaagagttcatcgcttggttagtcaagggccgcgggcatggggaagggactttcacttccgatgtcagctcttatctggaggagcaggctgccaaagagtttatagcttggctggttaaggggcgcggtcatggagagggtacctttacatccgacgtctcaagctacctggaggaacaggccgccaaagaatttattgcatggctcgttaaaggccgaggccacggggaggggacattcacgtcggacgtttcatcttatctggaagagcaagccgccaaagagtttatagcctggctggtcaagggtcgcggacacggggagggcacttttacatcagatgtttcctcctatctggaggaacaggccgcaaaagaattcatcgcatggctcgttaaagggagaggccacggtgaagggaccttcacaagtgacgtctcctcgtatctcgaagaacaagcggccaaagagtttatagcatggcttgtgaagggtcgcgggcacggagaaggaacgttcacctctgacgtcagcagctatttagaagagcaggccgccaaggaattcattgcatggctggtgaaagggcgagggggaggtgggggaggaggctctggtgggggcggtagcggaggaggcggcagtgcagaatccaagtacggcccaccttgccccccatgtcctgctccagaggcagcaggaggaccgtccgttttcctgtttccacccaagcctaaggataccctgatgatatccagaacgcccgaggtgacttgcgtggttgtggacgtgagccaggaggatccagaggtgcaatttaactggtatgtggacggggtggaagtgcacaatgccaaaaccaagcctagagaagagcagttcaacagcacatatcgcgtggtgtctgtgctcactgtgctgcaccaggactggctgaacggaaaagagtacaagtgtaaagtttcaaacaaaggacttccttcatccattgagaaaactatctcaaaggccaaaggccagccgcgagaaccccaggtctatacactcccaccatcgcaggaagagatgaccaagaatcaggttagcttaacctgcctcgtgaaaggcttctatccttcagatatagcggttgaatgggagtcgaacggacagcccgaaaacaattataagacaactcccccggttctagattctgacggatccttttttctctactcccggctaacagttgacaagagtcgatggcaggaaggtaatgtctttagctgttctgtgatgcacgaggcactacacaatcattatactcaaaagtcgttatcattaagtttaggg

SEQ ID NO: 15811 - DNA, 1740 bp, Artificial Sequence
  Description of Artificial Sequence: Synthetic coding sequence
atgaagtgggtgtctttcatatcactcttattcctgttttcatctgcctactcaggcagcttggataagcgacacggggagggaactttcacctccgacgttagcagctacctcgaggagcaggcggctaaagaattcatcgcctggcttgtgaaagggcggggacacggcgaaggcacttttacctcggatgtgtcctcgtatctggaggagcaagcagccaaggagttcatcgcctggcttgtgaagggaaggggccacggggaaggcacatttacatcagatgtgtcatcctatttggaggagcaggccgctaaagaatttattgcatggctcgtgaaggggcgagggcacggcgaaggaactttcactagtgacgtctcatcctatctagaagagcaggccgctaaagagtttattgcgtggctggtaaagggacgcggtcatggagaaggcacctttacaagtgatgtctcgagttatcttgaggaacaggctgccaaggagttcattgcctggctggtgaagggccgcggtcatggggaggggacgtttaccagcgacgtgagttcttacctcgaagaacaggccgccaaggagttcatcgcctggcttgtgaaaggtagaggacatggggaaggaaccttcacttcagacgtctcttcctacctggaggagcaagctgccaaagagttcattgcatggttagtgaaaggcagaggacatggcgaggggaccttcacttccgacgtcagctcctacttggaggaacaggctgccaaggagttcatcgcatggctggtgaaagggagaggacacggcgaagggaccttcacttcagacgtctcatcctacctcgaagagcaggctgccaaggagttcattgcgtggctggtcaagggccggggccatggggaggggacattcacttccgacgtcagttcgtatcttgaggagcaagcagccaaggagttcatagcatggctggtgaaggggcgagggggggggggcggtggcggatctggcggtgggggaagtggtggcgggggttctgccgaatccaaatatggaccaccatgtcctccgtgcccggcgccggaagccgccggcgggccgtctgtgtttctcttccctccaaagcctaaggacaccttgatgataagtcgcaccccagaggttacgtgtgtagtggttgacgtctcacaggaagaccctgaggtacagttcaactggtatgtggatggcgtggaagttcacaatgcgaagacaaaaccccgcgaagagcagtttaattccacttatagggtcgtttccgtattaactgtcttgcatcaagattggcttaatggaaaggagtacaagtgtaaggtgagcaacaagggccttccttcgtctatagagaaaacgatatctaaagcaaagggccaacctcgggaacctcaggtgtacacgctgcccccaagtcaagaagaaatgactaagaatcaggtatcactgacgtgcttggtgaagggtttttacccttctgacatcgccgttgagtgggaaagtaacggacagcctgaaaacaactacaaaaccacccctcccgtgctggacagcgatgggagtttttttctgtactcccgactgacggttgacaaaagcaggtggcaagaagggaacgttttctcctgtagcgtgatgcatgaagcgcttcataaccactatactcagaagagcctgtcactatccctgggc

SEQ ID NO: 15812 - DNA, 1740 bp, Artificial Sequence
  Description of Artificial Sequence: Synthetic coding sequence
atgaagtgggtgtctttcatttctctcctcttcctgttcagcagcgcctactccggatcgctggataaaaggcacggagagggtaccttcacctcggacgtttcctcatacctggaagaacaagcggcaaaagagtttatcgcgtggttggtcaagggacggggtcatggagaaggtactttcacgtcggacgtctcctcatacctcgaggaacaagccgctaaggaattcatcgcgtggctcgtaaagggacggggccacggagaagggactttcacctcggacgtttcatcatacctcgaggagcaggcggccaaagaattcattgcctggctcgtgaagggtcgcggacatggagaaggaaccttcacttcagacgtctcgtcgtacctggaagagcaggcagctaaggagtttattgcatggctggtaaaaggccgcggacatggcgaggggacttttacttccgacgtgtcgtcgtaccttgaggaacaggctgccaaagaattcatcgcatggttggttaagggccgtggacacggtgagggcaccttcacttctgacgtgagctcttacttggaagaacaagctgctaaggaattcattgcctggttggtgaagggtaggggacacggcgaaggcactttcacctctgatgtctcctcgtatctcgaagagcaagcagcgaaggaattcatcgcctggctggtaaagggtcgcggtcatggtgaaggcacctttacgagcgacgtcagctcctatttggaggaacaagctgctaaggagttcatagcctggctcgtgaaaggacggggacatggagaggggaccttcaccagtgacgtcagcagctaccttgaagagcaagctgcgaaggagtttatcgcctggcttgtgaagggacgagggcacggcgaaggaacgttcacttcagacgtgtcaagctatctggaggagcaggcagccaaagagttcatcgcctggttggtgaaaggacgaggagggggaggtggaggaggctcaggagggggcggttccggaggtggcggtagtgcagagagcaaatacggacccccgtgccccccatgtccggcaccagaagcggccgggggaccaagcgtgttcctctttcctcctaagccgaaggacacgctcatgatcagccgcacccccgaggtgacttgcgtggtggttgatgtgtcccaggaagatccggaagtccagttcaactggtacgtcgatggcgttgaggtgcacaacgccaaaactaaaccgcgggaggagcagttcaactcaacctaccgggttgtgtccgtgcttactgtgctgcatcaggattggctgaatggaaaggaatacaagtgcaaagtctcaaacaagggactgccgtcatcgatcgaaaagaccatctccaaggccaagggacagccgagggagcctcaagtgtacaccctgcctccgtcgcaggaagagatgaccaagaaccaagtgtcgctgacctgtctggtcaaggggttttacccaagcgacatcgcagtggagtgggagtccaacggccagccagagaacaattacaagactacgccgcctgtgctggattccgatggcagtttctttctctactctcgcctcactgtggacaagagcagatggcaggaaggaaatgtgttctcatgctccgtgatgcacgaagcgctgcacaatcactacacccagaaatccctgtcccttagcctgggg

SEQ ID NO: 15813 - DNA, 1740 bp, Artificial Sequence
  Description of Artificial Sequence: Synthetic coding sequence
atgaaatgggtctcgtttatttctcttctgttcttgttcagcagtgcatatagcggtagtctcgacaaacgccatggtgagggaacattcacgtcggacgtgtcctcgtatcttgaagagcaagccgcaaaagagttcatagcttggctcgtcaagggacgaggccatggagaggggaccttcacaagtgacgtctcctcctaccttgaagagcaagctgctaaagaattcatcgcctggctcgtaaaagggagggggcatggagaaggaacctttacaagtgatgtgtcatcatacttggaggaacaggcagctaaggaatttattgcatggctcgtaaagggcagggggcatggggagggcacattcacgtctgatgtgtcgtcttaccttgaggagcaggctgccaaagaattcattgcctggctcgtcaaaggacggggtcacggcgaaggtacattcacgtcggatgtgagctcctatctagaggaacaggctgctaaggaattcatcgcgtggctagttaaaggacgcggccatggagagggcacatttactagcgatgtgagtagctatctggaggagcaagcggctaaggaattcattgcttggttggttaagggacgggggcacggagaaggcacctttacctccgatgtgagctcgtatcttgaggagcaagcggcaaaagagtttatcgcgtggctagtgaaggggcgaggtcatggtgaaggaactttcacctcggatgtgtcctcttacctcgaggaacaggcggccaaggagttcattgcctggctcgttaagggtcgaggccacggcgaaggtacatttacttctgatgtttcctcatatcttgaagagcaagctgccaaagaattcattgcttggctagttaagggtcgtggccatggagaggggacgtttacgtctgatgtgagcagctacttagaggagcaagccgccaaggaatttattgcctggctggtcaaaggacgagggggcggaggtggtgggggatcgggcggcggaggcagtggtggtggtggtagtgcagagtcgaagtatggtccgccatgtccgccgtgccctgcccctgaagctgctggaggaccctcagttttcctcttcccccccaaaccaaaagacacactgatgatctcccggaccccagaagtcacctgtgtcgtcgtggacgtttcacaggaggatccagaggtgcagttcaactggtatgtggacggcgttgaggttcacaatgctaaaaccaaaccccgcgaggagcagtttaactccacctaccgcgtcgtcagtgtgctaacagtgttgcatcaggattggctcaatgggaaggagtacaaatgtaaggtttctaacaaaggattaccttcgtccatcgaaaaaaccatctcaaaggccaaaggtcagccgcgggagcctcaggtctatacgttaccaccatcacaggaggaaatgactaagaaccaagttagcttaacgtgtctagttaagggattttacccatcggacatcgcagtagaatgggagtcaaacggacaaccagaaaataactacaagacgacgccgcccgtcctagattcggatggtagttttttcctgtatagtcgtttgactgttgataaaagccggtggcaagagggcaacgtcttttcatgttcagtgatgcacgaggcacttcacaaccattatacgcaaaagagcttgtcgctttctttggga

SEQ ID NO: 15814 - DNA, 1740 bp, Artificial Sequence
  Description of Artificial Sequence: Synthetic coding sequence
atgaagtgggtgtccttcatctccctgctcttcctcttctcgtcagcttactccggctcgctggacaagcgccatggtgagggaacgttcacctcagatgtttcctcgtacttggaagagcaagccgccaaagagtttatagcgtggctggtcaaggggcgtggacatggcgagggtacctttacctccgatgtctcatcatacttggaggaacaggcagccaaagagttcattgcatggcttgtcaaaggacggggacacggggaaggaacctttacttctgacgtgtcatcttacctggaggaacaagcggctaaggagttcattgcttggttggtgaaagggcgaggacatggggaaggaactttcactagcgacgtctcaagctatcttgaggagcaggcggcaaaggaattcatcgcttggctggtgaaggggagagggcacggagaaggtacttttactagcgacgtctcgtcataccttgaagagcaagccgcaaaggagtttatcgcgtggctcgtcaagggtcggggacatggggagggtaccttcacgagcgatgtgtcgagctatcttgaggaacaagcagcgaaggagttcatcgcttggctcgttaagggacgcggccacggcgagggcacgttcacttcagacgtcagctcctacctggaagaacaggctgcaaaggagttcatagcctggctcgtgaaaggcagaggacacggagaagggacctttacctccgatgtgtcctcatacctggaagagcaggccgcgaaagaattcattgcctggctggtgaagggcagggggcacggggaaggtaccttcacttcggacgtcagctcatatctcgaagaacaagctgcgaaagagttcatcgcctggcttgtgaagggccgcggacacggcgaaggcaccttcacgtccgacgtttcgtcctatctggaggaacaggccgctaaggagttcatcgcatggcttgtcaaaggccggggtggaggaggcgggggcggatcgggtggaggaggctcgggcgggggcggtagcgcagaaagcaagtacggaccaccctgccctccgtgcccggctcccgaagcggcaggcgggccatcggtgttcctcttcccgccgaagccgaaggataccctgatgatctcccggacccctgaggtgacttgcgtcgtggtggacgtgagccaggaggaccctgaggtgcagtttaactggtacgtggacggcgtggaagtacataatgcgaaaactaagccgcgcgaggagcagtttaactccacctaccgcgtcgtatctgtcctcactgtgctgcaccaagactggctgaatggaaaagagtacaagtgtaaggtgagcaacaagggactgccttcctcgatcgaaaaaactatctcgaaggccaagggacaaccacgcgaaccccaggtgtacaccctccctccaagtcaagaagaaatgaccaagaatcaggtgtccctcacttgtctggtcaaggggttttacccttctgacatcgcagtcgagtgggagtcgaacggacaaccggaaaacaattacaaaaccacgccaccggtgcttgattcagatggttcctttttcttgtactcgagactcactgtggacaaatcaaggtggcaggaaggtaacgtgttcagctgctcggtgatgcatgaagcacttcacaaccactacacccagaagtccctctccctgagcctgggc

SEQ ID NO: 15815 - DNA, 1740 bp, Artificial Sequence
  Description of Artificial Sequence: Synthetic coding sequence
atgaagtgggtatcattcatttcgctgctgtttctgttttcatcagcatactcaggatcgttggacaagcggcatggagaaggtacctttacctcggatgtatcctcgtatctcgaagaacaggctgcgaaggagtttatagcttggcttgtgaaagggcgcggtcatggagaaggcacctttacttcggatgttagttcctacctcgaggaacaggctgcaaaagagtttattgcgtggctggtaaagggacgcggacacggtgaaggcactttcacctcagatgtgtcatcatatctggaagaacaggcagcgaaggaattcattgcctggcttgtgaaggggcgtggccacggagaagggaccttcacctctgatgtgagttcatacctcgaggagcaagctgccaaggagttcatcgcgtggctggtcaaagggcggggacacggcgaaggtactttcacgagcgatgtctcctcctaccttgaagagcaggcagcgaaagaattcatagcatggctcgtcaagggtagagggcatggcgaggggacgtttaccagtgacgtgtccagctacttggaagaacaagcagccaaagagtttatcgcatggctggttaagggccgtggtcacggagaaggaacttttacttcagacgtgagctcgtacttggaagagcaggccgcaaaggagtttattgcttggctcgtgaagggcagaggacatggcgaagggacctttactagcgacgtctcgtcgtacctggaggaacaagccgctaaggagtttatcgcttggctggttaaaggcaggggtcatggagagggaactttcacttccgacgtgagctcctatcttgaagaacaggccgctaaggaattcatcgcatggttggtgaagggacgaggacatggtgaaggaacctttacctccgacgtttcttcgtaccttgaggaacaggcagcaaaagagttcattgcatggcttgtcaagggacggggaggtggcggaggtggtggatccggaggaggtggaagcgggggtggcggaagcgcagaatccaaatacggtcctccctgtccgccctgtccagcccctgaagccgcaggagggccttccgtgtttctctttcctcctaagccgaaggataccctgatgatatcgcgcaccccagaggttacttgtgtggtggtcgatgtgtcgcaagaggatcctgaggtgcagttcaattggtacgtggacggcgtggaagtgcataatgcgaaaacgaagccaagggaagagcagtttaactccacttacagagtcgtaagcgtgctgaccgtccttcatcaagattggctcaacgggaaagaatacaagtgtaaagtgtctaacaagggtctgccgtcaagcatcgaaaagaccatttcaaaagcaaagggacaacctcgggaaccacaggtctacacgctgccaccctcgcaagaagaaatgaccaagaaccaagtgtcactcacgtgcttggtgaagggtttttacccatctgacattgcagtggaatgggaaagcaatgggcaacctgaaaacaattacaaaaccactcccccagtccttgatagcgatggctctttctttctttactccagacttactgtggataagtcgagatggcaagagggtaacgtgttttcgtgctcggtgatgcacgaagcacttcataaccactacactcaaaagtcgctgtctcttagcctgggg

SEQ ID NO: 15816 - DNA, 1740 bp, Artificial Sequence
  Description of Artificial Sequence: Synthetic coding sequence
atgaagtgggtgagcttcatctccctccttttcctcttcagctccgcctactcgggatcgctcgataagcgacacggcgagggaacgttcacttcagacgtatcttcatacctggaggagcaagccgcaaaggagtttatcgcctggctggtgaagggaagaggtcacggggagggcacctttactagcgatgtgtcatcctacctggaagagcaggctgccaaagagttcattgcgtggctcgtgaagggacgcggccacggcgaaggaactttcacttcggatgtctcgagctaccttgaagaacaagccgcgaaagaattcatcgcgtggttggtcaagggtcgcggacacggtgaaggtacgttcaccagtgacgtcagcagctacctggaggagcaagccgccaaggaatttattgcttggctggttaagggcagggggcacggagaaggcaccttcacctctgacgtctcgtcatatcttgaggagcaggcggccaaggagttcatcgcctggctggtgaaaggacgcggacatggtgagggcactttcacgtcggatgtgtcctcctatctcgaggagcaggccgcgaaagaattcattgcatggcttgttaagggacgggggcatggagagggtactttcacctcagatgtctcatcctaccttgaggaacaagcggccaaagaatttatcgcttggttggtgaagggccggggacatggcgaagggacctttaccagcgatgtctccagctacctcgaggaacaggctgcaaaagaatttatcgcgtggctcgtgaaaggcagaggacatggggaaggaactttcacttcggacgtctcctcatacctcgaagagcaagcagccaaggagttcatcgcttggctggttaagggccggggacatggagaaggcacttttaccagcgacgtgtcctcttaccttgaagaacaagcagctaaggaattcatagcctggctcgtaaagggacgtggcggtgggggcggaggaggaagcggaggtggggggtccggaggaggtggatccgcggaaagcaaatacgggccaccttgccccccgtgccctgcaccagaagcggccggaggaccatcagtgtttctgttcccgcctaagccgaaagacaccctgatgatctcgcgcactccggaagtgacctgcgtggtcgtggacgtcagccaggaggacccagaggtgcagttcaactggtacgtcgacggtgtcgaagtgcacaacgcaaagaccaagccgagagaagaacagttcaattccacgtaccgggtggtgtccgtgctcaccgtgctgcaccaggactggttgaatggaaaggaatacaagtgtaaagtgtcaaacaagggactgccgagttccatcgaaaagaccatcagcaaggctaagggacaacccagggagccacaggtgtacactctgccgccaagccaggaagaaatgactaagaatcaggtgtccctgacctgtctggtcaaagggttctacccgtcagatatcgcagtggaatgggagtcaaacggacagcccgagaacaactacaaaaccactccgcctgtgctggactcggacggcagctttttcctgtactcgcgcctgactgtggataagtcgcggtggcaggagggcaatgtgttctcgtgctcggtgatgcacgaagccctgcataaccactacacccaaaagtcgttgtcgctgtcgctggga

SEQ ID NO: 15817 - DNA, 1740 bp, Artificial Sequence
  Description of Artificial Sequence: Synthetic coding sequence
atgaaatgggtttcatttatctctctcctgtttctgttctcaagtgcctatagcggtagcctggataaacgacatggcgagggaacattcacatctgatgtatccagctatttggaggagcaggccgccaaggaattcatcgcttggttggtaaagggtcgcggacatggtgagggaaccttcaccagcgacgttagcagctatctggaggagcaggccgccaaagagtttattgcctggctcgtaaagggtagagggcatggggaaggtacattcacaagcgatgtgagctcatacctcgaagagcaagctgcaaaggaatttatcgcatggctggtcaaaggtcgtggccacggagagggaacatttaccagcgacgtgtcctcatatctcgaagagcaggccgccaaagaattcattgcctggctggtgaaaggacgcggccacggagagggcacttttacttctgatgtgagctcctatttggaagaacaggctgccaaggaatttatcgcctggctcgtgaagggcaggggccatggcgagggtacattcacctccgatgtctctagttacctggaggagcaagccgcaaaagagtttattgcttggcttgtaaaagggcggggccacggcgaaggcacattcactagtgatgtcagttcctaccttgaggagcaggccgcaaaagagttcattgcttggttggtcaaaggacgaggtcacggagaggggacttttacctctgatgtttcatcttacctggaggagcaggccgcgaaagaattcattgcctggctcgttaaggggagagggcacggcgaagggacattcacttccgacgtgagcagttacctggaagagcaggcagcaaaggagttcattgcatggctcgttaaggggcgtggccacggcgaaggcactttcacatccgacgtgtctagctatctggaggaacaggcagccaaggagttcatcgcatggctggtgaaaggaagaggggggggaggtggagggggaagcgggggtggagggtcagggggggggggttccgccgagagcaagtacggacccccttgcccaccatgcccggcccctgaggcggccggcgggccttcagtgtttttgtttccacctaagcctaaggatacactgatgatttcacgtacccctgaggtgacatgtgtggtcgtcgatgtaagtcaggaggatcccgaagtacagttcaattggtatgttgacggcgtcgaggtgcacaacgctaaaacaaaacctcgcgaagaacagttcaattcgacctatcgggtggtgtccgtgttgacagtcctgcatcaagattggttgaacggaaaggaatataaatgcaaagtgtccaacaaagggctgcctagctccattgaaaaaactatctccaaggccaagggccagccaagagaacctcaggtgtacactctgcctccgtcccaggaggagatgactaagaaccaggtgagcttgacttgcctcgtaaagggtttttatccctctgatatcgccgtggaatgggaaagtaacggccagcctgaaaataattataaaactaccccccctgtgctggattctgacggtagctttttcttgtactccaggctcactgtcgataaaagcagatggcaggagggtaacgtgttcagttgcagtgttatgcatgaagccctccacaatcattatacccagaagagcctttctctgtcacttggt

SEQ ID NO: 15818 - DNA, 1740 bp, Artificial Sequence
  Description of Artificial Sequence: Synthetic coding sequence
atgaagtgggtgagcttcatctccttgctatttctcttcagttccgcgtatagcgggagcttggataagaggcatggggagggcaccttcacatcagacgtgtcttcctaccttgaggagcaggcagcaaaagaatttattgcatggttggtgaaaggcagaggccatggggaggggaccttcacaagcgatgtgtcctcgtatcttgaagaacaagccgcgaaagaattcattgcatggctcgttaagggtagaggccacggagagggcacatttactagtgacgttagctcgtaccttgaggaacaggccgctaaagagttcattgcatggctggtaaaagggagaggacatggggaaggtacattcacttcagacgtgtcgtcctatcttgaggaacaagctgctaaagaattcatcgcctggctggttaaaggccgggggcacggggagggaacttttacttcagacgtgtccagctacttggaggagcaggcagccaaggagttcatcgcctggttagtgaagggtagaggacacggcgagggcactttcacctccgatgtctctagttatctggaagagcaggccgccaaggaattcattgcctggctggtgaaagggcgggggcacggagaaggcacttttaccagtgatgtatccagctatttggaagaacaggccgccaaggagttcatcgcctggctggtgaagggtcgcggccacggggaggggacctttacgagtgatgtgagctcctacctggaagagcaggctgccaaagagttcatcgcatggctggtgaaggggagagggcatggggaagggactttcacatcagacgtgagcagctatctcgaggaacaagccgccaaggaattcattgcatggctggttaagggaaggggtcacggggaaggtacctttactagcgacgtgagcagctatctggaggagcaggccgctaaggagttcatagcctggctggtgaagggtcgggggggcggtggaggcggcggaagtggtggcgggggctccggaggggggggttctgctgagagtaagtatggtccaccatgccctccatgtcctgcccccgaggccgctggcgggccttctgtgttcctttttccaccaaagcccaaagatacactgatgatttctaggactcccgaggtgacctgtgtcgttgtggacgtaagccaggaggatcctgaggtgcagttcaattggtacgtggacggggtcgaagtacacaacgcgaagaccaaaccaagggaagagcaatttaatagcacatatagggttgtcagcgtcttgaccgttctgcaccaggactggttgaacggcaaagagtataagtgtaaagtctccaataaaggactcccctcttcaatagaaaagaccatttctaaggccaagggacagcccagagagccccaggtctacaccctccccccctctcaggaggagatgactaaaaatcaggtgagtttgacatgtctggttaagggattttacccctctgacattgccgtggagtgggaatccaacgggcagcccgaaaacaattacaagaccacaccgcccgtgctcgattccgatggctctttctttctgtatagcaggcttaccgttgataagagccggtggcaggaggggaacgtgttcagttgcagcgtgatgcatgaggccctgcacaaccattacacgcagaagtccttgtctctcagcctcgga

SEQ ID NO: 15819 - DNA, 1740 bp, Artificial Sequence
  Description of Artificial Sequence: Synthetic coding sequence
atgaagtgggtttccttcatctctttgctgttcctctttagtagtgcttatagcggtagtctggacaagcgtcacggcgagggtactttcacttcggatgtctcgtcctatcttgaagagcaggctgctaaggagttcatcgcctggctagtgaagggccgtggccacggcgagggtaccttcacatctgacgttagttcttacttggaggagcaggcggccaaagagtttatcgcgtggctcgtcaagggacgggggcatggtgagggaacttttacctccgatgtctcgtcctacctggaggagcaggccgctaaagagtttatcgcatggcttgtcaagggccgcggacacggggagggtacgttcacttccgacgtctcttcgtaccttgaggaacaggctgccaaggagttcattgcctggttggtcaaaggccgtggtcatggtgagggcactttcacctcggacgtaagcagctacttggaggagcaagctgcaaaggagttcatcgcgtggcttgtgaagggtcgcggtcacggagagggcaccttcaccagcgatgtctccagctatttggaggagcaggccgccaaggaatttattgcttggctcgtcaaaggtcggggtcacggtgagggcacgtttacatctgacgtctcctcttatttggaagagcaagcggccaaggaattcatcgcctggctggtcaagggccgtggccatggagagggaacttttacttccgacgtgagtagctacttggaagagcaagccgccaaggagttcatcgcctggctcgtcaagggtcgtggccatggtgaaggcactttcacctccgatgtatcttcctacttagaggaacaagcggctaaagagttcatcgcatggctagtcaaaggccgcggtcacggagagggtaccttcacgtccgatgttagttcctacctcgaagagcaagctgccaaggagttcattgcatggttggtaaaggggcgaggcggaggcggcggaggcggttccggtggaggaggtagcggtggtggaggctctgccgaatcgaaatacggtcccccttgtcccccttgcccggccccggaagcggctggaggaccctctgtcttcctattccccccgaagcccaaggatacgcttatgataagtcgcacgccagaagtcacatgcgtggtcgtagacgttagccaagaggaccctgaggtgcagttcaattggtacgtggatggtgtcgaagtacacaatgccaagacaaagcctcgagaagagcagttcaactcgacgtaccgtgttgtctccgtgctcactgtcctgcaccaagattggctgaacgggaaggagtacaagtgcaaggtctctaataagggtctgccatcctcaatcgagaagaccatctccaaggccaagggccagccgcgcgaaccacaggtatatactctccctcccagccaggaggagatgaccaagaaccaagtgagcctcacctgccttgttaagggtttctacccttctgatatcgccgtggagtgggagagtaacggacagccggagaataattacaagactacccctcccgtcctggattcagacggaagcttcttcctgtactctcgcctcaccgtcgataagagtcgttggcaagagggcaacgtcttctcctgttccgtaatgcacgaagcgctgcacaaccactatacgcagaagagcttatcactgagcctcggg

SEQ ID NO: 15820 - DNA, 1740 bp, Artificial Sequence
  Description of Artificial Sequence: Synthetic coding sequence
atgaagtgggtgtcctttatctcgcttctgttcctgtttagctctgcatactcgggctcgctcgacaagcgtcatggagaaggcacctttacctccgacgtttcttcctacctcgaggaacaggctgcaaaggagtttatagcgtggttggtgaagggtcgaggtcacggggaaggaaccttcacctccgatgtgtcgtcttaccttgaagaacaggccgcgaaggagtttatcgcgtggctcgttaagggtcgtggtcatggtgaaggaacctttactagtgatgtgagttcctaccttgaggagcaggcggcgaaggagttcatagcttggctggttaagggtaggggtcatggcgaaggaacgttcacttccgacgtgtcaagttatctcgaagaacaggcagccaaagagtttattgcctggttggtaaaaggacgcggccatggtgagggtaccttcacgagcgatgtatcaagctacctggaagaacaagcggcgaaagaattcatcgcttggttggtcaaaggacgagggcacggggaggggacgtttacttctgatgtgagctcttacctcgaagaacaagcagctaaggaattcatcgcctggctggtcaagggccggggacatggggaaggaactttcacttcggacgtctcgagctatcttgaagaacaagccgcaaaagagtttatcgcatggctggtgaaaggcagaggacatggagagggcacttttactagcgatgtctcctcttacttggaagagcaagcagcaaaggagttcattgcatggctcgtgaagggcagaggccacggagagggaacttttacttctgacgtgtcctcctaccttgaagagcaggccgctaaagagtttatagcctggctcgtcaaaggaagaggacacggagaagggaccttcacgtcggatgtctcgtcgtatctggaagagcaggcagcaaaggaattcattgcctggcttgtgaagggtcgcggaggaggcgggggaggagggtccggaggagggggcagcggtggcgggggatccgcagaatcaaagtacggacctccctgtcctccgtgtcctgcacctgaagcagcaggtggtccttcagtgtttctgtttccgccaaaaccaaaagacactcttatgatttcacggaccccagaggtcacctgtgtggtggtggatgtctcacaagaagatcccgaagtccagtttaactggtacgtggatggggttgaggtgcataacgcaaagaccaagcccagggaagaacagttcaatagcacctacagagtggtgtcggtgctgaccgtgctgcatcaagactggctgaatggaaaggaatacaaatgtaaagtgtcgaacaagggactcccgagtagcattgaaaagacgattagcaaggcaaagggtcaaccccgagaacctcaagtctacaccctgcctccatcgcaggaggaaatgacgaagaaccaagtgtccctgacttgccttgtgaagggcttttacccatcggacattgccgtggaatgggaaagcaacggacaaccagaaaacaattacaagaccactccacctgtccttgattcagatggatccttttttctttactcgcggttgaccgtggataagtcgcgctggcaagagggtaatgtgttttcgtgctcagtgatgcacgaagcacttcacaaccattacacccagaagagccttagcctgagcctcggt

SEQ ID NO: 15821 - DNA, 1740 bp, Artificial Sequence
  Description of Artificial Sequence: Synthetic coding sequence
atgaagtgggtgtcattcatcagcctgctgttcttgttttcgtctgcctactcaggttcactggataagcggcatggtgaaggaacttttacctctgatgtatcgagctacctggaggaacaagctgccaaagaattcatcgcctggttggtcaaggggcgcggacatggtgaggggacgtttacctcagacgtgtcctcgtatctcgaggagcaggctgcgaaagagtttatcgcatggctcgtcaaaggcaggggacacggggagggcaccttcacgtcggacgtttcatcataccttgaggaacaggccgcgaaagaattcattgcatggctggtaaaaggcaggggtcacggagaagggacttttacttctgacgtcagctcctaccttgaggagcaggcggcgaaagagttcatcgcgtggctcgtaaagggacgggggcacggggaaggcacgtttacctcggacgtgagctcatacttggaggagcaggcagcgaaggagtttattgcctggcttgtgaagggtcggggccacggcgaaggaacgttcacctccgacgtgtcgtcgtatcttgaggagcaagctgctaaggagtttatcgcttggcttgtcaagggtcgtggacacggagaaggtacctttaccagcgatgtgtcgtcctacttggaggaacaggcagccaaggagttcatagcatggctggtcaaaggaagaggacacggcgagggtaccttcacctctgacgtctcatcttacttggaagaacaagccgccaaagagttcattgcttggttggtgaagggtcgcggacatggggagggaactttcacttcagatgtgagctcgtacctcgaagagcaggccgccaaggaattcattgcgtggctcgtgaaaggtaggggacatggcgaggggactttcacctcagacgtttctagttatctggaagagcaagccgcaaaggaattcatcgcatggcttgttaagggacgcgggggtggcggtggtggagggtccggaggcggaggaagtggcggcggcggaagcgcagagtcaaagtacggaccgccgtgcccgccgtgccctgcaccggaagctgccggtggacccagcgtgttcctgttcccaccaaagccgaaggacactctcatgatctcccggaccccggaagtcacttgtgtggtggttgacgtgagccaagaggatcctgaagtgcagttcaactggtacgtggacggagtcgaagtgcacaatgcaaagactaagcctagagaagagcagttcaactcgacctaccgcgtcgtgtccgtgctgactgtgctgcatcaggactggctcaatggaaaggaatacaagtgtaaggtcagtaacaaaggactcccgagctccatcgaaaagacgatctcgaaagccaaaggacaacccagagaaccccaagtgtacacccttcctccaagccaggaagaaatgactaagaaccaagtgtccctcacctgcctggtgaaaggcttctacccatcagatatcgcggtggaatgggaatcgaatggacagccagaaaacaactacaagactactccgccggttctggattccgacgggtcgttcttcctctactcgcgcctgacggtggataagtcccggtggcaggagggaaatgtgttttcatgcagcgtgatgcacgaagccctgcataaccactacacccagaagagcctgtccctgtcgctgggg

SEQ ID NO: 15822 - DNA, 1740 bp, Artificial Sequence
  Description of Artificial Sequence: Synthetic coding sequence
atgaagtgggtgtcatttatttctctgctgtttctgttctcatccgcgtactccggcagcttggataagaggcacggggagggtacttttaccagcgatgtgagtagctatttggaggaacaagctgctaaggaattcatcgcatggttagtgaaaggccgcggacatggggagggcacttttacatcggacgtctcgtcatatcttgaggagcaggccgctaaagagtttattgcatggctcgtaaagggccggggccatggagaaggaacgttcacaagcgacgttagttcctatctcgaggagcaagctgccaaggagtttatcgcctggctagtcaaaggaaggggccacggcgagggcacattcactagcgacgtaagctcatatttagaggagcaggcggccaaggaatttattgcctggcttgttaagggaaggggccacggcgaaggcacgtttacgagcgatgtcagcagctacctagaggaacaagctgcgaaggaattcatagcctggttagtcaagggacggggtcacggcgaaggcacgttcacgagcgacgtatcaagttatctggaggaacaggccgccaaggaatttatcgcctggctagtgaaagggcgtggccacggcgaagggacattcacctcggacgtgtcttcttacctcgaggagcaggctgccaaggagttcattgcctggcttgtgaaaggtagaggccacggggagggtacattcactagcgacgtgtcctcttacctcgaggagcaagccgctaaagagttcatcgcctggctagtgaaggggcggggacacggagagggtacattcacgagcgacgtctctagctacttggaggaacaggccgcaaaagagttcatagcttggctcgtgaagggcaggggtcacggggaggggacctttacctccgacgtgtcttcttaccttgaggaacaggcagcgaaggagttcatagcctggctggtgaaaggacggggcggtggtgggggaggtggcagcggaggtggcgggagtggtggggggggcagtgctgagagcaagtatggccccccttgcccaccttgtcctgcacctgaggctgcgggcggtccgagcgtgtttctattccctcctaagcccaaggacaccttgatgataagtcgcacccccgaggttacatgtgttgtggtagacgtgagccaggaggaccctgaggtgcagttcaactggtatgtcgacggagtggaagtgcataatgccaaaacaaagccgagagaggagcagttcaattcaacataccgcgtggttagtgtgctgactgtcctgcaccaggattggttaaacggaaaggaatacaagtgtaaggtgtcgaataagggcctacccagttctatagagaagactatctcaaaggcaaaagggcaaccacgggaacctcaggtctacactctgccgccatcccaggaggaaatgacgaagaatcaagtgagtctcacatgtctggtaaaaggcttctaccccagcgacattgccgtggagtgggagagtaacggccagcccgaaaacaactacaagactaccccacctgtgctcgactcagatggaagctttttcttgtattctaggctgaccgttgataaatcacggtggcaggagggtaacgtgttttcttgcagcgtgatgcatgaggctctccacaaccactacacacagaaatcactgtccctgtctctcggc

SEQ ID NO: 15823 - DNA, 1740 bp, Artificial Sequence
  Description of Artificial Sequence: Synthetic coding sequence
atgaagtgggtgtcattcatctctttgctgtttctgttcagctccgcatacagcggatcactcgacaaacgccacggcgaaggtacttttacctccgatgtctcgagctatctggaggaacaagccgcgaaagagtttatcgcgtggttggtaaagggtagggggcacggcgagggaaccttcacgtccgacgtgtcctcctaccttgaagagcaggcagccaaggaattcatcgcctggctggtcaaggggcgcggacacggagagggaacttttactagtgacgtgagcagttacttggaagagcaggccgcgaaagagttcatagcatggctcgtcaagggtcggggacacggagagggtacttttacctccgacgtttcctcatacctcgaagaacaagctgcgaaggaattcattgcgtggctcgtgaagggccgtggacacggagagggaaccttcaccagcgacgtttccagttacctcgaggaacaggccgcaaaagaattcattgcatggctggtgaaaggtagagggcacggggagggaacgtttacttcagatgtctcatcttacttggaagagcaagctgctaaggaattcatcgcttggctcgtgaagggaagaggacatggagagggcacgttcacctcggatgtgagctcctaccttgaagaacaggcggccaaggagttcattgcctggctggtgaaaggaagaggccacggggaaggcacctttacttcggatgtgtcgtcgtaccttgaggaacaggctgccaaagagtttatcgcatggcttgtcaagggaaggggacatggagagggcactttcacctccgacgtctcatcctacctggaagaacaagccgcaaaggagttcatcgcatggttggtcaaaggccgcggtcatggggaaggcaccttcacctcggacgtatcttcatacctggaggagcaagccgccaaggaattcatcgcttggcttgttaaggggcgaggaggcggcggagggggcgggagtggcgggggcgggtcgggaggcggtggaagcgctgaatcgaagtacggacctccgtgcccgccatgtccggcacccgaggccgcagggggtccgtccgtgttcctgttcccacccaaaccaaaggacactctgatgatctcgcggactccagaggtgacctgcgtggtggttgacgtgtcccaagaagatcctgaggtccagttcaattggtacgtggatggagtagaagtgcataacgccaaaaccaagccgcgggaagagcagttcaactccacttaccgggtggtgtcagtgctcaccgtgctgcaccaggactggctgaatggtaaggaatacaagtgcaaggtgagcaataaaggacttcctagcagcatcgagaaaacgatctcgaaggcgaaaggacagccgcgcgaacctcaagtgtacaccctgccgccgtcgcaagaagaaatgacgaagaaccaggtgtcgctgacttgtctcgtgaagggtttctacccctccgacatcgcggttgagtgggagtcgaacggtcaacccgaaaacaactacaagactactccaccggtgctggattcagatggatccttcttcctctatagccgcctgaccgtcgacaagagcagatggcaggaaggtaacgtctttagctgctcggtgatgcatgaagccctccacaatcattacacccagaagagcctgtcgctgtcgctggga

SEQ ID NO: 15824 - DNA, 1740 bp, Artificial Sequence
  Description of Artificial Sequence: Synthetic coding sequence
atgaagtgggtgtcatttatctcactgctgttcttgtttagctccgcctactcaggatcgttggacaagcgccatggggagggcactttcacgtcagatgtgtcatcgtacttggaagagcaggctgcaaaggaattcattgcctggcttgttaaagggcgcggtcacggtgaagggacttttacgtccgatgtgtcatcgtaccttgaggagcaggcagcgaaggagtttattgcttggttggtcaagggtagaggccacggggaagggacgttcacctcagacgtgtcgtcatacctcgaagagcaagccgccaaggagtttatcgcctggttggtaaaggggaggggtcacggagagggtacctttacctccgatgtctccagctaccttgaggaacaagcagcaaaagaattcatcgcatggctcgtgaagggacgcgggcatggagaaggtacttttactagtgacgttagttcgtacctcgaagaacaagcggcaaaagaattcattgcatggcttgtgaaaggaaggggacatggagagggcacctttacctcggatgtttcctcgtacctggaggaacaagcagcaaaggagttcatagcatggttggtgaaagggcgtggccatggtgagggtacttttacctccgacgtaagttcctaccttgaagagcaggctgcgaaagagtttatagcgtggctcgtaaagggcagaggtcatggagaaggcaccttcaccagcgatgttagcagctacctcgaggaacaggcagccaaggagttcatcgcttggctcgttaaggggcggggacatggtgaaggaactttcaccagtgacgtctcctcgtatctggaagaacaggcagcaaaggagtttattgcttggctggtgaaaggaagaggtcacggagaaggtactttcacgagtgacgtcagcagctatctggaagaacaggccgcgaaggaattcattgcatggctggtcaagggccggggcggaggtggaggcggcggatccggaggaggaggaagcgggggaggaggaagcgcagagagcaaatacggtcctccctgccccccttgtcccgcgcctgaagcagcagggggaccaagcgtctttctctttccacctaagccgaaggacacccttatgatttccagaactccagaagtgacctgtgtggtggtggatgtcagccaagaagatcctgaagtgcagtttaactggtacgtcgatggagtggaagtgcacaacgccaagactaagccacgggaagagcagtttaactcaacctaccgtgtggtgtctgtgctgaccgtccttcaccaggattggctgaatggtaaggagtacaagtgtaaggtgtctaataaggggctgccatcgtcaatcgaaaaaaccatctcgaaagctaagggccaacctcgagagccccaagtgtacactcttccgccgtcccaagaagagatgactaaaaaccaagtctcactgacctgtctggtcaaaggtttttacccttccgacattgcagtggaatgggagagcaacggacaaccagaaaacaattacaagactacccctcctgtgcttgattcagatggatccttttttctgtactccaggcttactgtggataagtcgagatggcaggaaggcaacgtgttttcgtgctccgtcatgcatgaagccctgcataatcattacacgcaaaagagcctctccctttctctgggc

SEQ ID NO: 15825 - DNA, 1740 bp, Artificial Sequence
  Description of Artificial Sequence: Synthetic coding sequence
atgaaatgggtgtcttttatctctttattgttcttattctcctccgcatactcagggtctctggacaaacgtcacggtgagggaacttttacttctgatgtgtctagttacctcgaggaacaggcagcaaaggagttcatcgcctggctggtcaagggacgaggccacggcgaaggtacttttacctctgacgtgtcctcctacctggaggaacaagctgccaaggagtttatagcctggctggttaaagggagagggcacggcgaaggcacttttacatccgacgtgtcttcttacctggaggagcaggctgccaaagagtttattgcttggctcgtaaaaggccgcggccacggagaaggaacatttactagtgacgtctcttcctacctcgaagagcaggccgccaaggagtttatcgcctggctggtgaaaggcagaggccatggggagggtacattcacttctgacgtgagctcttatctagaagagcaggctgccaaagagtttattgcatggctggtcaaaggccgaggccatggtgaggggacctttaccagcgacgtgtcatcttacctggaggagcaggctgcaaaagaatttattgcatggctggtgaagggcagaggacatggtgaggggacattcacctccgacgtgagcagttacttagaagaacaggccgccaaggaatttattgcttggctggtgaaaggaagaggccatggggaggggacattcacatccgacgtgagtagttatctagaggaacaggcagcaaaggagtttatagcctggctggtcaagggccgcggccacggagaggggacttttaccagcgacgtctcaagctacttagaggaacaggcagctaaagagtttatcgcatggctagttaagggccgtggccatggcgagggaacctttacaagcgatgtcagttcttacctcgaagagcaggctgccaaggagtttatagcctggttagtaaagggccggggtggaggcgggggcggaggttctgggggagggggatctggcggcgggggctccgctgaatctaaatacggtcctccctgtccaccctgccctgctccagaggccgccggcggaccaagcgttttcttattcccacctaagcccaaggatactctgatgataagcagaacccctgaggtgacctgcgtggtggtcgacgtgagtcaggaagatcccgaggtccaattcaattggtacgtcgatggagtggaagtgcacaatgccaagaccaaaccccgggaggaacagttcaatagtacttatcgggtcgtgagtgtgctgacagtgctgcaccaggattggctcaatggaaaggagtataagtgcaaggtttccaacaaggggctgccaagttccatagagaaaactatttctaaagccaagggccaaccaagggaacctcaggtgtataccctccctccatctcaagaagagatgactaagaatcaggtgagcctgacatgtctggtgaagggcttttatcctagcgacattgctgttgagtgggagagcaacggccaacctgaaaacaactacaagacaaccccccccgtcctagacagtgacggttccttttttctctactctcgtctcaccgtggacaagtctcggtggcaagaaggaaatgttttttcttgttcagtcatgcatgaagcactgcacaaccactatacacagaaatcactatccctatctttgggg

SEQ ID NO: 15826 - DNA, 1740 bp, Artificial Sequence
  Description of Artificial Sequence: Synthetic coding sequence
atgaaatgggtgtctttcattagcctcctctttctgttttcgtcggcctactctggctctcttgataaacggcatggcgagggtacttttacgagcgacgtgtcgagttaccttgaggaacaggctgcaaaagaattcattgcatggctggtgaaaggacgtggtcacggtgagggtacctttactagtgacgtgtcatcataccttgaagagcaagccgccaaggaattcatcgcctggcttgttaagggacgtggacatggagaaggcactttcacctcggatgtgtctagctaccttgaagaacaagccgcaaaagagtttatcgcatggcttgtgaagggtcgcggacacggggagggtactttcacgtcagatgtctcatcttacctcgaggaacaagccgctaaggagtttatcgcctggctggtgaagggacgaggccatggcgaaggtacgtttaccagcgacgtgtcctcgtatttggaagaacaggccgcaaaggagttcatcgcttggctggtcaaaggtaggggacacggagagggcaccttcacgtccgatgtctcatcctacctcgaagaacaggcagcaaaggagtttattgcctggctggtaaagggtagaggtcacggggaagggacgttcacctccgatgtatcaagctacctggaagagcaggctgctaaggagttcatagcatggctcgtgaagggaagaggtcatggagaggggacttttacttcagatgtgtcgtcctatctcgaagaacaagcagcaaaggaattcattgcctggttggtaaagggccggggacatggtgagggaaccttcacttccgatgtgtcaagttacttggaagagcaagcagcaaaagagttcatagcgtggcttgtcaagggccgcggtcatggtgaaggcacctttacctccgatgtttcctcgtacctggaggagcaggcggccaaggagttcattgcgtggcttgtgaaaggacggggtgggggcggaggaggtgggtccgggggcggtggctcggggggtgggggatccgcagaaagcaagtatggaccgccttgtccaccttgtcctgcaccagaagcggcaggcggaccaagcgtctttctgtttccccccaagcctaaggataccctgatgatttcgagaaccccggaagtgacttgcgtggtggtggatgtgtcgcaggaggacccagaagtccagtttaactggtacgtggatggtgtcgaggtgcacaatgctaagaccaaacctagagaagaacagtttaactcgacctacagagtggtgtcggtgctcaccgtgcttcatcaagactggctgaacggaaaggagtacaagtgtaaagtgtcgaacaagggtctgccctcgagcattgaaaagaccatctccaaggcaaaaggacaacctcgggaaccccaggtgtacactcttccaccttcccaagaagaaatgacgaagaaccaagttagtcttacttgtctggtcaagggtttttacccgtcagacattgcagttgaatgggaatcaaacggccaacctgagaacaattacaagaccactccacccgtcttggactccgacgggagcttttttctgtactcgaggctgactgtcgataagtcacgatggcaagaaggaaatgtgttttcgtgcagcgtcatgcacgaagcgcttcataatcattacacccagaaatccttgtcgctgagcctgggg

SEQ ID NO: 15827 - DNA, 1422 bp, Artificial Sequence
  Description of Artificial Sequence: Synthetic coding sequence
atggccgtgatggctcctcgaacactggtgctgctgctttctggtgcgctggcgttgacccagacgtgggcacaggtgaccctgcgtgaaagtggccctgcgttagttaaacctacacagacactgactctaacatgcacatttagtggctttagtctgagtacaagcggcatgtcagtggggtggatccggcagccccccggaaaggctctggaatggcttgcagatatctggtgggatgataagaaggactataatccctctctgaaatctcgtctgacaatcagtaaggatacaagcaagaaccaggttgtactcaaggtgaccaacatggaccccgctgacaccgccacgtactactgcgccagaagcatgattacaaattggtatttcgacgtatggggagccggtacaactgtgacagtgtcttcagcctctacaaagggcccttcagtcttcccactcgcaccatcttctaagtcgacctcggggggcactgcggccctggggtgtctggtaaaggactacttcccggagcctgtgaccgtgtcctggaattcaggggcactgacctccggcgttcacactttccccgcagtgctacagtcttcagggctgtacagcctgagctcagtcgtgactgtccccagctcttctctggggacacagacgtatatttgcaatgtgaatcataaaccttctaacactaaagtcgataagcgcgtggaaccaaagagttgcgataagacgcacacatgcccaccatgtccagcgcctgagttgttaggaggccccagcgttttcctgttcccccctaagcctaaggacacacttatgatctcacgcacacctgaagtcacctgcgtcgtggtggatgtgagtcatgaagatcctgaagtgaaattcaattggtacgtggatggggtggaagtgcataacgccaagacaaaacctcgtgaggaacaatacaactccacttatagagtagtttctgtgttgactgtgctccatcaagattggctgaacggaaaggagtacaagtgcaaggtttccaacaaagcgctgccggcacctattgaaaaaaccataagtaaagcaaaagggcagcctagagagcctcaagtttacaccctgcctcccagtagggaggaaatgactaagaatcaggtgtctttaacttgtctggtcaaaggattttatccttcagatattgccgtagagtgggagagcaacggccagccagagaacaattataagacgacaccaccggttctcgattccgacggaagtttcttcctttactcgaagctgactgtggacaagagccgatggcaacagggtaacgtgtttagttgtagtgttatgcacgaggccctgcacaaccactatacacagaaaagtctctctttgagtcctggcaag

SEQ ID NO: 15828 - DNA, 1422 bp, Artificial Sequence
  Description of Artificial Sequence: Synthetic coding sequence
atggcagtcatggcgccgcgcaccctcgtgctgctgctctccggagctctcgccctgacccagacttgggcccaggtcacgctgcgcgagtccggcccagctctggtgaagccaacccagactctcactctgacgtgcactttcagcgggttttccttgtccacttccggaatgtcagtcggatggatccggcagcctcctggaaaagccctggagtggctcgccgatatctggtgggatgacaagaaggactacaacccgagcctcaaatctcggctgacgatcagcaaggacaccagcaagaaccaggtggtgcttaaagtgaccaacatggacccggctgataccgccacgtactactgcgcgcggagcatgatcactaattggtatttcgacgtgtggggagccggcaccaccgtaaccgtctcgagcgcttccaccaaaggcccatcagtgtttccactcgcaccctccagcaaatcaactagcgggggtaccgctgccttgggctgcctggtgaaggattacttcccagaaccggtcactgtctcctggaattcgggggcacttacctccggtgtgcacactttcccggcagtgctccaatcgtccggactttattctctgagctccgtcgtgaccgtcccttcatcgtcgctgggaacgcagacctacatctgcaacgtgaaccacaagccgtcaaataccaaggtcgataagcgggtcgaaccaaagtcgtgcgacaaaacccatacctgcccgccatgcccggccccggaactgttgggtgggccttccgtgtttctgtttccccccaagcctaaggataccttgatgatctcgaggacgcctgaagtgacgtgcgtggtggttgacgtctcccacgaggaccctgaagtgaagttcaattggtatgtggacggtgtggaagtccacaatgcgaaaaccaagccgagagaggaacagtacaactctacttacagagtggtcagcgtgctcactgttctgcaccaggactggctcaatggaaaagaatacaagtgcaaggtgtccaacaaagccttgccggctcccattgaaaagaccatcagcaaggcaaaaggacagcctcgcgagcctcaggtgtacacgctgccgccgtcccgcgaggaaatgaccaaaaatcaagtgagcctcacttgcctcgtcaagggattttacccctccgatatcgcagtggaatgggaatcaaacggacaaccagagaacaattacaagaccaccccgccagtgctggacagcgatggctcgttcttcctttactcgaaactgaccgtggataagtccagatggcagcagggaaatgtgttctcgtgctcagtgatgcatgaagcccttcacaaccactacacgcagaagtcactttccctctcaccgggaaaa

SEQ ID NO: 15829 - DNA, 1422 bp, Artificial Sequence
  Description of Artificial Sequence: Synthetic coding sequence
atggcagtgatggcacctcggacccttgtgcttctgctgtcaggagcgctcgccctgactcaaacttgggcacaggtgaccctgcgcgaatcaggcccagcgctggttaagcctactcagacccttaccctgacttgcaccttctcgggattttcgctttcgacttccggaatgtccgttggatggatcagacagccgccaggaaaggcactggaatggcttgcagatatatggtgggacgacaaaaaagattacaatcccagtcttaaatcgcgtctgactatttccaaggatacctccaagaaccaggtggtgcttaaagtgaccaacatggatcccgcggacaccgccacctactactgcgcaaggagcatgatcaccaactggtactttgatgtgtggggcgcgggaactacggtgaccgtgtcgagcgccagcactaaagggcctagcgtgtttccccttgctcccagctcgaaatcaacctctgggggaaccgctgcgctgggttgcctcgtcaaggactacttccctgagcctgtcaccgtgtcatggaattcaggtgcattgacttctggcgtgcatacttttcctgctgtgctgcaaagctcgggcctttactcactttcgtctgtggtgactgtgccgtctagctcactgggtactcagacctatatctgtaacgtgaaccacaagccatccaacaccaaggtggacaaacgcgtcgaaccaaaaagctgtgataagacccatacctgtccaccgtgtcctgcgcccgaactcttgggtggaccttcggtgtttttgtttccaccgaagcctaaagataccctcatgatctcaagaactcctgaagtgacgtgcgtcgttgtcgatgtgtcgcacgaagatcctgaggtgaaattcaactggtatgtcgatggggtggaggtccacaacgccaagacgaagcctagggaagaacagtacaactccacctacagagtagtgtccgtcctcactgtgttgcatcaagattggcttaacggcaaggaatacaagtgtaaggtgtccaataaggccctgcctgctcctattgaaaagaccatctcaaaagcaaagggacagccacgggaacctcaagtctacaccctgcctccctcacgcgaagagatgactaagaaccaagtctcgcttacctgcctggtgaaagggttttacccttcagatatcgcagtggaatgggaatcgaacggccaaccggaaaacaattacaaaacgactcctccggtactggattccgatggatcttttttcctgtacagcaagctcacggtcgacaagtccaggtggcaacagggaaacgtgtttagctgctcggtcatgcatgaagcacttcataaccattacacccaaaagtccctgtcgctgtcacctggaaag

SEQ ID NO: 15830 - DNA, 1422 bp, Artificial Sequence
  Description of Artificial Sequence: Synthetic coding sequence
atggccgtgatggcacccaggacgcttgtactgctgttatctggagccctggcactgactcagacatgggcccaagttaccctgagagagtccggcccagctctggtgaagccgacccagaccctcactctgacctgtactttctcgggcttttctctgtctacctccgggatgagcgtcggttggattcgtcagcctccagggaaagcactcgagtggctcgccgacatatggtgggacgataagaaggactataatccaagccttaagtctcgtttaaccatctctaaagacacgagcaagaaccaggttgtgttgaaggtgacaaatatggaccccgctgacacggccacgtattactgtgcaaggagcatgattacgaattggtatttcgatgtgtggggagcgggaaccacagtgacggtgtctagtgcctccactaagggtccatccgtgttccccctggccccgtcctctaagagtacttccggtggtaccgctgcactaggatgcctcgtgaaggattattttccagaacctgttactgtgtcgtggaatagtggcgctttgacgtccggcgtccatactttccccgcggttcttcagtcctcaggcctatatagtctgtccagcgttgttacagtccccagcagtagtcttggaactcagacatacatttgtaatgtaaaccacaaaccctcaaacaccaaagtggataaaagagtagagccaaaatcatgcgacaagacacacacatgccccccgtgccccgccccagagcttttgggaggccctagtgtcttcctgttccctccaaagcccaaggataccttgatgatctcccgcacacctgaggtaacctgtgtcgtcgtggacgtgagccacgaggacccagaagtcaaattcaattggtacgtcgatggggtagaggtacataacgctaaaaccaaaccacgggaagagcagtacaactctacatacagggttgtgagtgtgctgactgtactccaccaggattggctgaatgggaaggagtacaagtgcaaggtctctaataaagcactcccggcgcctatcgaaaagactattagcaaagccaaggggcaaccccgtgagccccaagtctacacactcccaccgtcaagagaagagatgaccaagaaccaagtgtcactcacttgtcttgtgaaaggtttttatcctagcgatatagctgtggagtgggagtctaacggccagcccgaaaataactataaaaccactcctcctgtgttggatagcgatggcagcttcttcctgtacagcaaactgaccgtagacaaaagtcggtggcagcagggtaatgtttttagctgttccgtgatgcacgaggcccttcataaccattatacccaaaaatccctttcgctgtcaccagggaag

SEQ ID NO: 15831 - DNA, 1422 bp, Artificial Sequence
  Description of Artificial Sequence: Synthetic coding sequence
atggccgtaatggcccctcggacattagtgctgttgctgtccggcgcgctagcgctgactcagacttgggctcaggtgacgctaagggaaagtggacccgcccttgtgaaacctactcagacactcactctaacgtgcacattttccggtttttccctgagcacttctggcatgagcgtcggctggatacggcagccacctggcaaagcgcttgagtggctggccgacatttggtgggatgataagaaagactacaacccctctctgaaaagccgcctgacaatttccaaggacactagtaagaatcaggtggtcctgaaagtgaccaacatggacccagccgacaccgccacttattattgtgctaggagcatgatcaccaactggtactttgacgtgtggggcgcaggtacgacagttaccgtaagctctgctagcacaaaaggcccaagtgtattcccactggcacccagcagcaagagcacctccggaggtacggcagcccttggctgtcttgtcaaggattacttcccagagccggttaccgtttcatggaattctggcgccctaacctcgggagttcacacctttccagccgtgcttcagtccagcgggctttattccctctcttccgtggtgacggtaccctcctcctcgctgggaacccaaacttacatctgcaacgttaaccataaaccttctaatactaaggtcgataagcgtgtggaacctaagagttgcgacaaaacgcatacctgccctccatgccccgccccggagctgctgggaggtccttcggtgtttctatttccgcctaaacctaaggacaccctgatgattagtcgtacacctgaggtgacatgtgttgttgttgacgtcagccatgaagatcctgaagtcaaatttaactggtacgtggatggcgtggaagtccataatgctaagaccaaaccacgggaagaacagtataactctacatatcgcgtggttagtgtgctgacggtgctgcaccaggactggcttaacgggaaggagtataagtgtaaggtaagtaataaggcccttcccgcaccaattgaaaaaaccatcagtaaagcaaagggacagcccagagagccccaagtttacactctaccacccagccgagaggaaatgaccaaaaaccaggtgagtctcacgtgcctggtgaaagggttttatccttctgacatcgctgtggaatgggaaagcaacggacagccggagaacaactataagaccacaccaccggtgctggatagcgacgggtcattcttcctatattctaagctcacagtggacaaatcacggtggcagcaggggaacgtgttttcatgcagcgtgatgcatgaggcactccataaccactatacccaaaagagcctcagcctctctccagggaag

SEQ ID NO: 15832 - DNA, 1422 bp, Artificial Sequence
  Description of Artificial Sequence: Synthetic coding sequence
atggccgtcatggcacccaggaccctggtccttctgctgtccggtgcactggcattgacccagacttgggcacaggtgactctgcgagagtccgggcccgcattggtgaagcccacgcagacgctgactctgacctgcacgttttcgggattcagcttgtccacttccggaatgagcgtgggttggatacggcaacctcccggaaaggcacttgagtggcttgcagatatttggtgggatgacaagaaggattacaatccttccctgaaaagcagactgacgatatcgaaagacactagtaagaaccaagtggtcctgaaggtcactaatatggatcctgcagatactgcgacttactactgtgcccgcagcatgattacgaactggtactttgatgtatggggcgcggggaccaccgtgactgtgagctcagcgtccaccaagggtccttccgttttcccactggcacctagttctaagtcaacctcaggaggaaccgcagcgctgggatgccttgtgaaggactactttcccgagccagtaaccgtttcgtggaattcaggagcactgaccagcggtgtgcatacttttccagctgtgctgcaatcatcgggcctttacagcttgtcgtcggtggttactgtcccatcctcgtcacttggcacccaaacctacatctgcaacgtgaaccacaaaccgtcgaacactaaggtggataaaagggtggaacctaaatcatgtgacaagacgcatacctgtccgccatgtcccgcccccgaattgctgggaggcccttcggtgttcctcttcccccctaaaccaaaagacaccctgatgattagccggacgcccgaggttacttgtgtcgtggtggatgtgtcccatgaggatcccgaagtcaagtttaactggtacgtcgatggcgtggaggtccacaatgcaaagaccaagcctcgagaagaacagtataactcgacttacagagtagtctctgtgcttactgtgcttcatcaggactggcttaatggcaaggaatacaagtgtaaagtgtccaataaggcccttcctgcacctatcgaaaagactattagcaaggctaagggacagcctagggaacctcaagtgtacacccttcccccttcacgcgaagagatgaccaaaaaccaggtgtccctcacttgccttgtcaaaggattctatccttccgatatagctgtcgaatgggaatcgaacggtcaaccagagaacaattacaagaccactccgccagtacttgattcggacggtagcttttttctgtacagcaaactgactgtggacaagtcgagatggcaacagggaaacgtgttttcatgctccgtcatgcacgaagcactgcataaccattacactcaaaagtcgctctctctctcgcccgggaag

SEQ ID NO: 15833 - DNA, 1422 bp, Artificial Sequence
  Description of Artificial Sequence: Synthetic coding sequence
atggccgtgatggcacccaggaccctggtgctcctcttaagtggggctctcgccctgactcagacgtgggcccaggtcactcttcgggaatctggccctgcccttgtgaaaccaactcaaacgcttaccctcacctgtaccttcagcggtttcagcctcagtacgagtggaatgtctgttggatggatcaggcaaccgcccggcaaggctctggagtggctcgccgatatatggtgggacgataagaaagactacaatccctcattgaaatcgcgcctgacgatctcaaaggatacatccaagaatcaggtggtgctcaaggtgactaatatggacccggccgacacggctacatattactgtgccagatctatgatcaccaactggtacttcgatgtgtggggcgccgggaccaccgtgacggtttcctcagcctccacaaaagggccctctgtcttccccctggcgccctcctccaaatctacctcaggcggtacggctgccttgggatgtctggttaaggattacttcccggagcccgtaacagtgagttggaattccggagcgctgacatctggggttcataccttcccagctgtgttacaatcttctggactgtattctttgtctagcgtcgtgacggttccgtcatccagcctgggaacacaaacgtacatttgcaatgttaatcacaagccgtctaatactaaagtcgacaagcgcgttgagccaaagtcctgtgacaagacacacacatgtccaccatgcccggcccctgagttgttaggcgggcctagcgtcttcctatttcctcccaagcctaaggatacgctcatgatctctcgaacccccgaagtgacctgcgtcgtggtggatgtcagtcatgaggaccccgaggtgaagtttaactggtatgtggacggcgtggaagtacataatgccaagactaagcctagagaagagcagtacaatagcacctaccgcgtagtatcagtccttacagtgctacaccaggactggctgaacggaaaagagtacaaatgtaaggtctctaacaaagcccttcccgcgcccatcgaaaagaccatctccaaagccaaaggtcagccccgagagccccaggtatataccctgcctccaagccgcgaggagatgaccaagaaccaggtatcactgacttgtctcgtgaaggggttttatccgagcgacatcgccgtcgaatgggagagtaatggacagccagagaataattacaaaacgacgcccccagtgctggacagtgacgggtctttcttcctgtattctaaactcaccgtcgacaaatcccgatggcagcagggaaacgtgtttagctgctcagtgatgcacgaagctctgcataaccactacacccagaaatccctgtcgctcagtcctggaaaa

SEQ ID NO: 15834 - DNA, 1422 bp, Artificial Sequence
  Description of Artificial Sequence: Synthetic coding sequence
atggctgtcatggcacctagaaccctcgtgctcttacttagcggagcgcttgcactgactcaaacatgggctcaggttacactgagggagagcggccccgctctggttaagcccactcaaactctcacactgacatgtacctttagcggcttttctttgagcacctcgggcatgagcgtgggctggatcagacaacctccgggtaaagctctggagtggctggccgacatttggtgggacgataagaaggattataatccaagcttgaaaagtaggctaaccatctcaaaggacactagcaaaaaccaggtggtgctgaaagtgacgaatatggatccggccgatacagccacttactactgcgcaaggagcatgatcactaattggtatttcgatgtctggggcgctggcacaaccgtgaccgtcagcagcgccagcacaaaaggcccgtctgtctttcctctggccccgagcagtaagagcaccagcggcggaacagctgctcttggatgtctcgtgaaagattattttccagaacccgtgaccgtgtcttggaacagcggcgccctgaccagcggagtgcatactttccctgcggtactgcagagctcaggcctgtactcactttcatcagtagtgacagtgccatctagctcactgggcacacaaacgtatatttgcaatgtcaaccacaaaccaagcaacactaaggtcgacaaaagagtcgaacctaagagctgcgacaaaacccatacatgtcctccttgtccagctccggagctcctgggcgggccctccgtgtttcttttcccacctaaacctaaagatactctgatgatctccagaaccccggaggtgacttgtgtagtggtcgatgtcagccacgaagatcctgaggtaaagtttaactggtatgtggatggagtggaagtgcacaatgcaaagaccaaacctagagaagagcaatataactctacttacagggtggtttctgtcttgaccgtgttgcatcaggactggctcaacggaaaagaatacaaatgcaaagtctcaaataaggccctgcccgccccaatcgaaaaaacaatctcaaaggcaaagggacaaccaagagaaccacaggtctatactctgccgcccagcagggaagaaatgaccaagaaccaggtaagcctcacctgtctggtaaaaggcttctatcccagcgacatcgctgtcgagtgggagagcaatggtcaacctgagaataactacaaaactacccctcccgtgttggatagcgatggcagcttcttcctgtatagcaagctcaccgtggacaaaagcagatggcagcagggaaacgtctttagttgcagcgtcatgcacgaggctcttcacaaccactacacccagaagagcttgtctctcagcccaggcaaa

SEQ ID NO: 15835 - DNA, 1422 bp, Artificial Sequence
  Description of Artificial Sequence: Synthetic coding sequence
atggctgtaatggccccaagaactctggtgctgctcctgtccggagctttagcacttacccagacttgggcacaggtcacccttcgtgagtctggtcccgccctggtgaagcctacccagaccctgacactcacctgcacattctcaggcttctcactgagcacctccggaatgtcagtgggctggatcaggcaacccccaggtaaagctctggaatggctggccgacatttggtgggatgacaagaaagattacaatccatcgctcaagagtaggctgacgatcagtaaggatacctcaaagaatcaggtcgttctaaaggtcactaatatggatcccgcagacacagcaacctactactgtgctaggtctatgataacaaattggtattttgatgtatggggagccggaacgacagtaacggtgtcaagtgcctctacgaaaggacctagtgtgttcccactggcacccagctccaagagcactagcgggggcacagccgcccttggatgcctggtgaaggactattttccagaaccagttaccgtatcctggaatagcggtgccctaacaagtggcgtgcacacattccccgcggtactgcagagctctggattgtatagtctgtcatccgtcgtcacagtgccaagcagctccctgggcacccagacgtatatctgcaacgtcaaccacaagccaagcaataccaaagttgacaagagagtagagcccaaatcctgtgataaaacacatacttgccccccctgtccagcaccggaactgttgggagggcccagcgtgttcctctttccacccaaaccaaaagataccctgatgatttcccgcactcctgaggtgacctgtgtggtcgtggatgtgagccatgaagatcccgaggtcaagttcaactggtatgtggatggcgtagaggttcataatgccaagacaaagccgcgcgaggagcaatacaacagcacctacagagtggtcagtgtgcttactgtgctgcatcaggactggctcaacggcaaggaatacaaatgtaaagtgtcaaacaaggccttgcccgcacccattgagaaaacaatctctaaagctaaaggccagccgagggaaccgcaggtgtataccctgcctccgagtcgtgaagaaatgacgaaaaatcaagtgagcttaacctgcctcgtcaagggattctatccctccgatattgccgtcgagtgggagagcaatggacagccggaaaacaattacaagacaaccccacccgttcttgacagcgatggaagcttcttcctgtattcaaagctgacagtcgataagagcagatggcagcaggggaacgtgttcagctgttcagtgatgcatgaggccctacataaccactatacccagaaaagtcttagcctgtcgcccggcaag

SEQ ID NO: 15836 - DNA, 1422 bp, Artificial Sequence
  Description of Artificial Sequence: Synthetic coding sequence
atggcagtgatggccccgagaaccctggtcctgctcctctcgggcgcgcttgcactgacccaaacctgggcacaagtgactctccgcgaaagcggaccagcacttgtgaaaccaactcagacccttactcttacttgtactttttcagggttttccctcagcacctcgggaatgtcggtcggatggattcgacaaccacctgggaaggcactcgagtggctggccgatatttggtgggatgataagaaggactacaacccctcactcaagtcacggcttacgatttccaaggatacgtcaaaaaaccaagtcgtgctcaaagtgaccaacatggatccagccgataccgcaacctactactgcgcacggtcaatgatcaccaactggtactttgatgtgtggggagctggaaccactgttaccgtgtcgtccgcctcgaccaagggacctagcgtgtttccccttgccccaagctccaagagcacttcaggtggtactgccgcccttgggtgtctggtgaaagattacttccctgaacccgtgaccgtcagctggaatagcggagcactcacttcgggcgtccacaccttcccagcagtccttcagtcgtcggggttgtactcgctgtcatccgttgtcacggtgccatcgtcgagcctggggacccagacttacatttgtaatgtgaatcacaagccttcgaacactaaggtcgataaacgcgtcgaaccaaaaagctgtgacaagacccacacctgcccaccatgtccggcacctgagctgcttggcggaccttccgtgtttctttttcccccgaagccaaaggatactcttatgatctccaggactcctgaggtgacctgtgtggttgttgacgtgtcccatgaagatcctgaggtcaagtttaactggtacgtggacggggttgaagtccacaacgcaaagacgaaacccagagaggaacagtacaacagcacttaccgcgtggtgtccgtgctcactgtcctccaccaagattggcttaacggtaaggaatacaagtgtaaggtttcaaataaggccctgccagcgcctattgaaaagaccatatccaaagctaagggtcaaccccgggaacctcaggtgtacacccttccaccctcgcgggaggaaatgaccaaaaaccaggtgtccctcacgtgcctcgtcaaggggttttacccttcggatattgccgtggagtgggaatccaacggccaaccagagaataactacaaaaccacccctcctgtccttgattccgacggtagctttttcttgtactcaaagctgactgtggacaagtcccggtggcaacaaggtaacgtgttctcctgtagcgtgatgcatgaagcactgcacaaccactacacccaaaagtcccttagcctgtcaccaggcaaa

SEQ ID NO: 15837 - DNA, 1422 bp, Artificial Sequence
  Description of Artificial Sequence: Synthetic coding sequence
atggcggtgatggcaccgcgtaccctcgtccttctgctgagcggagcattggcacttacccagacctgggcccaagtgaccctgcgggagtcaggaccagcacttgtcaagcctacccaaactctgaccctgacctgtaccttctccggtttttcgttgtccacctcaggcatgtcggtcgggtggattcgccaacccccaggcaaagccctggaatggttggccgatatatggtgggatgataagaaggactataatccgtcacttaagtcgcggctcaccattagcaaagacacgagcaagaatcaggtggttcttaaggtcaccaatatggaccctgccgacactgcgacgtactactgtgcaagaagcatgattactaattggtactttgatgtctggggggccggaacgaccgtgaccgtgtcctccgcgagcaccaagggcccctcagtgttcccactcgcaccttcaagcaagtccacctccgggggaactgcagccctgggttgcctggtcaaagattacttccctgagccagtgacggtgagctggaactccggagcgctcacttcaggggtgcataccttccccgcagtgcttcaatcatccggtctttactcgttgtcgagcgtcgtcaccgtgccaagttcttcgctgggaactcagacttacatttgcaatgtgaaccataagccatcaaacacgaaggttgataagcgcgtggaacctaagagctgtgataagacccatacctgtccgccttgtccagcgccagaactcctgggaggtcctagcgtgtttctgtttcccccaaaaccaaaggataccctgatgatctccaggacccccgaggtgacttgtgtggtcgtcgatgtctcccacgaagatcctgaagtgaagtttaactggtacgttgatggtgtggaagttcataacgccaagaccaagccgagagaagaacaatacaactccacctacagagtcgtgtccgtgctgactgtgctgcaccaagactggctgaacggaaaggaatacaagtgtaaagtgagcaacaaggcattgcctgcacctattgaaaagaccatctcgaaggcaaaaggccagcctcgtgaaccccaggtgtacaccctgcctccatcgagggaagagatgacgaaaaatcaagtgtcactcacttgccttgtgaagggtttttaccccagcgatatagcagtagaatgggaatcaaatggtcaacctgagaataactacaaaactactccccctgtgctggactcggatggatcttttttcctttacagcaaattgaccgttgacaaatccaggtggcagcaaggcaacgtctttagctgctcggtgatgcatgaagccttgcataaccattacactcagaagtcgctgtcgctgtcccctggaaaa

SEQ ID NO: 15838 - DNA, 1422 bp, Artificial Sequence
  Description of Artificial Sequence: Synthetic coding sequence
atggcagtcatggcacctagaactctggtgctgcttctgagcggagctctcgccctgacacagacttgggcgcaggtgacactcagagagagtggtccggccctggttaagcctacgcaaacactgacactgacctgcacattctcgggtttcagcctcagcacgtcagggatgtccgtgggctggattcgccagcccccaggcaaagccctagagtggcttgccgatatctggtgggatgataagaaggactacaacccaagtctcaagtcccgactcactataagcaaggatacaagcaaaaatcaggttgtcctgaaggtgacaaatatggaccctgccgacaccgcaacatactactgcgcccgctcaatgattacaaattggtacttcgacgtctggggtgcaggaacaaccgtgactgtgagctccgcctccactaagggccccagcgtgtttcccctggccccgtctagtaagagcacctctggcggcacggcggccctcggatgccttgtgaaagactacttccccgagcctgttacggttagttggaattctggggcccttaccagtggagttcacacatttcccgccgtgctccaatcctccgggctgtacagtctcagttccgtcgtaactgtcccctctagttccctcggaacacagacctacatatgtaatgtgaaccataagccgagtaacaccaaagtcgacaagagggtggaaccgaagagctgcgacaagacgcatacatgtccaccttgtccggcacccgagctgctgggaggaccttcggtctttctgtttcctccgaagcctaaagacacattaatgatatcacgcacccccgaggtaacttgcgtagttgtggatgtttcgcacgaagaccctgaggtgaaattcaactggtacgtggatggtgtggaagtacacaatgccaaaaccaagccgcgtgaggagcagtataacagcacttatagggtggttagcgttctaacagttttgcaccaagactggctgaatggcaaagagtataaatgcaaagtatccaacaaagccctgcccgcacctatcgagaagacaatctctaaggctaaaggacagccgcgcgaaccgcaggtgtataccctgcctccgtctagagaggagatgaccaaaaaccaggtatcccttacctgcctcgtcaagggcttctatcctagcgacatagcggttgaatgggagagcaatggccaaccggagaacaactataagactacccccccagtcctggattccgacggaagcttttttctatattccaagcttaccgtcgacaaaagccgatggcaacaaggcaacgtcttttcgtgtagtgtcatgcacgaggccctccacaatcattacacccagaaatccttgagcttatccccgggtaag

SEQ ID NO: 15839 - DNA, 1422 bp, Artificial Sequence
  Description of Artificial Sequence: Synthetic coding sequence
atggcagtcatggcacctaggactctcgtcctgctgctcagcggggcattggcacttacccaaacttgggcccaggtgactcttcgcgaatccgggccggccctcgtcaagccaacccaaacccttacccttacttgcactttttcaggtttttccctgtcaacttccggtatgtcggtcggttggattaggcagcctcctggcaaggcacttgaatggcttgcggacatttggtgggatgataagaaagattacaatccatccttgaagagccgcctgactatatccaaggatactagcaagaatcaagtggtgctgaaggtgaccaatatggatccagcagacaccgcaacttactactgtgcaaggtcaatgatcactaattggtacttcgacgtttggggagcagggactactgtgacggtttcgtcggcgtcgactaaagggccatcggtctttccactggccccgtcctccaaatcaacttcgggtggtaccgccgcactggggtgcctggttaaggattactttcctgaaccagtgacggtgtcgtggaacagcggtgcactgacctcaggcgtgcacacgttccctgctgtgctgcagtcctctgggctctattccctgtcgagcgtcgtgactgtcccctcatcgtcgctgggaacccaaacctatatctgtaatgtcaaccataagccatcaaatactaaggtggacaagcgagtcgagccaaagtcatgtgataagacccatacctgcccgccatgcccagcaccagagctcctcggaggtccttcggtgtttctgttcccacccaaacctaaagatacgcttatgatttccagaactcctgaggtgacctgtgtcgtggtggacgttagccacgaggaccccgaagtcaagttcaattggtacgtggatggcgtggaagtgcataacgcaaaaactaagccacgagaagaacagtacaattccacttaccgggtagtgtcagtccttaccgtgcttcatcaagattggctgaacggtaaagagtacaagtgtaaagtctcgaacaaagctcttccagcacctatcgaaaagactatctcgaaggccaaggggcaaccgcgggaacctcaggtgtacactcttcctccgagtcgggaggagatgaccaaaaatcaagtcagtctcacgtgtcttgtgaagggattttacccttcagacatcgcagtcgaatgggaatcaaacggccaacctgagaacaactacaaaacgacgccccctgtgctggattctgatggttcgtttttcctttactcgaaactgactgtggataaatcacggtggcagcaaggtaacgtcttttcctgttccgtgatgcatgaagccctccataatcactacacccaaaagagcctgtcgctttcgccagggaaa

SEQ ID NO: 15840 - DNA, 1422 bp, Artificial Sequence
  Description of Artificial Sequence: Synthetic coding sequence
atggccgtcatggctccaaggacgctcgtcttactgctctccggggcattggctctgactcagacttgggcccaggttacccttagagagagtggcccagcactcgtaaaacccacacagactcttacattgacctgtaccttttcaggattttcactcagtacatcagggatgtctgtcggttggatacggcagcctcccggtaaagcactcgaatggctcgcagacatttggtgggatgataaaaaggactacaacccttctctcaagtccaggctgaccatcagcaaagacactagcaaaaaccaggtggtcctcaaggttaccaacatggaccctgcagatacggcaacctactactgtgcccggagcatgattaccaattggtacttcgacgtttggggggccggtacgacagtgacagtgtctagtgcctccacaaagggcccctcagtttttcccctggcacctagcagtaagagcacttccggtgggaccgctgccctcggatgtctcgtgaaggactacttccctgagccagttaccgttagctggaacagtggagccctgacctcaggagtgcatacctttccggcagtgctacagtctagcgggctctattcactgtcttcggtagttactgtcccaagcagttctctgggaactcagacctatatttgtaacgttaatcataaacctagtaacaccaaagtcgataagagggttgagcctaaatcatgcgacaagactcacacatgtccaccgtgtccagctcccgagcttctaggcgggccgagcgttttcctgttcccccccaagccaaaagacacccttatgatctcaagaacacccgaagtgacctgtgtggtggtagacgtgagccatgaggacccagaggtgaaattcaactggtacgttgacggggttgaagtacataatgcgaagaccaagcctcgagaggagcagtataatagtacctatcgcgttgtctctgtgttgacagtgttgcaccaggactggcttaacgggaaagaatacaagtgcaaggtgagcaacaaagcgctgcctgcgcccatagagaagacaatcagcaaggcgaaagggcagccccgagagccccaagtctatactctgcctccatctcgcgaggaaatgacaaagaatcaagtgagtctgacttgtcttgtaaaaggattctaccccagcgatattgcagtcgaatgggagagcaacggtcaaccagagaataattacaagaccactccgccggtactggattcagatggcagcttctttctatactctaagctcaccgtggataagtccaggtggcagcaaggtaacgtgttttcatgtagcgtgatgcatgaggcattgcacaatcattacacccaaaaaagcctcagtctttctcctggcaaa

SEQ ID NO: 15841 - DNA, 1422 bp, Artificial Sequence
  Description of Artificial Sequence: Synthetic coding sequence
atggccgtaatggcccctcggacccttgtgctcctgctctctggggccctggcgctgacgcagacttgggcccaggttactctgcgcgagagcggtccagcgttggtgaagcccacccagacattgaccctgacctgcacttttagcggtttttccctctctacatccgggatgtctgtcggctggatccggcaacccccagggaaagctctcgaatggttggcggacatctggtgggatgataaaaaggattacaacccctcactaaaatctcgcctgacaatctcaaaggatacctccaagaatcaggtagtattgaaagtgaccaacatggaccccgctgatacagctacatattactgcgctagatctatgattactaattggtactttgatgtgtggggtgcaggaaccactgtgacagtaagctcagccagcacaaagggaccctctgtatttcccctcgccccgtctagcaaatccaccagcggcggcaccgcagccttaggatgtctggtgaaggactactttccagagcctgttactgtctcctggaattccggagccctgacttcgggagtgcacaccttccctgcagtcctgcagtcaagcggcctgtattcactttccagtgtggtgaccgtgccttcttcatcccttggcacacagacgtacatttgtaacgtgaaccataagccctccaacacaaaagtagataaaagagttgagcccaagagctgcgacaagacccacacatgcccgccatgtcccgcacccgagttgctgggtgggcctagtgtgtttctctttccaccaaagccaaaggacaccctcatgatcagccgcacacccgaggtaacctgcgtggtggttgacgtgtcccatgaggatccagaggtgaaatttaattggtatgtcgacggggttgaggtgcacaatgccaagactaaacctcgagaggaacaatacaacagtacatatcgggtagtgagtgtactgacagtattgcatcaagactggctcaacgggaaggaatacaagtgtaaggtcagcaataaggctttacccgctcctatagagaagaccatctctaaagcgaaaggacagccaagagaaccccaggtatacaccctgcccccatccagggaagagatgactaaaaaccaagtgagtttaacttgcctcgttaaaggcttttaccccagtgatatcgcagtagagtgggaatcaaacgggcagccagaaaacaactacaagactaccccccccgtgctggacagcgacgggagcttttttctttactctaagctgacagtggacaagtcacggtggcagcaaggtaacgtattctcatgtagcgtgatgcatgaggcccttcataaccactacacacaaaagagcctcagcctgtcacctggaaag

SEQ ID NO: 15842 - DNA, 1422 bp, Artificial Sequence
  Description of Artificial Sequence: Synthetic coding sequence
atggccgtcatggcaccgagaaccctggtcctgctgctttctggagcactggccttgacccagacctgggcacaggtgactcttcgcgagtctggaccagccctggtgaagccgactcaaactctgaccttgacttgtactttctcaggattttcgctctcaacctcgggcatgtcagttggttggatccgccagccacctggaaaagcgttggaatggcttgcggacatttggtgggacgacaagaaggattacaacccatcactcaagtccagacttactatctctaaggacacttcgaaaaaccaggtggtgctgaaggtgactaacatggatccggccgacactgctacttactactgcgcacgctcgatgatcaccaactggtacttcgacgtctggggagctggtaccaccgtgactgtgtcctcagcctcaaccaagggaccgagcgtctttccgctggcgcctagctccaagtcgacttcaggcggcaccgccgcactgggttgtctcgtcaaggattacttcccggaacctgtgactgtgagctggaacagcggcgcgctcacgtccggcgtgcataccttcccggccgtccttcagtcaagcggtctgtactcactctcctccgtggtgacggtgccctcttcttccctgggcactcagacctacatctgcaatgtgaatcacaagccatcaaacaccaaggtggataagcgcgtggagcccaagtcgtgcgacaaaacccacacgtgtccgccgtgcccagcccctgaactgctgggcggcccgagcgtgttcctcttccctcccaaaccgaaggacactctgatgatcagccggactccagaggttacttgcgtggttgtcgatgtcagccacgaagatccagaagtcaagtttaactggtacgttgatggcgtcgaagtccataatgccaagaccaaaccgcgggaggaacagtacaatagcacctaccgcgtcgtgtccgtcctgactgtgctgcaccaggactggttgaatgggaaggagtacaagtgcaaggtgagcaacaaggcactgccagcaccgattgaaaaaacgatcagtaaggccaaaggccagccccgagagcctcaggtgtataccctgccgccgtccagggaggagatgaccaagaaccaagtgtcactgacctgcctggtgaagggcttctacccatcagacatcgctgtggagtgggagtcgaacggacagcctgaaaacaactacaagaccaccccgccggtgctcgactcagatggctcattcttcttgtactcaaagctcaccgtcgacaaatcgcgctggcaacagggcaatgttttcagctgcagcgtgatgcatgaagcgctccacaatcactacacccagaagtcgctgtccctctcgccaggaaag

SEQ ID NO: 15843 - DNA, 1422 bp, Artificial Sequence
  Description of Artificial Sequence: Synthetic coding sequence
atggctgtcatggctcctcggacgttggttcttcttctgtctggtgcgcttgcactgacgcagacttgggctcaagtgaccttgagagagagcggacctgccctggtgaaaccgacacagacactgacattaacttgcaccttttcgggcttttcactaagcactagtggtatgtcagtcgggtggatcagacaaccccccggaaaggcactggaatggctcgctgatatttggtgggatgacaaaaaggattataaccccagcctcaaatccagactcacgatctcaaaggacaccagtaagaaccaagtggtgttgaaagtcaccaatatggatcccgccgataccgctacatattattgcgcccgttccatgattaccaactggtacttcgatgtgtggggggccgggacaaccgtcacggtaagttccgcgagcacaaaaggcccatcagtcttcccacttgccccctcatctaaatccacaagcggcgggaccgcggctttgggctgcctcgtgaaagactatttccccgagccagtgaccgtgtcatggaactctggggcactgacatctggggtgcacacctttcccgccgttctgcagtcgagcggattatatagtctgtcatccgtcgtaacagtccccagtagttcccttgggacacagacatacatttgcaacgttaatcataagccctctaatacaaaagtagacaaaagggtagaaccaaaatcgtgtgacaaaactcatacgtgtccgccctgccctgcccctgaacttctcggtggaccctctgtgtttctgttcccgcccaagccaaaagatactttgatgatttcccggaccccagaggtaacttgtgtcgtggtcgatgtgtctcatgaagatcctgaagttaaatttaactggtatgtcgacggggtggaggtgcacaatgctaagaccaagcccagagaggaacagtataattccacttacagggtagtcagtgttctgacagtgctccatcaagattggctgaacggaaaggaatataagtgcaaagtcagtaacaaggctttgcctgcccctatcgagaagacaatctccaaagccaaaggccagcctagggaacctcaagtgtatacactccctccgagcagagaggaaatgaccaaaaatcaggtgtctctgacatgcctggtcaagggattctatccaagcgacattgccgttgagtgggagtctaatggccaaccagagaacaattacaagaccacaccccccgtccttgattcagacggcagttttttcctgtacagcaaattgacggttgataagtcaaggtggcagcaggggaatgtgttctcatgtagcgtgatgcacgaagctttgcacaatcactacactcagaagtctctgagtctctcccccgggaaa

SEQ ID NO: 15844 - DNA, 1422 bp, Artificial Sequence
  Description of Artificial Sequence: Synthetic coding sequence
atggcagtgatggcgccaaggaccctggtgctgttgctgagtggcgccctggccctgacccaaacgtgggctcaggtgaccctgcgcgagtccggacccgctctggtcaaaccgactcagacgctcaccctgacctgtaccttttcgggcttctcgctgtcgacctccgggatgagcgtgggatggatccgccagccaccgggcaaggccctcgagtggctcgctgacatctggtgggatgacaagaaggattataacccctcgcttaagtccagactgactattagcaaggatacttccaagaatcaagtggtgctcaaagtgaccaatatggacccggccgacaccgcaacctactactgcgcccgatcgatgatcactaactggtacttcgatgtctggggagccggaactaccgtcactgtctcttcagcgtccactaagggaccctcggtgttcccgcttgccccgtcgagcaagtcgacctcgggcggaaccgccgcgctcggatgcctggtgaaagattatttcccggagcccgttactgtgagctggaattccggagcgctgacttcgggcgtgcatacgttccctgccgtgctccagagctccggcctctactcactgtcatcggtggtgactgttccgtcctcgtcactcggaacgcaaacctacatctgcaacgtgaaccacaaaccgtcaaacactaaagtggacaagcgggtggaacctaaaagctgcgacaagactcatacctgtccaccttgcccagccccggaactgctgggtggtccttccgtgttcttgttccctcccaagccgaaggacaccctcatgatcagcaggactccggaagtgacctgcgttgtggtcgacgtctcccacgaggatccagaagtgaagtttaattggtacgtggatggggtcgaggtccacaacgctaagaccaaaccgcgcgaggaacaatacaacagcacttaccgggtcgtctcagtcctgacggtcctgcatcaggactggctgaatggcaaggagtacaagtgcaaggtgagcaacaaggcgcttccagcacctatcgaaaagacgatttccaaggcgaagggacagccgcgcgaaccacaagtctacactttgccgccttctcgggaagaaatgactaagaatcaggtgtcccttacctgcttggtgaaagggttctacccgtcggacatcgcagtggaatgggagtccaacggacagccagaaaacaactacaaaactaccccgccagtgctggatagcgacggttcattctttctctacagcaaactcaccgtagacaagagcagatggcagcagggaaatgtcttttcgtgttccgtgatgcatgaggcactgcacaaccactacactcaaaaatcactttcactgtcaccagggaag

SEQ ID NO: 15845 - DNA, 1422 bp, Artificial Sequence
  Description of Artificial Sequence: Synthetic coding sequence
atggcggttatggcccctagaaccttggttctattgctctccggcgctcttgccctgactcaaacatgggctcaagttaccctccgcgagtccggccccgctcttgtgaagcccactcagacacttacactgacctgcacttttagtgggttcagcctgagcacgtccggaatgtcagtggggtggataagacagccaccaggaaaagctttggagtggctggccgatatttggtgggatgacaagaaggattacaatccaagtctgaagtcaaggctcactattagtaaggataccagcaagaaccaagtagttcttaaggtgaccaacatggatcccgccgacacagctacctactattgcgctcgaagcatgattaccaactggtacttcgacgtgtggggagccgggaccactgtaacggtcagcagcgcatctacaaaaggccccagcgtgtttccactcgcaccttccagtaagtctacatctggcggcaccgcagcgttgggctgcttagttaaggattacttccctgaaccggtcaccgttagttggaacagtggagcattgacctcgggagtacatacatttcctgcagtcttgcaatctagcggcctgtatagtttaagttcagttgtgaccgtgcccagtagctcgcttggtacacagacttacatctgcaacgtgaaccataagcccagcaatactaaggtggacaagagggtggagccgaaaagttgcgataagacacatacttgtccaccatgtcccgcaccagagctgttggggggtcccagcgtgtttctcttccccccaaagccaaaagatactctgatgatttccaggacgcctgaggttacatgcgtagtcgtagatgtgtcccacgaggaccctgaagtcaaattcaactggtatgtcgatggagtggaagtgcacaatgccaagaccaagcctcgggaagaacaatataactctacatatcgcgtggtctcagttctcaccgtgttgcaccaggactggctgaatgggaaggaatataaatgtaaggtgtccaacaaggcactccccgctccaatcgaaaagactattagtaaagccaagggtcagccccgcgagccacaggtttacaccctcccaccctctcgtgaggaaatgaccaaaaatcaggtgagtctcacttgtctggtcaaaggcttttaccccagtgacattgccgtcgaatgggagtctaatggtcagccggagaacaattataaaactacacctccggtcctggattctgacggctcctttttcctgtattcgaagctgaccgtggataagtccaggtggcagcaaggaaacgtgtttagttgtagcgtcatgcatgaggcgctgcataatcactacactcagaaatccctgtccctttcccccggcaaa

SEQ ID NO: 15846 - DNA, 1422 bp, Artificial Sequence
  Description of Artificial Sequence: Synthetic coding sequence
atggctgtgatggcgccgcgtacacttgtactgctgctgtctggcgctttggctctcacccagacatgggctcaggttaccctccgggaatccggtcccgcactagtgaaacctacccaaacgttgaccctaacgtgtactttttcaggtttctcactctccacatctggcatgagtgtggggtggatacgacagccaccgggcaaggctcttgagtggttggcagatatctggtgggacgacaaaaaagattacaacccaagcctcaagtcccgcctcacgatttccaaggatacctcgaagaaccaggttgttctcaaggtcacgaacatggacccagctgatactgctacatactactgcgccaggtcaatgattacaaactggtacttcgacgtctggggtgcaggcacgactgtcacggtcagctctgcgagcacgaagggaccttcagtgttcccgttggctccatctagtaaaagtactagtggtgggaccgctgcacttggctgcctagtgaaggattacttccccgaacccgttaccgtcagttggaactccggcgctctgacaagcggcgtacatacatttcctgcggttctgcagagttctggtctttactccctcagctccgtggtgactgtgccgtctagttccctcggaacccagacgtatatttgtaatgtcaaccataagcccagtaatactaaggtcgacaagcgggtcgaacctaagagctgtgacaagacccatacatgtcctccatgcccagctcccgagctgttgggcggaccctcggttttcttgttcccaccaaaaccgaaggataccttgatgatctctcgcacacctgaggtcacttgcgtcgtcgtggacgtgtcccatgaagatcccgaggttaagttcaactggtatgttgatggtgttgaggtgcataatgctaagacaaagccccgtgaagagcagtataactccacataccgagttgtgtccgtcttaaccgtactacaccaagattggctcaacggaaaggagtacaagtgcaaagtgagcaacaaagctctgcctgcgcctatcgagaaaactatttccaaggctaagggtcagccccgggaaccccaagtctatacattgcccccatctcgagaggagatgacaaagaaccaggtctctctcacatgtcttgttaaaggattctaccctagcgacatagctgtggagtgggagtccaacggccagcctgagaataattataagacgactccccctgttttggatagtgacgggtccttcttcctatatagcaagctcactgttgacaaatctcgctggcaacagggtaatgttttctcttgttccgtaatgcatgaagcgttgcacaatcactacactcagaagagcctgtctttgagccctggaaag

SEQ ID NO: 15847 - DNA, 1422 bp, Artificial Sequence
  Description of Artificial Sequence: Synthetic coding sequence
atggcagtgatggctcctagaactctggtgctgctcctgagcggagccctcgcactcactcaaacctgggcacaggtgacgctgagggaatcgggacctgccctcgtgaagcctactcaaactctcaccctcacctgcaccttttccgggttttcccttagcacgtccggcatgtccgtggggtggataagacaaccccctggcaaagccctcgaatggttggctgacatatggtgggacgacaagaaagattacaacccatcgctcaaatcgcgactcactatttcaaaggatacttcgaagaaccaagtggtgctgaaggtcaccaacatggatcccgccgatactgcaacctattactgcgcgcggagcatgattaccaactggtacttcgatgtttggggcgccggtaccacggtcactgtctcctcagcatccactaaaggaccttccgtttttccacttgcacctagctcgaagtcgaccagcggaggcaccgcagctcttggatgtcttgtgaaggattactttcctgagccagtcactgtgtcatggaacagcggcgcgctgacttcgggagtgcataccttccctgctgttcttcaatcgtccgggctgtactccctttcctcagtggtcactgtgccatcttcctcccttggtacccaaacgtacatctgtaatgtcaaccataaaccttcgaatactaaagtcgataagagagtcgaacctaaatcttgtgacaaaacgcacacttgcccaccttgtccagcaccggaacttctgggtggcccctcggtgtttcttttcccacctaagccgaaagacactcttatgatttcccgtactcctgaagtgacttgcgtggtggtggatgtgtcacacgaggatcccgaagtgaagttcaactggtatgtcgacggggtggaggtccacaatgctaagactaagcctcgcgaagaacagtacaactccacttatagagtggtgtctgtgcttaccgtgctccatcaggattggctgaacggaaaagagtacaagtgtaaagtgtccaacaaggcattgccggcgcctatcgagaaaactatcagcaaggcaaagggacagccaagggaaccccaggtctacactcttcccccctctcgcgaggagatgactaagaaccaagtctcgttgacctgtcttgtcaaaggtttctacccaagcgacattgcagttgaatgggagtcaaatggacaaccagagaataactacaagaccaccccgccagtgctggattccgacggatccttttttctctactccaagctcactgtggataagtcacggtggcaacagggaaacgtgttctcctgttcggttatgcacgaagctctgcataaccactacactcagaagtcactgagcctgtccccggggaag

SEQ ID NO: 15848 - DNA, 1422 bp, Artificial Sequence
  Description of Artificial Sequence: Synthetic coding sequence
atggcggtgatggccccgcggaccttggtgctcctgctgtccggcgctctggcgctgactcaaacctgggcccaagtcacgctccgggaatcgggtccggcacttgtgaaacctactcaaaccctgactctcacgtgcaccttctcagggttctcactttccacctcaggaatgagcgtgggttggatccgccagccgccagggaaggccttggagtggctcgcagatatttggtgggatgataagaaagactacaatccgtccctgaaatcgcgcctgaccatcagcaaggatacgagcaaaaatcaggtggtcctgaaggtgactaacatggacccggcggacacggcgacttactactgcgcacggtcaatgatcaccaactggtactttgacgtgtggggagctggaaccactgtgaccgtgagctcggcctccactaagggcccttcggtgtttccacttgccccatcgtccaagagtacttcgggtgggacggccgcgctgggatgtcttgtgaaagactacttccctgaacctgtgacggtttcatggaattccggagctctcactagtggagtccataccttcccggcagtgctccagtcgtcagggttgtactccctgtcctcggtcgttaccgtgccatcctcatcgcttggaacgcaaacctatatctgcaatgtgaaccataaaccttccaacaccaaagtcgacaaaagagtggagccaaagtcctgcgataagacccacacttgcccgccttgtcccgctcccgaactgttgggcggcccctcagtattcctgttccccccgaagcccaaggacactcttatgatctcccgaactccggaggtgacctgcgtcgtcgtggatgtctcacacgaagatcctgaggtaaagttcaactggtacgtggatggtgttgaggtccacaacgccaagacgaagccgcgcgaagaacagtacaacagcacgtaccgggtcgtgtccgtgctcactgttttgcatcaagactggctgaacggcaaggagtacaagtgcaaagtgtcgaacaaagcactcccagcgcccatcgaaaagactatttcaaaggccaaaggacagccccgcgagccgcaagtgtacaccctcccaccgagccgtgaagaaatgaccaagaatcaggttagtctgacctgtcttgtaaagggattttacccttccgacatcgcagtggagtgggaatctaacggacagcctgaaaacaactacaagaccaccccacccgtcctggactcggacggcagctttttcctctatagcaagctgaccgtcgacaaatccaggtggcagcagggaaatgttttctcttgcagcgtcatgcacgaggccctccacaatcactacactcagaagtcattgtccctgtctccgggaaag

SEQ ID NO: 15849 - DNA, 1422 bp, Artificial Sequence
  Description of Artificial Sequence: Synthetic coding sequence
atggcggtgatggcaccccgaacccttgtcctgctgctgtctggtgcccttgcccttacccagacctgggcacaagtcactttgagagaatccggccctgcccttgtcaagcctacgcaaaccttgaccctcacctgcactttttcgggattttctttgtccacctcgggaatgagcgtgggttggattaggcaaccacccggtaaggcgctggaatggctggctgacatatggtgggatgacaagaaggactataacccgtcgcttaaatcgcgccttaccatttcaaaagatacctccaaaaaccaagtcgtgttgaaggtgactaacatggatcctgctgacaccgcaacctactactgtgctagatcgatgatcactaactggtacttcgatgtgtggggggccggtaccaccgtcacggtgtcctccgccagcaccaagggaccctcagtctttccattggcgccgtcctcaaagtcgacgagcggtggaactgcagcacttggctgcctcgtgaaagattactttccagagcccgtgaccgtgtcctggaactcaggggcacttacttcgggagtccatacctttcctgccgtgctccaatcatcgggactgtacagccttagctctgtggtgactgtcccatctagctccctgggcacgcagacttacatttgtaacgtgaaccataaaccttcgaacactaaggtggacaaacgggtggaaccaaaaagctgtgataagactcatacttgccctccttgtcccgcacctgagctcttggggggaccatccgtgtttttgtttccacctaagccgaaagacactctgatgatatcgagaacccctgaggtgacgtgtgtggtggtggatgtgagccacgaagatccggaggtcaagtttaactggtatgtcgatggcgtggaagtgcataatgccaaaactaagcctagagaagaacaatacaactcgacgtacagggtggtgtcagtgctcacggtgctgcaccaggactggcttaacggcaaggaatacaaatgcaaggtgtcgaataaggcactgcctgcccccattgaaaagaccatcagcaaggcaaagggacaacccagagaaccacaggtctacactttgccgccctcgcgggaagagatgaccaagaaccaggtttccctgacttgtctggtgaaggggttctacccgtcggatattgccgtggaatgggaatccaatggacagccagagaataactacaagaccactccacctgttcttgattccgatggttccttcttcctctacagcaagctgaccgtcgacaagtccaggtggcagcaaggtaacgtgttcagctgtagcgtgatgcatgaagccctccacaatcattacacccagaaatcccttagccttagccctggtaag

SEQ ID NO: 15850 - DNA, 1422 bp, Artificial Sequence
  Description of Artificial Sequence: Synthetic coding sequence
atggcagtgatggcacctagaactcttgtgttgctcctgtccggagcacttgccctcacccagacctgggcccaagtcacgctccgagaatcgggaccagcactcgtgaaacctactcagaccctgaccttgacctgtacgtttagcggatttagcctgagcaccagcggaatgtcggtcgggtggattagacaacctccaggcaaggctctggagtggctggcagatatttggtgggatgacaagaaggattacaatccttctcttaaatccagattgactataagcaaagatacttctaagaaccaagtggtcctgaaagtgaccaatatggatccagcggataccgcaacttactactgcgctaggagcatgattactaactggtactttgatgtttggggagcaggcactactgtgaccgtgtccagcgcatcgaccaaggggccttcggtctttcctctggcaccttcgagcaaatccactagcggtggaaccgcagcgcttggttgtctcgtgaaagattacttcccagagcctgtgacggtttcctggaattccggtgcacttacttcgggagtgcatacctttcctgccgtccttcaatcgtcaggactctactccctgtcctcggtggtgactgtgccatcgtcctccctgggaactcaaacttacatctgcaatgtcaaccacaagcctagtaacactaaggtcgacaagcgggtcgaacctaagtcgtgcgataaaactcatacctgtcccccgtgtcctgcacccgaacttctgggcggcccttccgtgtttctctttccaccgaagcctaaggatacgcttatgatatcgagaaccccagaagtcacttgcgttgtggttgacgtctcccacgaggaccctgaggttaagttcaattggtacgtggatggggtggaagtgcataacgcgaaaaccaagccacgtgaggaacaatacaacagcacttaccgagtggtgtcagtgttgactgtgctccatcaagactggcttaacgggaaggaatacaagtgtaaggtatcaaacaaggcacttcctgctcctatcgaaaagactattagcaaggcaaagggtcagccacgggaaccgcaggtgtacacccttccaccatcacgtgaagaaatgaccaagaatcaggtgtccctgacctgtctcgtgaagggcttctacccgtcagatatcgccgtggaatgggagagcaacggccagccagagaataactacaaaaccactcccccagtgcttgactcggatgggtcattctttctgtactcaaagctgactgtggacaagtccagatggcaacaaggaaatgtgttctcctgttcggtgatgcacgaggcgctgcataaccactacacccagaagagcttgtccctgtcgccaggaaaa

SEQ ID NO: 15851 - DNA, 1422 bp, Artificial Sequence
  Description of Artificial Sequence: Synthetic coding sequence
atggctgtgatggcgcctagaaccctagtgctactgctgtccggcgccctggccttgacacaaacttgggcgcaggtgaccctgcgcgagtccggacctgcccttgtcaagcccacacagacactgacgctgacctgtaccttttctggctttagtctttctacctccgggatgtctgtcggctggattcgccagccaccaggcaaagctcttgagtggctcgccgatatctggtgggacgacaagaaagattataacccttccctgaaatcacggttgacgatatccaaggacacttcaaaaaatcaggtcgttttgaaggtgaccaacatggatcctgccgacacggccacgtattattgtgcgaggagtatgattaccaactggtacttcgacgtttggggggccggaacaactgtgaccgtctcatccgcgagcactaagggaccctctgtgttcccattagccccctcaagtaagtccacatcaggaggtacagcggctttgggctgcctggtgaaggattacttccctgaacctgttaccgtgtcatggaattccggcgcattaacaagcggcgtacatactttccctgctgtgcttcaaagtagcgggttgtactccctgtcaagtgtcgtgacagtgccctccagctcgttgggaactcagacctatatttgcaatgtgaaccacaagccctccaataccaaggttgataagcgcgtggaaccaaagtcttgtgacaaaacccacacctgcccgccctgtccagctcctgagttgttgggcgggccttccgtcttcctgttccctccaaaacccaaggatactctgatgatcagtcgcacccccgaagttacgtgcgtcgttgtggatgtgtcacatgaggatccagaggttaaattcaattggtacgtggacggcgtggaagtgcataacgccaagactaagcctcgggaggaacagtataattccacataccgcgtcgtatccgtcttaaccgtactgcaccaggattggcttaacggcaaggagtacaaatgcaaggttagtaacaaggccctgcccgccccaatcgagaaaacaatatccaaagccaaaggccaaccgagagaaccacaggtctacaccttgcctccatcgcgtgaagagatgactaaaaatcaagtcagcctgacttgcctggtcaaggggttctatccaagtgacattgcagtcgagtgggagtcaaatgggcagcccgagaataactataagacaaccccccccgtacttgatagcgatggctctttctttctctactcaaagctgaccgtggacaagagccggtggcagcagggcaacgtgttcagctgctcagtaatgcacgaggctctccacaatcattacacccagaagagcctaagcctgtcacctgggaag

SEQ ID NO: 15852 - DNA, 1422 bp, Artificial Sequence
  Description of Artificial Sequence: Synthetic coding sequence
atggcagtgatggctccgcggaccctggtcctcctgttgtcaggagccctggcgctgactcagacctgggcgcaagtgaccctgcgggaaagcggaccggcgctggtcaagccaactcaaaccctgactctcacttgcactttcagcggattttcactgtcgacctcgggtatgtcggtgggatggatccggcagccgcccgggaaggccctggagtggctggcggacatctggtgggatgacaagaaggattacaatccgtccctcaaatcgcgccttacgatcagcaaggacacgtccaagaatcaagtggtgctgaaggttaccaacatggatccggccgataccgcgacctactactgtgcccgctcaatgatcactaattggtactttgacgtctggggcgcgggtactaccgtcactgtgagctccgcctcaactaagggcccgtcagttttcccgttggcaccgagctcaaaatccacctccggcggaaccgcggctttgggttgtcttgtgaaggactacttccctgaaccggtcaccgtgagctggaattcaggagctttgacctccggcgtgcatacgttccctgcggtgctgcagtccagcggactgtacagcctttcatcggtcgtcaccgtcccgtcatcctccctgggaacgcagacctacatttgcaacgtgaaccacaagccttccaatactaaagttgacaagcgcgtcgagccaaagtcctgcgacaagactcatacctgcccgccttgccctgctccggaactgctcgggggaccatcggtgttccttttcccaccaaagccaaaggacaccctgatgatctcacgcaccccagaagttacgtgcgtcgtggtggatgtctcgcatgaggatccggaagtcaaattcaattggtacgtggacggcgttgaagtgcacaacgcgaaaaccaagccccgcgaagagcaatacaattcgacttaccgagtcgtgagcgtgctcaccgtcctgcaccaagattggctcaacggaaaagaatacaaatgcaaggtttcgaacaaggccctgccggcgcctatcgaaaagaccatctccaaggcgaagggccaacctcgggaaccgcaagtctacaccctcccgccctcccgcgaggaaatgaccaagaatcaggtgtcgctgacctgcttggtgaagggattctacccgtcggacatcgccgtagaatgggagtcgaacggccagccggaaaacaactacaagactacgccccctgtccttgactcagacggatccttcttcctgtactcaaagctcactgtggataaatctcggtggcaacaaggaaacgtgttctcctgttccgtgatgcatgaagctctgcataatcactacacccagaaatcgctcagcctgtcgccgggaaaa

SEQ ID NO: 15853 - DNA, 1422 bp, Artificial Sequence
  Description of Artificial Sequence: Synthetic coding sequence
atggctgttatggctcctaggactctcgttcttctcctctcaggggcattggccttaactcaaacgtgggcacaggtgactcttcgagagtcaggtccagcacttgtgaaacctacacagactctcacccttacttgcaccttttccggtttctcactgtcaacttcaggcatgtcggttgggtggatacgacagccgccaggcaaggctcttgagtggctcgcagatatctggtgggacgataagaaggattacaatccttcactaaaatcaagactaactatttccaaggatacatcaaaaaaccaagtggttctcaaggtcaccaacatggatccggcagatactgcaacctactactgcgccagatccatgatcacaaattggtatttcgacgtttggggtgccggtactacagtaactgtttcttctgcaagcactaagggcccttcagttttcccgctcgctccttcaagtaagagcacttctggtggaactgctgctcttggttgtcttgttaaggactactttcctgaaccagtgactgtgtcttggaactctggtgcattaacctctggtgtccacacttttccagctgttttgcaatctagcggactctattcacttagtagcgtagtgaccgttccatcgtcctcacttggtactcaaacctacatttgcaacgttaaccacaaaccatccaatacgaaggttgataaacgggtggagccgaagagttgcgataaaactcatacctgtcctccgtgcccggcacctgagctcttgggcgggccaagcgtgttcttgtttccaccaaaacccaaagataccctcatgatatccaggaccccggaagtgacttgtgttgtggttgatgtaagtcacgaagatccggaagttaaatttaattggtatgtggatggtgttgaggttcataatgcaaagacgaaacctagagaggagcagtataattctacctaccgggttgtttcggtattgacagtcctgcatcaagactggctcaatggaaaagagtataaatgtaaggtgtccaacaaggcactgcccgctcctatcgaaaagactattagcaaagcaaaaggccagccgcgcgaaccacaagtttacactttgcctccttcgagggaagagatgacaaaaaaccaagtttcattgacttgtctggtgaaagggttctatccttcagatattgcagtcgaatgggaatctaacggacagcctgagaacaattacaaaactactcctcccgttctagactctgatggttcgttcttcttgtatagcaagcttactgtagataagtcgagatggcagcaaggaaatgttttcagctgctctgtgatgcacgaggcgttgcacaatcattatacgcagaagtcactttcgctttcccctggaaag

SEQ ID NO: 15854 - DNA, 1422 bp, Artificial Sequence
  Description of Artificial Sequence: Synthetic coding sequence
atggcagtaatggcacctagaacactcgtgttgttgctttctggagcactggctttgacgcagacctgggcccaggtaaccctccgtgaaagcgggccggcactggtgaagcccacacagaccttaacactgacctgcacgttcagtgggttttctttatctacctctggcatgtctgtggggtggatcaggcaaccccctggcaaggccttggagtggctcgctgacatctggtgggatgacaaaaaagactacaatccatctctgaagagccgcctgaccatctcgaaagatacctcaaagaatcaggtggtcctcaaggttaccaacatggaccccgcagacactgccacatactactgcgctaggtccatgatcacaaactggtactttgacgtctggggtgcagggaccacggtgactgtcagctctgcatcgactaaaggcccctcggtgttcccccttgccccctctagcaaatcaaccagcgggggcaccgctgcacttggctgcttggttaaggattattttccagaaccagttacggtctcatggaattctggggccctcacgtcgggagtgcatacattccccgcggtcttgcaaagtagcggcctctatagcctcagtagtgtcgtgacggtccctagcagttcgctcgggacccagacgtacatctgcaatgtaaatcataagcctagcaataccaaggttgataaacgtgtggagccaaagagttgtgataagacccacacttgcccaccttgtcccgctcccgagctgctggggggccctagtgtttttctgtttccgcccaaacccaaggacaccctgatgatctcccgcacccccgaggtcacatgtgtggtagtcgatgtttcacatgaagatccagaggtcaagtttaattggtatgtggatggcgtggaagttcacaacgctaagaccaaaccaagagaagagcagtataattctacctacagagtcgtgagcgttcttactgttttgcatcaggattggctgaacggaaaggagtataagtgcaaagtttcgaacaaagcactcccagccccaatagagaaaacaatatcaaaagccaagggccagcccagggagccgcaggtatatactctgccccccagcagggaagagatgacaaagaatcaggtgagcctgacatgcctcgtgaagggattctacccctccgacattgctgtggagtgggagtccaacggtcagccagagaataattacaagactacacccccagtgctcgattccgacggaagctttttcctgtatagcaagctgaccgtggataagtctcgttggcaacagggtaacgtcttctcttgctctgtcatgcacgaggcgctacacaatcattatacgcaaaaatcgctctctctaagcccgggaaag

SEQ ID NO: 15855 - DNA, 1422 bp, Artificial Sequence
  Description of Artificial Sequence: Synthetic coding sequence
atggctgtgatggctccaagaactctcgtgctcctattatctggagcactcgctctcacacaaacatgggcccaagtcactctgcgggaaagtggaccagcccttgtgaaaccaactcagacactcacactaacttgcacttttagtggattcagtctgagtacaagtggaatgtccgttggatggattaggcagccacctggaaaagctttagaatggctagcagacatctggtgggatgataagaaagattacaaccctagtcttaaatcacggctgactatcagtaaggatacttccaaaaaccaggtcgtgctcaaagtcacaaacatggatcccgctgatacagccacttattactgcgccagatcaatgataacaaattggtattttgatgtgtggggggcagggacgactgtaactgtgtcttctgcttctacaaaagggccttctgtatttcctttagcacctagttctaaatctacttctggggggacagccgcgctaggatgcctcgtgaaagattatttccctgaaccagtgactgtctcatggaacagtggagctctgacatcaggagtgcatacatttcctgccgttctccagtccagtggactctattctctgtcttctgtggtgactgtgccctctagttcattagggactcagacttatatttgcaacgtaaatcacaaacccagtaatacaaaagtggacaaacgggtggaaccaaaaagttgcgataaaacacatacatgtcccccatgccctgcccctgaactacttgggggacctagtgttttcctctttccccccaaacctaaagatacactaatgatttcccgaactcctgaagttacatgcgttgtagtggatgttagtcacgaggatcctgaagtcaagttcaactggtacgtagacggagtagaggtacataacgccaaaacaaaaccacgagaggagcagtacaattcaacatacagggtcgtgtcagtcttaacagtgcttcatcaggattggttaaacgggaaagaatacaaatgcaaagtgtctaataaggccctccctgcccctatagagaagacaatatctaaagccaaggggcagcccagggaacctcaggtgtacactctgccacccagtcgcgaagaaatgacaaaaaaccaggtgagtctaacttgcctggttaaaggattctatccttctgatatcgcggtagagtgggaatccaatgggcagccggaaaacaactacaagactacacctcctgtgctggattccgatgggtcgttctttttgtattccaaactcacagtggataagtcacggtggcagcagggaaacgtgttctcctgttccgtgatgcatgaagctctccataaccactatacacagaaaagtctttccctatcacctgggaaa

SEQ ID NO: 15856 - DNA, 1422 bp, Artificial Sequence
  Description of Artificial Sequence: Synthetic coding sequence
atggccgtgatggcccctcgcacgctggtgttgctcctctcaggagctctggctctcacccaaacctgggcgcaagtgactttgagagaatccggacctgcgctcgtcaagccgactcagactctcactcttacctgcaccttctccggcttctcgctgtccacttccggcatgtcagtgggctggattcggcaaccaccgggaaaggccctcgaatggctggcagatatttggtgggacgacaaaaaggattacaacccgagccttaagagccgcctgactatctccaaggacacctcaaagaaccaagtcgttctcaaggtgaccaacatggatccggctgatacggcgacctactactgcgcccgcagcatgatcactaactggtactttgacgtctggggagccggcactaccgtgaccgtctcatccgcctccacgaagggaccgtccgtctttcctctggcgccatccagcaaatcgacctccggaggcaccgccgcgcttggatgtctcgttaaagactacttcccagaaccggtcaccgtgtcgtggaattcaggagccctgacttcgggggtgcatacgttcccagctgtgctgcagtcaagcggactgtacagcctgtcgtccgtggtgaccgtcccttcgtcctcactgggcactcaaacctacatctgcaacgtcaaccacaagccgtcgaataccaaggtggacaaaagagtggagccaaaatcatgcgacaagacccacacctgcccgccttgccctgcaccggaactcctgggtggtccttccgtgtttctcttcccccctaagccgaaggatactttgatgatttcgcggaccccggaggtgacctgtgtggtggtggatgtcagccatgaggaccccgaagtgaaattcaactggtacgtcgatggagtggaggtgcataatgcaaagaccaaacctcgggaagaacagtacaatagcacctacagagtagtctccgtgctgactgtcctccaccaggattggctcaacggaaaggaatacaaatgcaaggtgtcgaataaagccctccccgccccaatcgaaaagaccatctcaaaagcgaagggccagccccgcgaaccgcaggtttacactctgccgccatcacgggaggaaatgaccaaaaaccaggtatccctgacctgcctggtcaaaggattctaccccagcgatatcgcagtggagtgggagtcgaacggacagcctgagaataactacaaaaccacgcccccagtgctcgacagcgatggctcattctttctgtacagcaagttgaccgtggacaagagccggtggcagcagggcaacgtgttttcctgttcggtgatgcacgaggcactgcacaatcattacacgcagaaatcactttcgctgtcccccgggaaa

SEQ ID NO: 15857 - DNA, 1422 bp, Artificial Sequence
  Description of Artificial Sequence: Synthetic coding sequence
atggcagtcatggcgccacgcaccctcgtgctgctcctgtcgggagcgctggccctgacccagacgtgggcccaggtcaccctgcgcgaatctggaccggcactcgtcaagcccactcagaccctcactctgacctgcacgttcagcggtttctcactgtccacttccggtatgtcggtgggatggatcagacaacctccgggcaaggccctcgagtggcttgccgatatctggtgggacgataagaaggattacaatccatcgctcaagtcaagacttactatttcgaaggacacttcgaaaaaccaagtggtgttgaaggtgactaatatggacccagccgatactgcgacctattactgcgcccggtccatgatcaccaactggtactttgacgtctggggagcgggtaccactgtgactgtttcttcggccagtactaagggccctagcgtgttccctctggcgccgagcagcaagagtaccagcggaggaaccgccgcgctgggatgtttggtgaaagattacttcccagaacctgttaccgtgtcgtggaacagtggggccctgacttccggagtgcatacctttccagctgtgttgcaatcgtcaggcctgtactcactgtcctccgtagtgaccgtgccctcctcgagtcttggcacccagacttacatttgcaatgtcaaccacaaaccaagcaacaccaaagtggacaagagagtcgaacccaagtcgtgcgacaagacgcatacctgtccgccgtgccccgcaccagaactcctcggaggacccagcgtctttttgttcccgcctaaacctaaagacacgctcatgatctcccggactccagaagtcacctgtgtcgtggtcgacgtgtcacacgaggacccggaagtgaagttcaactggtacgtggacggggtcgaagtgcataacgcgaaaacgaaaccgcgcgaggaacagtacaacagtacctaccgtgtggtgtcggtcttgactgttctgcaccaagattggctcaatggaaaggagtacaagtgcaaggtgtcaaataaggccctcccggctcccatcgagaaaaccatctccaaagctaagggccaaccccgcgagccgcaggtctacactctgcctccttccagggaggaaatgaccaagaaccaggtgagcctgacttgcctggtgaagggcttctacccatcagacatcgcagtcgagtgggaatcaaatggtcagccggagaacaactacaagacgactccgccggttctcgactccgatggatcgtttttcctctatagcaagctgactgtggataaatcccggtggcagcaggggaatgtgttcagctgctcagtcatgcatgaagcgttgcacaaccactacactcaaaagagcctttcactttcgccggggaag

SEQ ID NO: 15858 - DNA, 1422 bp, Artificial Sequence
  Description of Artificial Sequence: Synthetic coding sequence
atggcagttatggcaccacgtaccctggtcctgcttctgagcggagctctcgctctgacccagacttgggctcaggtgactttgcgggagtcaggacctgcacttgtgaagccgacgcagacccttactcttacctgtacctttagcggcttttcactgtcgacctcaggaatgtccgtgggatggattagacaacctccagggaaagcactcgagtggttggccgatatctggtgggatgacaaaaaggattacaacccttcactgaagtccagacttaccatcagcaaagatacttccaaaaaccaagtggtgcttaaggtgaccaacatggatcctgccgacaccgccacctactactgcgccagaagcatgattaccaactggtacttcgatgtgtggggtgcaggaactacggtcaccgtgtcgtccgcctcgaccaagggcccttccgtgtttccactggcaccaagcagcaagtcgacttccggcggaacggcagcactgggttgtctggtgaaggactactttcccgaaccggtgaccgtgtcgtggaattcgggtgcgctgacctcgggtgtgcataccttccccgcagtgctgcagtcgtccggcttgtacagcctctcgtcggtggtgactgtcccctcctccagcctggggactcagacttacatctgtaatgtgaaccataaaccatccaacaccaaagttgataagcgggtggaaccaaagtcatgcgataaaacccatacctgtcctccctgccctgcccccgagcttctgggcggaccatcagtgttcctctttcctcccaagcctaaggacaccctgatgatttcgagaaccccagaagtgacctgcgttgtggtcgatgtctctcatgaggaccctgaagtcaagttcaattggtacgtggacggagtcgaggtgcacaacgccaagactaaaccgagagaagaacaatacaattccacctacagagtcgtgtcggtgcttacggtgctgcatcaagattggcttaacggaaaggaatacaagtgtaaggtgtccaacaaggctctccccgcccctattgaaaagactattagcaaggccaaaggccagccgagagaacctcaggtctacactctgcctccatcccgtgaggagatgaccaaaaaccaggtcagcctgacttgtcttgtgaaaggattctatccatcggatattgcagtcgagtgggaatccaatggccagcccgagaacaactacaagaccactcctccagtgcttgattccgatgggtcgttctttctgtactcgaaacttactgtcgataagtccagatggcagcaagggaatgtgttctcctgttccgtcatgcatgaagcactccacaatcattacactcaaaaaagccttagcctttcgcccggcaag

SEQ ID NO: 15859 - DNA, 1422 bp, Artificial Sequence
  Description of Artificial Sequence: Synthetic coding sequence
atggccgtcatggcaccgcgcaccctggtgttgctgctgtccggagccctggccctcactcagacctgggcgcaagtcaccctgagggaatcaggaccggcgttggtcaaaccaactcaaacgctgacccttacctgtactttctccgggttttcattgtctactagcggaatgtcagtgggatggatccggcagccacctggcaaggctctcgagtggttggctgacatctggtgggacgataagaaggactataatccatcactgaagtcccgcctgaccatttccaaggacacttcgaaaaaccaggttgtgcttaaggtgaccaacatggaccctgcggacaccgccacttactactgcgcccggagcatgattactaattggtacttcgatgtctggggagctgggactaccgtcaccgtgtcctcggcctcgaccaagggaccgtcggtgttcccactggcccccagctcgaagtcgacctctggcggaaccgcagccctgggatgtctggtgaaggactactttcctgagcccgtgactgtgtcctggaattcaggtgcgctgacttctggagtgcacacgtttccagctgtgcttcagagcagcggactgtactcactgtcgtcagtggtgaccgtgccgagctcctccctcggaacgcaaacgtacatctgtaacgtgaaccataagcctagcaatactaaagtcgacaaacgcgtggagccgaagtcgtgcgataaaacccatacttgcccgccttgtccggcacctgagctgttgggaggaccatcggtgttcctgttcccacctaagccgaaggataccctgatgatctctcggacccccgaggtgacttgtgtcgtggtcgatgtgagccacgaggaccccgaagtgaagttcaattggtacgtggatggagtggaggtgcacaacgccaaaacgaagccaagagaagagcagtacaactcgacgtatcgcgtggtatccgtgctgaccgtgctccatcaagactggctgaatggaaaggagtacaaatgcaaagtgtcaaataaggccttgccggcaccgatcgagaaaacgatctccaaagccaaaggacaaccgcgggaaccgcaagtctacactctgccgccgtcccgcgaggaaatgaccaagaaccaagtttcactgacctgtctcgtcaaggggttctaccctagcgacatcgccgtcgagtgggaatccaatggacagcccgagaacaactacaaaactacgccgccagtgcttgactccgacggatcatttttcctctactctaagctcacggtggacaagtcacggtggcagcagggcaacgtgttctcgtgctccgtcatgcatgaggccctccataaccattatacccagaagagtctttcgctcagcccaggcaaa

SEQ ID NO: 15860 - DNA, 1422 bp, Artificial Sequence
  Description of Artificial Sequence: Synthetic coding sequence
atggcagtaatggcaccacggaccttggtgctcttgctttcaggagctctggccctgacccagacttgggctcaagtgaccctgagggaatctggccctgcgcttgttaaaccaacccaaactctgaccctgacctgcacattctcaggatttagtctctccactagtggcatgtctgttgggtggatcagacagcctccgggaaaggctcttgagtggttggctgacatatggtgggatgacaagaaggattacaatccatccctgaaaagccgtttgaccatatctaaagatacctctaaaaaccaggtcgtgcttaaggtgacaaacatggaccctgcagatacagctacctactattgcgcaaggagtatgatcaccaactggtatttcgatgtctggggagctgggaccactgtaaccgtgagcagcgctagcaccaaaggtccaagcgtcttccccctggctccctctagtaagtctacaagtggcggtaccgcagcactcgggtgcttagtgaaggactattttcctgagcccgtaactgtcagctggaacagcggcgccctgacatccggcgtgcataccttccccgccgttctgcaatcatctgggctttactcgctaagcagtgtggtgaccgtacctagctcttcactcggcacccaaacctacatctgtaacgtgaatcataagccgtctaacactaaagtggacaagcgtgtggagccgaaatcgtgcgataagactcatacctgccctccatgtccagccccagaattgctcggaggccccagtgtgtttctttttccgcctaaacccaaggatactcttatgatatctaggacacccgaagtcacctgcgtagtggtggatgtcagccacgaggacccagaggttaaattcaactggtacgtggatggcgtcgaagtgcacaacgctaagaccaagcctagagaggagcaatataacagcacctacagagttgttagtgtccttaccgtgcttcaccaggattggctcaacggaaaagaatacaagtgtaaagtgagcaataaagctctcccggccccaattgaaaagactatctctaaggccaagggtcagcccagagaaccccaggtctacacactcccaccaagtcgcgaggagatgaccaagaaccaggtaagcctgacctgccttgtgaagggcttttaccccagcgatatcgcagttgaatgggagtctaatggacagccagagaataactacaagacgactccacctgtgcttgattcagacggatcctttttcctgtacagtaagctcaccgtggataaaagccgctggcaacaaggaaatgtgttctcgtgctcggtgatgcatgaggctcttcacaaccactacacacaaaaaagtctctccctctctcccggaaaa

SEQ ID NO: 15861 - DNA, 1422 bp, Artificial Sequence
  Description of Artificial Sequence: Synthetic coding sequence
atggcagtaatggcgcctcgcacattagtcttactattgagcggtgctctggcactgacacaaacgtgggcccaagtaacgctgagagagagtgggcctgctttggttaagccgacacaaacactgacacttacgtgtacattttcagggtttagtctttctacaagcggcatgtcagtcggatggatacgccagcccccaggaaaagcactggaatggcttgccgatatatggtgggatgacaagaaagattacaacccgtcattgaagtctcgtttaacgatttcgaaggatacttctaagaatcaggtggtgttgaaagtgacgaatatggatccagctgatacggcaacatattactgtgcgaggtccatgattacaaattggtatttcgacgtctggggcgcaggcactacagtaacagtatcctctgccagtacaaagggaccgtcagtgtttccgctggcgccgtcctccaaatccacaagcggaggcacggctgcattgggctgtctagtcaaagattatttcccggaaccagtgacagtaagctggaactcgggtgcactgactagcggagtccatacatttccagccgtgttgcagagctctgggctgtatagtctttcgtcggtcgtcacggtaccgagttcctcgttagggactcagacttatatctgcaatgtcaatcacaagccgtcaaatactaaagtcgataagcgcgtagaaccaaaatcgtgcgacaaaacacatacgtgccctccgtgcccggcaccagagttgttaggtggaccgtcagtcttcctgttcccgcctaaacctaaagacactttgatgatcagccggacgccggaggttacatgcgtggtggtagatgtgtcacacgaggaccctgaagtcaaattcaattggtatgtggatggcgttgaagtgcataacgccaaaacaaaaccgagagaagaacagtataatagcacttatagggtggtgagtgtacttaccgtccttcaccaagattggttaaacggaaaggaatacaagtgcaaagttagtaacaaagcgttaccggcacctatagaaaagaccatttctaaagctaaagggcagccgcgcgaacctcaggtgtacacactcccgccatcgcgagaggaaatgaccaagaatcaggtttctttgacttgcttggtaaaaggcttttacccaagtgacattgcggtagaatgggaatctaatgggcagccagaaaataactacaagactacccctccggtacttgattctgacggttccttctttctttatagtaaacttaccgttgataaatcacgttggcagcaaggcaacgtgttttcttgctctgtgatgcacgaggccctgcataaccactacacacagaagtctctttctctatcaccgggaaaa

SEQ ID NO: 15862 - DNA, 1422 bp, Artificial Sequence
  Description of Artificial Sequence: Synthetic coding sequence
atggccgtcatggcgcccaggaccctagtactattgcttagcggcgctctggcactgacgcagacgtgggctcaagttaccctccgggagtccgggccagctctagttaagcccacccagacgctaaccctcacatgtactttctccggttttagcctctccacatctggtatgagtgtggggtggatccggcaacctcccggcaaggcccttgagtggttagccgatatatggtgggacgacaaaaaggactacaaccctagcctgaaatccagactcactattagtaaggataccagcaaaaaccaggtggtgctcaaagtcactaacatggaccctgccgacactgccacatattactgtgccagaagcatgattaccaattggtacttcgatgtgtggggtgcaggcaccactgttacagtcagctccgccagtactaaggggcctagcgtctttcctttagctcccagcagtaagtctaccagtggcgggaccgccgccttaggctgtcttgtgaaggactactttccggagcccgtaactgtcagctggaacagtggcgccctgacaagtggggtgcacacatttccagcagtcctgcagtcaagcgggctgtatagtctgtcttcagtggtcaccgtaccttcatccagcctaggtacacagacctatatctgtaacgtgaatcataagccatcgaacacgaaggtggacaaaagggttgaaccaaaaagttgcgacaagactcatacctgccccccttgtcctgcccccgaactgctagggggaccaagcgtgttcctcttccctccaaagcccaaggacacgctcatgatttcacggaccccagaggtgacttgtgtagtggtggatgtgtctcacgaagacccagaggtcaagttcaactggtatgtggacggagtggaagtgcataatgccaaaacaaagccgagggaggaacaatataattccacataccgcgtcgtgagcgtgcttacagtgttgcaccaggattggctcaacggtaaagagtacaaatgcaaggtttctaataaggcccttcctgcccctatagagaagacgatatctaaagcgaagggtcagccacgagaacctcaggtgtataccttgccacccagccgggaagaaatgacgaaaaaccaggtctcattgacatgcctcgtcaagggcttctatcccagcgacatagctgtggagtgggagtcgaatgggcagccagaaaacaactacaaaactactcctccagtgctggattctgacggatctttcttcttgtactctaagttgactgttgacaaaagtcggtggcagcaagggaacgtgttttcgtgctcagtgatgcatgaggcactccataaccactacacccagaaaagtctgtccttatcacccgggaaa

SEQ ID NO: 15863 - DNA, 1422 bp, Artificial Sequence
  Description of Artificial Sequence: Synthetic coding sequence
atggcggtcatggctcctaggaccctggttctcctgctctccggcgccttggcgctcacccagacgtgggcccaggttaccctacgtgagtctgggcctgctcttgtgaaacccacgcagacccttactttgacgtgtaccttctctggcttctctctctcgacttccggaatgtctgtcggatggatccggcagcctccgggtaaggccctcgaatggttggccgacatctggtgggatgacaagaaggattataacccctccctgaaatcgcgtctgactatatctaaggacactagcaagaaccaagtcgtcttgaaggtcactaatatggaccccgctgataccgctacgtactactgcgcccgttcaatgattacgaactggtactttgacgtgtggggcgctggcaccacggtgacggtctcatccgcctctaccaagggcccttccgtgtttcctctcgctcccagctccaagtctactagtggggggaccgccgcattgggctgcctggttaaggattactttcccgagcctgtgacagtcagctggaactctggggcgcttacctctggggttcataccttcccggcggtgctccaatcgtccgggctgtacagcctttcttctgtcgttaccgtcccctcctcctccctgggtacgcagacctacatttgcaacgttaaccacaaaccgagcaacactaaggtggacaagcgcgtcgaaccaaaatcttgcgacaagactcatacttgcccgccctgccctgcgcctgagctgttgggtggcccatccgtgttcctgttccctcccaaacccaaagatactcttatgatcagccgcaccccggaggtaacgtgcgtggtggttgacgtctcccacgaggaccccgaggtgaagttcaactggtacgttgatggcgtcgaggtccacaacgccaagactaagccccgagaagaacagtacaattcaacttatcgtgtcgtgagcgtcttgactgtgctgcaccaggactggctaaacggtaaggagtataagtgcaaggtcagtaacaaggcgctccccgctcctatcgagaagacaatttcgaaggcgaaaggtcagccccgcgaaccacaggtctataccctccccccgtcccgcgaggagatgaccaagaaccaggtgtccctgacgtgcctcgtcaagggcttctacccctcggacatcgcagtcgaatgggagtccaacggacagcccgagaacaactacaagaccacgcccccagtgctggactcggacggctctttctttctgtacagcaaactcaccgtggataagtcccgctggcagcagggcaacgtgttcagctgcagcgttatgcatgaggcccttcacaatcactacactcagaagtccctgagcttatcgcccggtaag

SEQ ID NO: 15864 - DNA, 1422 bp, Artificial Sequence
  Description of Artificial Sequence: Synthetic coding sequence
atggccgtgatggctcctaggaccctcgtgctgctcctctccggggccttggccctgacccaaacttgggctcaggtgactctcagagaatcaggacccgcacttgtgaaaccaacccaaacccttaccctgacttgcacgttctcaggattctccctttccacttcaggtatgtcagtgggatggattaggcaaccgccgggcaaagcgctcgaatggctcgcagacatctggtgggatgacaaaaaagactacaatccgtcgctgaagtccagactgaccatctccaaagacacgtccaagaaccaggtagtcctcaaggtgaccaacatggaccctgccgacaccgcaacttattactgcgcccgctcgatgatcaccaattggtacttcgacgtgtggggcgcgggaaccaccgtgaccgtgtcgtcggcttcgaccaagggaccaagcgttttcccgctcgctccgagctccaagtcaactagcgggggaaccgcagccctgggctgtttggtgaaggactacttcccggagccagtcaccgtgtcctggaatagcggcgcgctgacgagcggggtgcatacttttcccgctgttctgcagtcgtcaggcctgtactcgctcagctccgtggtgactgtcccctcctcatcgctcgggacgcaaacgtacatctgcaatgtcaaccataaaccatcgaataccaaggtcgacaagcgcgtggaaccgaagtcgtgcgacaagacccatacttgtccaccttgcccagcaccggagctgcttggaggaccatcggtgtttcttttcccgcctaagccgaaggatactctcatgatctcgcggactccagaagtgacctgcgtggtggtagacgtgtcgcatgaggaccccgaggtgaagtttaactggtacgtggacggtgtggaggtccataacgcaaagactaagcctagggaggaacagtacaatagcacttatcgggtggtgtctgtgctgactgtgctgcaccaggactggcttaacggtaaggagtacaaatgcaaagtgtccaacaaagcactgccggcgccgatcgaaaagactatctccaaggctaaagggcagccgcgggagcctcaagtctacaccctcccgcccagccgggaggagatgaccaagaaccaagtgtccctcacctgccttgtcaaaggattctacccgtctgacatcgccgtggagtgggagtctaatggacagcctgaaaacaattacaagactacgccgccggtgctggatagcgacgggagcttcttcctgtactcaaagttgactgtcgacaagtcacgctggcaacaaggaaacgtgttctcctgttcggttatgcacgaggcgctgcacaatcactacacgcagaaatcgctgagcctgtcacccgggaag

SEQ ID NO: 15865 - DNA, 1422 bp, Artificial Sequence
  Description of Artificial Sequence: Synthetic coding sequence
atggcagtcatggccccaagaacactggtcttgctcctatctggagcactggccctaacacagacttgggcacaggtgactctacgagagagtgggccagctctggtgaagccaacccaaacccttacccttacttgtacattctccggcttcagtctcagcaccagtggtatgtccgtgggttggatacgccaaccaccgggtaaagccttggagtggctagccgacatctggtgggacgacaaaaaagactacaaccccagcctgaagtctaggctcacaattagcaaggacaccagcaaaaatcaggtggttctcaaggtgacaaacatggacccagcagatacagctacctattattgtgcgagatcaatgattacaaactggtacttcgatgtgtggggcgctggaaccactgtgacagtgtccagtgccagcacaaaaggcccaagcgtgtttcccctggcgccctctagtaaatccactagcgggggcaccgcggcactggggtgcctggtgaaggactactttccagaacccgttactgtgtcctggaactcaggagctctaacatccggggtgcatacctttcccgcggtcctacagtcatcggggttatactccctgtcatctgtggttactgttccatccagctctctggggacgcagacttatatatgcaatgtgaaccataaacctagcaacacgaaggtggataagagggtcgagccaaagtcgtgtgacaaaactcacacctgtcctccctgccccgctccagagctactgggagggccaagcgtgtttctttttccacctaaacccaaagataccttaatgatctctcggacccctgaagtcacctgcgtcgtcgtggatgtgtcccatgaagaccctgaagtgaaattcaactggtacgtggacggggtggaggtccacaatgctaaaaccaaacccagagaagaacagtataactcaacatatcgagtagtgtccgtcctgactgtcctccatcaggattggctcaatggtaaggaatacaagtgcaaagtctctaacaaagcactgccagcccccattgagaaaacaattagtaaggccaagggccagcctcgcgagccccaagtgtatacgctaccgccaagccgcgaagaaatgacaaagaaccaggtgagcttgacttgtctcgtgaagggattctatccctcagatattgccgtggagtgggaatccaacgggcagccggaaaataactataaaacgacgcctcccgtgctagacagtgatggcagcttctttctctattccaagctcaccgtggataagtcccggtggcaacagggtaacgtgttcagttgttcagtgatgcacgaagccctgcacaatcactacacacagaagtccttgtccctttcccccgggaag

SEQ ID NO: 15866 - DNA, 1422 bp, Artificial Sequence
  Description of Artificial Sequence: Synthetic coding sequence
atggcggtgatggcaccgcgcacccttgtgctccttctgagcggtgcactggcactgacccagacctgggcacaggtgactcttagagagtcgggccctgcgctggtcaagccgacccagaccctgacccttacttgtacgttttcgggatttagcctgtccacttccggaatgtccgtggggtggattcgccaaccccctggtaaggcgttggagtggctggccgatatttggtgggatgataagaaggactacaatcctagccttaagtcgagactgacgattagtaaggacactagtaagaatcaggttgtcttgaaggttaccaatatggatccagccgacaccgcaacttactactgtgcaagatctatgattaccaactggtacttcgacgtctggggagcagggacgactgttaccgtgagcagcgctagtactaaaggaccaagcgtgtttcccttggcaccatcttcaaagtcaactagcggtggaacggcagcactgggctgtctggtgaaggattacttccccgagcctgtgactgtgagctggaactccggagcacttacgtctggtgtgcacactttccctgcggttcttcaatcgagcggcctttatagcctgtcgtcagtggtgaccgtgccaagcagctccctcggaactcagacctacatctgcaacgtgaaccacaagccgtcaaataccaaggtggataagcgagtggagccaaagagctgtgacaagacccatacttgccccccatgtccggcacctgagctgctgggtggaccttcggtgttcctctttccaccgaagcctaaggacacgcttatgattagccgaactccagaagtgacttgcgtggtagtggatgtctcgcatgaagatcccgaagtgaaattcaactggtacgtcgacggagtggaggtccacaacgccaaaaccaaacctcgagaagagcagtataactcaacctacagggtggtgtccgtgctgacggtgcttcaccaggattggctcaatggaaaagaatacaaatgtaaagtctccaacaaggccctccctgccccaattgagaaaactatatcgaaggccaagggtcaacctcgcgagcctcaggtgtacacccttccccctagccgtgaagagatgaccaaaaaccaagtcagcttgacctgccttgttaagggtttttacccctcggatatcgcagtggaatgggaatcgaacggccaacctgaaaacaattacaaaaccacccctcccgtgctggactcggatggttcgttttttctgtatagcaaactgacggtggataaatcgaggtggcaacaaggaaacgtgttttcgtgttcggtgatgcatgaagcactccataatcattacacccaaaagagcctgtcgctttcacctggtaag

SEQ ID NO: 15867 - DNA, 1422 bp, Artificial Sequence
  Description of Artificial Sequence: Synthetic coding sequence
atggcggtcatggcaccgagaaccctggtgctgctccttagcggcgcacttgcactgacccagacctgggctcaagtcacgctgcgggagagcggcccggcgctggtcaagccgacccagactctgacactaacctgtaccttcagtggctttagtctcagcacctccggcatgtcagttggatggattaggcagccgccgggcaaagctctggaatggctggctgacatctggtgggacgacaagaaggattataacccctccctgaagtcacgtttgaccatctccaaggatacgagtaaaaaccaggttgtcttgaaagtgacaaacatggacccagctgacaccgccacttattactgcgcccgatccatgatcactaattggtatttcgatgtgtggggcgccggcaccacagtgacagtatcgagtgccagtactaagggtccctcagtgtttcccttggcgccgagcagcaagagcacgagcggaggaaccgccgccctgggatgcttggtgaaagactactttccagagccagtgaccgtttcctggaacagcggcgccttaacctccggagtgcacacattcccagccgtattgcaatcatcgggcttgtattcgctcagctctgtggtgacggtgccctcctcgtccctggggacccagacgtacatatgcaatgtgaatcacaagcccagtaacaccaaggtagataagcgtgtagaacctaagtcctgcgataagactcatacttgccccccgtgccctgcccccgaacttttaggaggcccctccgtgttcctcttcccgcccaagccaaaggataccctaatgatttcgaggacgccggaggttacctgcgttgtcgtggatgtatcacatgaggacccagaggttaagttcaactggtatgtcgatggagtggaagtgcacaatgccaagactaagccccgcgaggaacaatacaattcgacctatcgcgtagtatccgtgctaacggttctccatcaggattggttgaacggcaaggagtacaagtgcaaagtcagcaataaggccttgccggcccccatcgagaagacgatttccaaggcgaagggacaaccccgagagccacaggtatacaccctgcccccatccagagaagagatgaccaagaatcaggtatccctgacctgcttggtgaaaggcttttacccgtccgatatagcggtcgagtgggaatcaaatggtcagccggagaacaactataagacgactccgcccgttctggattccgatggctccttcttcctgtactccaagctgaccgtagacaagtcccggtggcaacagggtaacgtcttcagctgctccgtgatgcacgaagccttgcacaaccactacacccagaaatccctgtcgttgagtccgggaaag

SEQ ID NO: 15868 - DNA, 1422 bp, Artificial Sequence
  Description of Artificial Sequence: Synthetic coding sequence
atggcagttatggcgccacggacactcgtgctgctgctcagcggcgccttggcactgacacagacttgggctcaggtcactctcagagaaagtggaccggccttggtgaagcctacccagacgctcacactgacctgcacttttagcgggtttagcctgtctacctctggcatgtccgtcggctggatcaggcagcctcccgggaaggcgctggaatggctggcagacatctggtgggatgataagaaagattataaccccagtctgaagagtcggctgaccatctcaaaggacaccagtaagaatcaggtggtgctgaaggtgactaacatggatccagccgacaccgcgacatattactgtgccagatcaatgataacaaattggtacttcgacgtgtggggggctggcaccaccgtgaccgtgagtagcgcgagcaccaaagggcctagtgtgtttcctctggctccatcatcaaaatctactagcggagggactgctgccctcggatgccttgtgaaggactactttccggagccagtcaccgtttcttggaacagcggtgcactgaccagcggtgtgcataccttccctgcggtattgcagtcaagcggtctttacagcctgagcagcgtggttaccgtacccagtagctcccttggcacccaaacctacatctgtaatgtgaaccacaagccgagtaacacaaaagtcgataaacgcgtcgagcctaaatcctgcgacaagacccatacctgcccaccatgtccggcacctgaactgctcggcggtcctagtgtctttctcttcccgcccaaaccaaaagatacattgatgatttctcgaacgcccgaagtgacatgtgtagtcgtggatgtgtcccacgaagatcctgaggtaaagttcaactggtatgttgacggggtggaggtgcacaatgcgaagaccaaaccccgggaggaacagtacaattccacgtaccgcgtcgtcagtgtcctgaccgttctgcatcaggactggctgaatggcaaggagtacaagtgcaaggtgtccaacaaggctctgcccgccccaatcgagaagactatcagtaaggccaagggtcaacccagagagccccaggtttacaccctgcctcccagccgagaggaaatgaccaaaaatcaggtgtctctgacttgcttggtcaaagggttttacccgtccgatattgcggttgagtgggaaagtaacggacagccggagaacaactacaaaacaacgccaccagttctggacagcgatgggagctttttcctgtattccaaactcacagtggataaatcccgatggcaacaggggaacgtgtttagttgtagtgtgatgcacgaggctctgcacaatcactacacccaaaaatctttgtctctttccccgggaaaa

SEQ ID NO: 15869 - DNA, 1422 bp, Artificial Sequence
  Description of Artificial Sequence: Synthetic coding sequence
atggcagttatggccccgaggacacttgttctcctgctgtctggtgctttggctctgacccagacttgggctcaagttactctacgagagagcggaccagcactcgtgaaacctacccaaacactgacactgacctgcaccttttcaggatttagtctgagcacatccggtatgtccgtggggtggatccgacaacccccaggtaaggctctggagtggctcgccgacatttggtgggatgataagaaggactataatccttctttaaagagccgactgacaatctctaaggataccagtaaaaaccaggtggtcttaaaagtgaccaatatggacccggccgatacagcaacttattactgcgcccgaagtatgattacaaactggtattttgacgtctggggtgccggtacaactgtcacagtttcgtctgctagcacgaagggaccttccgttttcccgctggccccatcaagcaagagtacctctggtggaactgccgctctcggatgccttgtcaaagattatttccccgagcccgtgaccgtgtcctggaattccggagcccttacgagtggcgtgcacacatttcctgccgttctccagagcagtggtctgtactcgctgtcatccgtggtgacggttccctctagcagcctcggcacgcagacttacatctgtaatgtgaaccataagcccagtaacactaaggtggacaagcgcgtcgaaccgaaatcttgtgataaaactcatacatgtcctccctgtcccgcacccgagttgttgggcggccccagcgtgttcctgttcccacctaagccaaaggacaccctgatgatttccagaacccctgaggttacctgtgtcgtggttgacgttagccacgaggatccggaagtcaagtttaattggtacgtggacggagtagaggttcataacgcgaagactaaaccacgtgaagagcaatataattcgacttatcgagtcgtatctgtcctcaccgttctgcatcaggactggctgaatggcaaggagtacaaatgtaaagtgtctaacaaggccttacctgcaccaattgagaagactattagcaaagcgaaagggcagccacgtgagccccaggtgtatacgctccctccctctcgcgaggagatgactaaaaaccaagtaagcttgacttgtctggttaagggcttttatccaagcgacatcgccgtcgagtgggagagtaatgggcagccagaaaataattataaaactacacccccagtgctggattcggacgggtcattctttttgtactcaaagctcacagttgataaatctcgatggcaacaaggaaatgtcttcagttgcagtgtgatgcatgaggcgctgcataatcactacacccagaagtccctgagtctgtcgcccggcaaa

SEQ ID NO: 15870 - DNA, 1422 bp, Artificial Sequence
  Description of Artificial Sequence: Synthetic coding sequence
atggctgtgatggccccaagaacactcgtactccttctatcaggggcattagcattaacacagacctgggcacaggtgacactcagagagagtggaccagccctagtgaagcccacacaaactctcactctgacctgtaccttctctggtttctccctcagcacaagcgggatgtctgtgggctggattcgtcagccacccgggaaagccctggaatggcttgcagacatatggtgggacgataagaaggactacaatccctccctcaagagccgcctgaccatctcgaaggatacgagtaagaaccaggttgtccttaaggttacaaatatggacccggctgatacggccacctactactgcgcacgaagcatgattaccaattggtacttcgacgtttggggggctggcactaccgtcacagtgagtagtgcgagcaccaagggccccagcgttttcccgctggctccgagttcaaagtctactagcggtggcactgctgcacttgggtgcttggttaaagactactttccagaacctgtgactgtgagttggaactccggggcactgactagcggcgtgcatacgttccccgcagtactccagtccagcggcctgtattctctttcctctgtcgtgactgtgccctccagcagtctgggaacacagacgtatatctgtaatgtcaatcacaagccctctaacaccaaggtcgacaagcgagttgaacctaagagttgcgacaaaacacatacctgcccgccatgtccggcacctgaattgctgggcggcccgtctgtctttctttttcctcccaagcctaaggacactctaatgatctcgcggactcctgaggtgacgtgtgtagtggtggatgtgtcccatgaagatcccgaggtaaagtttaactggtatgtggatggtgtggaagtccacaatgccaagacgaagcccagggaagaacaatataacagcacctaccgggtggtgtccgtgcttactgttttacatcaagattggctgaatgggaaggaatataaatgtaaggtctctaataaggcactcccggccccaattgagaaaaccattagcaaagctaaagggcagccccgggagcctcaggtctacaccctgccaccttctagggaggagatgactaaaaaccaggttagcctgacctgtctggtgaaaggattttatccgtctgatattgctgtcgagtgggaatccaacggacaacctgagaataattataagaccactccccccgtccttgattccgatggctcctttttcctatactcgaaactgaccgtagacaagtcccgttggcagcagggtaatgttttttcatgcagcgtaatgcacgaggctttgcataaccactacacacagaagtcactgtccctatctcctggaaag

SEQ ID NO: 15871 - DNA, 1422 bp, Artificial Sequence
  Description of Artificial Sequence: Synthetic coding sequence
atggctgtgatggcgccacggaccctggtgctcctgctctcgggagccctggccctcacccagacgtgggctcaggtgaccctgcgcgaaagcgggccagcactggtgaagccaacgcagacgctgactctcacctgcaccttctccggattctccttgtcaacttcgggaatgtccgtgggctggatccgccaaccacctggcaaggcccttgaatggctggcggacatctggtgggacgacaagaaagactacaatccgagccttaagtcccgcctgaccatcagcaaggatacctcaaagaaccaggttgtgctgaaggtcaccaatatggacccggcggacaccgccacctactactgcgcacggtcaatgattactaattggtacttcgatgtgtggggagccggcactaccgtgaccgtgtcatccgcctcgactaagggcccttccgtgttcccgctggccccgtcatcgaagtccacttccggcgggactgcagcgctgggctgcctcgtgaaggattactttccagaacccgtgaccgtctcgtggaactccggcgccctgacttcaggcgtgcacactttcccggcagtgcttcagagcagcggactgtactcgctgtccagcgtggtgactgtgccctcatcatcgcttgggactcagacctacatctgcaacgtgaaccataaaccgtccaacaccaaggtggacaagagagtggaacctaaatcgtgcgacaaaacccacacctgtcctccgtgccctgcccccgaactgttgggcggaccgtccgtgtttctgttcccgccgaaaccaaaagacactctgatgatctccagaactccggaagtgacttgcgtcgtggtggacgtctcccacgaagatccagaagtgaagttcaactggtacgtggacggcgtggaagtgcacaatgccaagaccaaaccgagagaggagcagtacaattccacctaccgggtcgtgtcggtgctgaccgtgctccatcaagactggctcaatggaaaagagtacaagtgcaaggtgtccaataaagccctgccggctccgatcgagaaaaccatttcgaaagccaagggccaacccagggaaccgcaagtctacacgctcccgccgtcgagggaagaaatgactaagaaccaagtgtcgctgacttgtcttgtgaagggcttctacccgtcagacatcgcggtggagtgggaatcgaacggtcagcccgagaacaattacaagaccaccccgccagtgctggattcagacggtagcttcttcctctactcgaagctgactgtcgacaagagccgctggcagcagggtaacgtgttctcatgctcggtcatgcacgaagcactgcataaccattatacccagaagtcgctgagcctgtcgcccggcaag

SEQ ID NO: 15872 - DNA, 1422 bp, Artificial Sequence
  Description of Artificial Sequence: Synthetic coding sequence
atggcggtgatggcaccgcgcaccctggtgctgttgctctcgggcgctcttgcgctgacccagacttgggcgcaagttaccctgagagaatcaggcccggccctggtgaagcccactcagaccctgaccttgacctgtaccttctccgggttcagcctcagcacttcaggcatgtccgtgggatggattcggcagcccccggggaaagcccttgagtggctggctgatatctggtgggatgacaagaaggactacaacccgagcctgaagtcccggctgactatttccaaggacacttcgaaaaatcaggtggtcctgaaggtaaccaacatggatccggccgacaccgctacttactattgcgccaggtcaatgattaccaactggtacttcgacgtgtggggcgcaggaacgaccgtgacggtgtcgtccgcgtccaccaagggaccgtcagtgttcccattggccccatcctccaaaagcacctccggcgggaccgcagcgttgggctgcttggtgaaagactactttccagagccggtgactgtctcgtggaactcgggagcgctcactagcggagttcacactttccctgcagtgctgcagtcgtcgggactctactcgttgtcctcggtggtgaccgtgccgtcatcaagcctgggaactcagacctatatctgcaacgtcaaccataagcctagcaacactaaggtggacaaacgggtggagccgaaatcatgtgacaagactcatacctgccctccgtgcccagcgcccgaactgctcggggggccgtccgtgtttctcttcccaccaaaaccaaaggatactctgatgatttccagaacgccagaggtcacctgcgtcgtggtggatgtgtcccatgaggacccggaagtgaagtttaactggtacgtcgacggagttgaagtgcacaatgccaagacgaagccacgggaggaacagtacaattcgacttacagggttgtctcagtgctgactgtcctgcatcaggactggctcaatggcaaggaatacaagtgcaaggtcagcaataaggccctgccagctccgatagaaaagaccatctcgaaggcgaaggggcagccacgagaaccacaagtttacactctgccgcctagcagagaggaaatgactaagaaccaggtcagccttacctgcctcgtgaaaggattttaccctagcgatatcgcggtcgagtgggagtcgaatggtcagccagaaaacaattacaagaccactcccccggtactggattcggacggctcattcttcctgtactccaaactcactgtggataagagcagatggcagcaaggaaatgtgttctcctgttcagtcatgcacgaagcactgcataatcactacactcagaaaagcctgtcactctctcccggaaag

SEQ ID NO: 15873 - DNA, 1422 bp, Artificial Sequence
  Description of Artificial Sequence: Synthetic coding sequence
atggccgttatggccccccggacccttgttctgctgttgagcggcgcactcgctctcacgcagacttgggctcaagtgacccttcgggagtcaggaccagccctggtgaagccgacacagaccctgaccctaacgtgcaccttctctggattctctctgagcacttccggaatgtccgttggatggattaggcagccacctgggaaagccctggagtggctggccgatatctggtgggatgataagaaagattacaacccgtccctaaagtccaggttgaccatcagcaaagatacaagcaagaaccaggtggtcctgaaggtgacgaacatggatcctgctgacactgctacctattactgcgctcgctctatgatcactaattggtattttgatgtatggggggccggtacaaccgtgaccgtaagctccgcatccacgaagggtccctccgtcttccctctggcgccaagtagtaagagcacaagcggagggaccgccgcattgggatgtctggtaaaggactacttccctgagcctgttacagtttcctggaattcgggcgctctgactagtggagttcacacattccccgccgtgctgcagtcgagcggcttgtacagtctctctagcgtagtcactgtaccttcatcttctttgggcacacagacgtatatttgcaacgtcaatcacaagccatctaataccaaggtagataagcgggttgaacctaagagttgcgataagacccacacttgcccgccttgtccagcgccagaactgctgggcggtccctctgtttttttgtttcccccaaaacccaaagatactctgatgattagccggactcctgaggttacttgtgtcgttgtggacgtttctcatgaggatccagaagtgaaattcaattggtatgtcgacggtgttgaggtccacaatgcaaaaacgaagccaagggaggagcagtacaactcaacttaccgcgtagtttctgtgcttacagtgctacatcaggactggctcaatggtaaagagtataaatgtaaggtatccaataaagcactgcccgccccaatagaaaaaactatctcgaaggctaagggacaacctagggagccacaagtttatacgctgccaccgtcccgagaggaaatgaccaaaaatcaggtgtcgctgacctgcctggttaaggggttctacccttccgacattgcagtggaatgggagtcaaacggtcaaccagagaacaactacaaaacaacgccgcctgtgctggatagcgacggcagtttctttctgtactcaaagctgacagtggataagagccgctggcaacaagggaatgtgttctcctgcagcgtaatgcacgaggccctccacaaccactacactcagaagtctctgtcgttgagcccaggaaag

SEQ ID NO: 15874 - DNA, 1422 bp, Artificial Sequence
  Description of Artificial Sequence: Synthetic coding sequence
atggcagtgatggcccctcggaccctggtgctcctgctgtcaggagctctcgccctcacccaaacctgggcacaagtcactctgagagaatcaggtccggctctggtcaagcctactcagacccttaccctcacgtgtaccttctccggattctccctgtcgacctccggaatgtcggtgggatggattagacagccacccggcaaggcgctggaatggctcgccgacatctggtgggacgataagaaagattacaacccctcgcttaaatcgcggttgaccatcagcaaagatacttccaagaaccaggtggtgctgaaggtgactaatatggacccggcagacactgccacttactactgtgctcggtcaatgatcaccaactggtacttcgacgtttggggagcaggaaccaccgtcactgtgtcatcggctagcactaagggaccgtcggtgttcccgttggccccttcctcgaagtcgacctcgggaggcacggccgcgctcggatgcctggttaaggactacttcccggagcctgtgaccgtgagctggaactccggggcgctgacgtccggagtccacacctttccggcggtgctgcagtcgagcggactctacagcctgtcgtcggtggtgacggtcccctcctcgagcttgggaacccagacttacatctgtaatgtcaaccataagccaagcaacactaaggtcgataagagagtcgaaccaaaatcctgtgataaaactcatacctgcccgccgtgccctgcgccagaactcctcggaggcccatccgttttcctgtttccgccgaagccgaaggatactcttatgatatctcgtacgcccgaggtgacttgcgtcgtggtggatgtttcacacgaggaccccgaggtgaaattcaattggtatgttgacggcgtggaggtccacaatgccaaaacgaaaccgcgcgaggaacagtataactcaacctaccgggtggtgtcggtgttgaccgtgctgcatcaggattggcttaacggaaaggagtacaagtgcaaagtctcaaataaggccctgccagccccgatcgaaaagacgatctccaaagcaaagggacagccgagggagccgcaggtctacaccctcccgccaagccgggaagaaatgactaagaaccaagtgtccctgacttgcctggtcaagggattctacccctcggatattgctgtggagtgggaaagcaacggacaaccggaaaacaattacaaaaccactccaccagtgctggactcggacgggagctttttcctttactctaagctcaccgtcgacaagtcacgctggcaacagggaaacgtcttttcgtgttccgtcatgcacgaggccttgcacaatcattacactcagaagtccctctcgctttcccccggaaag

SEQ ID NO: 15875 - DNA, 1422 bp, Artificial Sequence
  Description of Artificial Sequence: Synthetic coding sequence
atggcggtgatggctccgcgtaccctggtgctgctcctcagcggagcactggcgctgacccagacctgggctcaagtgaccctccgagagagcggaccggccttggtgaagccaacccagactctgacgctcacctgcacgttttccgggttctctctgagcacctccggcatgtcggttgggtggattcgccagccgcccggaaaagcgctcgagtggctggcggatatctggtgggacgataagaaggattacaacccgtcactcaaatcgcgcctgaccatctcgaaagacacttcaaagaatcaagtcgtcctgaaggtaaccaatatggaccctgccgatactgccacctactactgtgcacgcagcatgataactaactggtacttcgacgtctggggcgccggtaccactgtcacggtgtcctccgcgagcaccaaaggtccgtcagtgttcccgctcgcgccttcttcgaagtcaacgtcgggtggcacggccgcgcttggctgccttgtgaaagactacttccccgaacccgtgaccgtgagctggaactccggcgctctcacttccggagtccatacctttcctgcagtcctgcagagcagcggactgtactccctctcaagcgtcgtgactgtgccgtcctcgagccttggaactcaaacttacatctgcaacgtaaaccacaagccgtcgaacactaaggtcgataagagggtcgaaccgaaatcttgtgacaaaacgcacacttgcccgccttgcccggcccctgaacttctgggaggtccgtcggtgtttctgttccccccaaaacctaaggataccttgatgatctcgcggaccccagaagtcacctgcgtcgttgtggacgtgtcacatgaggatccggaagtgaagttcaactggtacgttgacggcgttgaggtgcacaatgccaagaccaaacctcgggaagagcaatacaacagcacgtaccgcgtagtgtccgtcttgaccgtccttcatcaggactggctgaatggaaaggaatacaaatgcaaggtgtccaacaaggctcttccggcaccgattgaaaagaccatctctaaagccaagggacagccaagggagccgcaggtgtacaccctcccaccatcgagagaagagatgacgaagaatcaggtgagcctgacttgcctggtgaaagggttctacccatcggacatcgcggtcgagtgggaatcaaatgggcaacccgagaataactataagactactccaccagtcctggattcggacggtagctttttcctgtattcaaagttgaccgtggacaagtcaagatggcaacaggggaacgttttctcgtgttccgtgatgcacgaggcgctgcacaaccattacactcaaaagtccctgagcttgtctccaggaaag

SEQ ID NO: 15876 - DNA, 1422 bp, Artificial Sequence
  Description of Artificial Sequence: Synthetic coding sequence
atggcggtgatggcaccgagaaccctggtactgctactctccggcgctcttgccttgacgcagacatgggcccaagtcaccttgcgcgagtccggacccgccctagtcaaaccgacccagaccttaaccttaacttgtaccttctctggctttagtctctcaacttccggaatgtctgtgggctggatacggcagcccccaggaaaagctcttgagtggcttgccgatatctggtgggacgacaagaaagactacaatcctagtctgaaatctcggctgacaattagtaaagatacatcaaagaatcaggtggttctgaaggtgaccaacatggatccagctgataccgctacatactactgtgccagatcaatgattaccaattggtattttgatgtatggggcgccggaactacggtaacggtgagcagtgcctcgactaagggtccctcagtctttccacttgccccatcctcaaagagtacatccgggggtacagcagcactgggctgcttggtcaaagattacttccctgagcccgttactgtttcctggaactcaggggcgttgacctctggagtgcatacatttcccgcagtactgcaatcatccggtctctactccctttcttcagtggtgactgtcccctcctcctccttgggcactcagacgtacatttgtaacgttaatcacaaaccctcaaatacaaaagtggataaaagagtggaacccaaatcttgtgataaaacccatacctgccccccctgccctgcacccgagctgctgggcggaccttccgtgttcctgtttccacctaagccgaaggacacgctgatgatctctcgcactccagaagtaacctgcgtcgtcgtagacgtttcgcatgaggatcccgaggtgaaatttaactggtatgtagacggtgtagaagtccataatgcgaagactaagccgcgggaggagcagtataacagcacttaccgcgtggtctcggtcctcacggttctgcatcaggattggctcaacggcaaggagtacaaatgcaaggtgtccaataaagctctaccagcaccaatcgagaagaccatctcaaaagccaaaggacagccccgcgagccacaggtgtataccctgcctcctagcagagaggagatgacaaaaaaccaagtgagcctcacgtgtctcgtcaagggcttttacccctccgatatcgcagtggaatgggaaagcaatggacagcccgagaataattacaaaacgaccccgcccgttctcgactctgatggatcattcttcctatacagcaagctgaccgtggataaatcaaggtggcagcaaggaaatgtattctcctgttcagttatgcacgaggccctgcacaaccattatacacaaaagtccctatcactgagccctgggaag

SEQ ID NO: 15877 - DNA, 1422 bp, Artificial Sequence
  Description of Artificial Sequence: Synthetic coding sequence
atggcagtgatggcaccaaggacgctggttctgctcctgtcaggagctctggccctgactcaaacctgggcccaagtcactctgcgggaatcgggaccggcactggtcaagccgactcagaccctgacccttacctgcaccttcagcggattttctctgtcaacgtccggaatgagcgtcggctggatccggcaaccgcccgggaaggcgttggaatggctcgcagacatctggtgggatgataagaaggactacaatccttcgctgaagtcgcgccttaccatctcaaaagatacctccaaaaatcaggttgtgttgaaagtcacgaacatggatccagcagatactgctacctactactgtgctaggtccatgatcaccaattggtacttcgacgtgtggggggccggtactaccgtcacggttagctcggcgagcactaagggaccgtcggtgtttccgctggccccatcatccaagtcgacgtccggcggcacggccgcccttggatgcttggtgaaggactacttcccagagccggtgaccgtctcctggaactcgggtgcccttacttcaggtgtccacacctttccggccgtgctgcagtcatccggactctactccctctcatcggtggtcaccgtcccgtccagctctctcgggacccagacgtatatctgcaacgtgaaccacaagccgtccaataccaaggtggacaaacgcgtggagcctaagagctgcgacaaaacgcatacctgcccaccttgtcccgccccggagctgcttggaggaccctcggtctttctcttcccaccgaagcctaaggatactctcatgatcagccgcacccccgaggtgacctgcgtggtggtggacgtgtcgcatgaggatccggaagtgaagttcaactggtatgttgacggagtggaggtgcacaatgcaaagactaagcccagagaggaacagtacaatagcacttatcgggtggtcagcgtgttgactgtcttgcatcaagactggctcaacggaaaggagtacaagtgcaaagtttccaacaaggccctgccagccccaatcgaaaaaaccatctcgaaagccaagggacagccacgcgaacctcaggtctacactctccctccgtcgagagaggagatgaccaaaaaccaagtctcgctcacttgtctcgtgaaaggtttttacccgtccgacatcgcagtcgaatgggaatccaatgggcaaccggagaacaactacaaaactacccctcctgtgctggactcggacggctcgttcttcttgtactctaaactgactgtggacaagagccggtggcaacagggaaacgttttcagctgcagcgtgatgcatgaagctctgcacaaccactatactcaaaagtccctgtccctgtcgccgggaaaa

SEQ ID NO: 15878 - DNA, 1422 bp, Artificial Sequence
  Description of Artificial Sequence: Synthetic coding sequence
atggctgttatggcgcctcggacgctggtcctcctgctctccggcgccctggcactcacccaaacctgggcgcaggtgactctgcgcgaatcaggtccagcactggtgaaaccgactcagacgctcacgctgacctgtaccttctcaggtttctcgctctcaacctcggggatgtcagtcggatggatcagacagccaccagggaaggcccttgagtggctggctgatatctggtgggatgataagaaggattacaacccctctctgaaatctcggctgaccatttcgaaggatacgagcaaaaaccaagttgtgctcaaggtgactaacatggaccctgcggatactgccacctactactgtgcacggagcatgatcactaattggtacttcgacgtgtggggagcaggaaccactgtgaccgtctcgtctgcttccactaagggaccgagcgtgttcccgcttgcaccttcatccaagagtacctcaggcggcactgccgcgttgggatgccttgtgaaggactacttcccggagcctgtgactgtgtcctggaattcgggagcgctgacctcaggcgtgcacacgtttccagccgtgttgcagtcctccggactgtattccctgagctccgtggtgaccgtgccgtcgtcctcgcttggcacgcaaacttatatctgcaatgttaatcataaaccatcgaacaccaaggtggacaaacgggtcgaacccaagtcatgcgacaagactcacacttgtccgccatgcccagccccggaactgctgggaggaccgtccgtgttcctgttcccgccaaaacctaaggacacgctgatgatctcacggacgcccgaggtcacttgcgtggtggtcgacgtttcgcatgaggaccctgaggtgaaattcaattggtacgtggatggagtggaggtccacaacgcaaagactaagccgcgggaagaacaatacaattcgacctaccgagtggtcagcgtgctcactgtcctccatcaggactggctcaacggaaaggaatacaaatgcaaggtgagcaataaagcactcccggcaccgatcgaaaagactatctccaaagctaaagggcagcctagggaacctcaagtgtacaccctgccgccgagccgggaggaaatgaccaaaaatcaagtgtccctcacgtgcctggtcaaggggttctatccgtccgatatcgccgtcgagtgggagtccaatgggcagccggagaacaattacaagaccactcctcctgtgctcgactcggacgggtccttttttctctacagcaagctgacggtcgataagtcccgctggcaacaaggaaacgtgttctcgtgctccgtgatgcacgaggcactccataaccactacactcaaaagtccctgtcgctgtccccaggaaaa

SEQ ID NO: 15879 - DNA, 1422 bp, Artificial Sequence
  Description of Artificial Sequence: Synthetic coding sequence
atggcggtgatggctccgcgcaccctggtcctcttgctcagcggagcgctggcgctgacccagacctgggcgcaggtaaccctgagagagagcggaccggcactggtgaagccaacccaaaccctgacgctcacgtgcaccttttcgggcttctcactctccacctccggaatgtcagtgggatggatcagacagccgcccggaaaggcccttgaatggctcgcggatatttggtgggacgacaagaaggattacaacccatcactgaagtcccgcctcaccatctcgaaggacacctccaagaatcaggtggtcctgaaggtgactaacatggacccggcagataccgcaacctactactgcgcacggtccatgatcaccaactggtacttcgatgtctggggagccggcactaccgtcactgtctccagcgccagcactaagggtccgagcgtgttcccgctggccccatcgtccaagtcgacctcgggcggcactgccgcacttggatgccttgtgaaggattacttcccggagccggtgactgtgtcgtggaactcaggcgcgctcacctcgggagtgcacaccttcccggcggtgcttcagtcgtccggattgtacagcctgtcgtcggtggtgaccgttccgtcctcttccttgggaacccagacctacatctgtaatgtgaatcataagccctccaacaccaaggtggataagcgggtggaacctaagtcgtgcgacaagactcatacttgtcctccgtgtccagcccccgaactgctgggcggccccagcgtgttcctgttcccaccaaagccaaaggatactctgatgatctcacgcacccctgaagtgacttgtgtggtggtggatgtgtcccacgaggaccccgaggtcaagttcaactggtacgtggatggcgtcgaggtgcataacgccaaaaccaagccacgcgaagaacaatacaactccacttaccgcgtggtcagcgtcctgactgtgcttcaccaagattggctcaatggtaaggagtataagtgcaaggtgtcaaacaaagctctcccggccccgatcgaaaagaccatctcgaaagcaaaaggacagccacgcgaaccgcaggtgtacacgttgccgccgtcgcgggaggaaatgaccaagaaccaagtctccttgacctgcttggtgaaaggattctacccgtccgacattgccgtggaatgggaatccaacgggcaaccggagaataactacaaaactacgcctccagtcctcgactcagatggatcgttcttcctctatagcaaacttactgtggacaagtcgcgctggcagcagggaaacgtgttttcatgctcagtgatgcacgaagccctgcacaatcattacactcaaaagtcgctgtcgcttagcccggggaag

SEQ ID NO: 15880 - DNA, 1422 bp, Artificial Sequence
  Description of Artificial Sequence: Synthetic coding sequence
atggccgttatggctccacgaacgttggtgctgttgctgtctggagcacttgcacttacacaaacatgggcacaagttaccttacgagagagtggaccagctctagtaaaaccaacacagactctgacactaacgtgcactttcagtggcttttccttgagcactagtggaatgtcagttggttggatcagacagccgccaggcaaagcgttggagtggcttgcagacatttggtgggacgataaaaaagactacaacccttcacttaagtcacgactgaccattagcaaagatacttcaaagaatcaggttgtcctgaaagttacgaatatggaccctgcagatacggctacatattattgtgcgcggtccatgattactaattggtatttcgacgtctggggtgcaggaacgaccgtaaccgtgtccagcgcatcgactaaaggcccgtctgtgttcccgttagcaccatcgtcaaaatcaacctcggggggaacagcggcactgggatgtctggtcaaagattatttcccagaacccgtcactgtttcatggaactccggagccttgacttccggagttcacactttcccagcggttctccaatcaagtggactatactcgctgagcagcgtagtgactgtcccttctagttcactgggaacacaaacttatatatgtaatgtgaatcataagccttccaatacgaaagtagataagcgagtagaaccgaaatcatgtgataaaacacacacctgcccaccttgcccggctccagagctgttggggggaccatcagtatttttgtttccaccaaaaccaaaggatactcttatgatctcccgcacgccagaagttacgtgtgttgtagttgacgtttcacacgaagacccggaagtgaaatttaattggtatgttgacggagtcgaagtccacaatgctaagactaaaccacgtgaagaacaatacaattcaacataccgggtcgtgtcagtactgaccgtgttgcatcaggattggcttaacggaaaagaatataagtgtaaagtgtctaataaagccctcccagccccaattgaaaagacaattagtaaagccaagggacaaccccgtgaaccacaagtttacacgctaccaccttcccgtgaagaaatgacaaaaaatcaagttagtctcacttgcttagtgaaaggattctaccctagtgacatagcggttgaatgggaatctaacggtcaacctgaaaataattacaagacaacaccaccagttttggattctgacggatccttttttttgtattccaaactcactgttgataagagtcgatggcaacagggtaatgttttttcttgttcagttatgcatgaagcgctgcacaaccattacactcaaaaatcactttcactgtcgccgggaaag

SEQ ID NO: 15881 - DNA, 1422 bp, Artificial Sequence
  Description of Artificial Sequence: Synthetic coding sequence
atggctgtcatggcccctcggaccttggttttattgctatcaggagcgctggccctgacccaaacttgggcgcaggtgacactgagagaatcaggccctgcattagtgaaacctacgcagaccctgaccttgacctgcactttcagtggtttttcccttagtacctctggaatgtcagtcggttggatcaggcagcctcctgggaaagccctggagtggctggctgatatctggtgggacgacaaaaaggactataacccctccctgaaaagccgcttgaccatttccaaagataccagtaagaaccaggttgtgctgaaggtcaccaatatggatccagccgacactgctacctactattgtgcgcggagcatgattactaactggtacttcgacgtgtggggggctggtacaacggtgacagtctctagcgctagcaccaagggtccatccgtattcccgttggccccgtccagcaaatccacaagtggtggaaccgccgcactgggctgcctggtgaaggattacttccccgaacccgtgacagtgtcctggaattctggcgcacttacatccggggtgcacaccttcccagccgtgctgcagagctccggactgtatagcctttccagcgttgtcactgtgccaagttcctccctgggaacacaaacgtacatctgcaacgtcaaccataagccaagcaataccaaggtggacaagcgagtggagcctaagtcatgcgacaaaactcacacctgcccaccatgccctgctccagaactgctgggcggccccagcgtattcctctttcctcctaagcctaaggacacccttatgattagcaggacacccgaggtgacctgcgtcgtggtggacgttagtcacgaggaccccgaggtcaaattcaattggtacgtagacggagtggaggtccataacgctaagactaaaccgcgggaggaacagtacaattcaacgtatagggtagtttctgtgctaacggtgctgcaccaggattggttgaatggtaaggaatacaaatgcaaggtgagcaataaagctttgccagctccaatcgagaaaacgatttcaaaagctaagggccagcccagagagccccaagtatacaccctccctccctcaagggaggagatgacgaagaaccaggtttccctcacatgcttggtcaagggcttttatccgtccgatattgcagttgagtgggaaagtaatggccagcccgaaaacaactacaagacgaccccaccggtactggacagcgacggctcattttttctttatagtaagctcactgtggataaatcccgatggcagcagggcaacgtcttctcctgctcagtaatgcatgaggctttgcataaccactacacacagaaatccctgagcttatcacctggcaag

SEQ ID NO: 15882 - DNA, 1422 bp, Artificial Sequence
  Description of Artificial Sequence: Synthetic coding sequence
atggctgtgatggccccaagaaccctggtgctgctgctgtccggagctctggcgctgacccaaacctgggctcaggtgactctgagagaatcaggtcctgcccttgtgaagcctactcaaacgctgactctgacgtgcaccttcagcggcttcagcctgtctacttcggggatgtccgtcggatggatccggcagccaccagggaaagcactggaatggttggccgacatctggtgggatgacaaaaaagactataacccgtcacttaagagccgccttacgatcagcaaggacacctcaaaaaaccaagtggtcttgaaggtgaccaatatggaccctgcggataccgccacctactactgcgcccgctcgatgatcactaattggtacttcgatgtttggggggccggtactactgtcacggtgtcgtcggcaagcaccaagggaccatccgtgtttccattggcgccgagctcgaagagtactagcggcggtaccgcggcactcgggtgtctggtgaaggattactttccggagcctgtgaccgtgtcgtggaactcaggagctctgacttccggagtgcacaccttccctgctgtgctgcagtcgtcaggactctacagcttgagctccgtcgtgaccgtgcctagctcctcgttgggaacccagacctacatctgcaacgtcaatcacaagccgagcaatacgaaagtggataagcgcgtggaaccaaaatcctgcgacaaaacccatacctgcccgccatgcccggctccggagctcctgggcggaccatcagtgtttctgtttccacccaagccgaaggacactctgatgatctccagaaccccagaagtgacctgcgtggtggtggacgtcagccacgaggaccctgaggtaaagttcaactggtacgtcgacggagtggaggtgcacaacgccaaaactaaaccacgcgaagaacagtacaactccacttaccgggtggtgtctgtgttgactgtgctgcatcaggactggctgaacggaaaggaatacaagtgcaaggtgtcgaacaaggctctccccgcgccgatcgaaaagaccatttctaaggccaagggacagccgcgcgagccgcaagtgtacactctgccaccttctcgcgaggagatgacgaagaaccaagtgtcgctgacctgtctcgtcaaaggcttttacccgtcagatatcgccgttgagtgggaatcgaacgggcagcctgaaaacaactacaagacgaccccgcccgtgctggatagcgacggatcgttcttcctgtactccaagctcactgtcgataagtcacgatggcagcagggaaacgtgttcagctgtagcgtcatgcacgaagcactgcacaaccattacacccaaaagtcgcttagcctctcaccaggcaag

SEQ ID NO: 15883 - DNA, 1422 bp, Artificial Sequence
  Description of Artificial Sequence: Synthetic coding sequence
atggccgtgatggctccgcgaaccctcgtcctcctgttgtctggcgccttggccctgacccagacttgggcgcaggtgaccctgagagaatctggacccgctttggtaaagccaacacagaccctgacccttacctgcactttttccgggttttctctgtctacctctggtatgtcagtgggatggatccggcagccacctggcaaggcactcgagtggctcgcagacatttggtgggatgataagaaggactacaacccttcactcaagagtcggctgacgataagtaaggatacaagcaagaatcaagtggtcctgaaggtaactaatatggaccccgccgacactgctacctattattgcgccagatccatgatcactaattggtattttgacgtgtggggcgctggcactacagtaaccgtcagtagcgcctcaactaaaggcccttctgtgttcccactggccccctccagcaagagcaccagcggcggtacagcagccctcggctgccttgtcaaagattattttccagaacccgttactgtaagctggaatagcggagctcttacatcaggagtgcacaccttccccgctgtcttgcagtcctctgggctgtattcactgtcatctgtagtgacagtgccaagtagctccctcggcacccagacgtacatctgcaatgtaaaccacaagccctctaacacaaaagtggataagagggtggagcctaagtcttgcgataagacacatacgtgtcccccttgtcctgcaccagagctgctgggcgggccctccgtgtttctgttccctcctaagccgaaagatacgttgatgatatctcggaccccagaagttacgtgcgttgtggtcgatgtatcccacgaggaccccgaggtcaagtttaactggtatgtggatggcgttgaagtccacaacgctaagaccaaacctcgcgaggagcagtacaacagtacctaccgggtggtgtctgtgttgaccgtgctgcaccaggattggctgaacgggaaggagtataagtgcaaggtctccaacaaagcacttccagctccgatcgagaagaccatttcaaaagctaagggccagccaagggagccccaagtgtatacgctgcccccctccagggaggagatgaccaagaatcaagtttccctgacatgcctggttaagggcttttacccctctgacatcgctgtagagtgggagagcaacgggcaacccgagaacaactacaaaactacacctccggtcctggactccgacgggtccttttttctctattctaaactcactgttgataagagccgctggcaacaggggaacgtcttctcttgtagcgtcatgcatgaggcattgcataatcattacacccagaagagcctttcccttagccccgggaag

SEQ ID NO: 15884 - DNA, 1422 bp, Artificial Sequence
  Description of Artificial Sequence: Synthetic coding sequence
atggcagtgatggcgccacgtactttggtcctgctgctgtccggagcactggctctcacacaaacttgggcgcaggtgacattgcgtgagtcagggcccgccttagtcaagcctacccagaccttgactctgacgtgtaccttcagtggatttagcttgagtaccagcgggatgtcagtgggttggattagacagccccctggcaaggccttggagtggctggcagatatctggtgggacgataagaaggactataatccatccttaaaatccagacttactatctctaaggacacaagcaagaaccaggtggtgctgaaggtgaccaatatggatccagcagataccgccacatactactgcgcccgaagcatgatcaccaactggtattttgatgtctggggggccggtacaactgtcaccgtatccagcgccagcactaagggaccgtcagtattcccattggcccccagctccaaatccacctccggcggcacagccgccctaggctgcctcgttaaggattacttcccagagcccgtgacggtgtcatggaactccggagccctcactagtggagttcatacgttcccagcagtcctgcaaagctctggtctgtatagcctaagctctgtagtcacagttcctagtagctcgttgggaacccagacatacatttgtaacgttaatcacaagcccagcaatacaaaagtcgataagagagtagaaccaaagagctgcgacaagacccacacatgtccgccttgtcctgctcccgagctcctgggaggacctagcgtgtttttgttcccgccgaagcctaaggacacacttatgatctctaggacgcccgaggtcacatgtgtcgtggtggacgtgagtcatgaggaccccgaggtcaagttcaactggtacgtggatggagtggaggtacacaacgccaagacaaagccaagagaagaacagtacaattctacataccgcgttgtgtcggtgttaactgtgctgcaccaggattggctgaatgggaaggagtataaatgcaaggtgtcgaacaaggctctgcccgcaccgatcgaaaagacaatatccaaggccaaaggccagccacgcgagcctcaagtgtacacgctaccacctagtcgggaagaaatgactaagaaccaggtgtcactgacctgcctagtgaagggtttctacccttctgatatagctgtggagtgggaatcaaacggccaaccagagaacaactacaagaccaccccccctgtgctcgactcagatggctctttcttcctctattccaagttgactgtggataagtctcgctggcaacaggggaacgtgtttagttgcagtgttatgcatgaggctctccataatcactacacgcagaagagcctgtcattgtccccaggcaaa

SEQ ID NO: 15885 - DNA, 1422 bp, Artificial Sequence
  Description of Artificial Sequence: Synthetic coding sequence
atggccgtgatggccccccgcaccctggttctgttgctttcaggtgccctcgccttgacccagacatgggcccaggttactcttagagagtccggcccagcactagtgaaaccgacccaaacacttaccctgacctgtaccttcagcggattttccctttctacttcaggtatgtctgtcggctggatcagacaacctccaggtaaagccctggaatggctggcagacatctggtgggatgataagaaggactataaccccagcctgaaaagtcggcttacgatttctaaggatacctcaaaaaatcaggtggtcctgaaggtgactaatatggatcccgctgatacagcaacttattactgcgcccgtagtatgatcacgaattggtactttgatgtatggggcgccggaactaccgttacagtctcctctgcttctacaaagggtccgtccgtcttccccctggcccctagctctaagtctactagtgggggcactgcagctctggggtgtcttgtcaaagactatttcccagaaccagtgacggtcagctggaacagcggcgctcttacatccggagtccacactttccctgccgtgctccagtcatccggcttgtattctctgtcctccgtggtgaccgttccgtcgtcctccctaggtactcagacatatatctgtaatgtgaatcacaaaccgtcgaatactaaagtggacaagagggtggaacccaagtcctgcgataaaacgcacacgtgcccgccttgtcctgcacctgaactcctgggtggccccagcgtgttcctgttccctccaaagcctaaagatacacttatgatctccagaactcctgaagtgacatgcgtagtggtcgacgtcagccatgaggaccccgaagtgaagttcaattggtatgttgacggcgtcgaggttcacaatgcaaagactaaaccaagggaggaacagtacaattctacatatagggtcgtcagtgtattgacggtgctccatcaggactggttgaatgggaaggaatacaaatgtaaagtttcaaacaaggccctgcctgctcctatagaaaagaccataagtaaagccaaaggacagccgagggaacctcaggtgtatactctgccccctagcagggaagagatgaccaaaaatcaggtgagtctaacctgtcttgtgaaggggttctatccatccgatattgctgtcgaatgggagagtaacggacagcccgaaaataattataagacgactccccccgttttagactctgacggctcctttttcctgtattctaagttgaccgtggacaaaagtcgatggcagcagggaaatgtattttcatgctccgtcatgcatgaagccttacacaaccactacacacagaaatcactgagtctatcccctggcaaa

SEQ ID NO: 15886 - DNA, 1422 bp, Artificial Sequence
  Description of Artificial Sequence: Synthetic coding sequence
atggctgtaatggccccccgtactctcgtactgttgctttcaggagcattggccctcactcagacctgggcccaagtgaccctgagagaatctggcccagcactcgtaaagcctactcagactctgacattgacctgtaccttcagcggattctccctgtccacctcaggaatgtctgttggttggatacgtcaacctcccggcaaggccctggaatggctggcagacatctggtgggacgacaaaaaggactataaccctagtctcaaaagtaggcttactatcagtaaagacacatcaaaaaatcaggtggtgttgaaagtgaccaacatggacccagctgataccgccacctattattgcgcaaggtctatgatcacaaactggtattttgacgtctggggcgcaggaacaacagtgacagtgagcagcgcctccactaagggcccctccgtgtttcctctggccccctcctccaaatctacatccggtggcacagccgcattgggctgcctggtaaaggactacttcccagaaccagtcacagtgtcttggaactctggcgccctgacctcaggtgtgcacaccttccccgccgttcttcagagttcaggtctttactccctctcttccgttgtcacagtcccctcaagcagtctcggtacacagacctatatatgcaatgtgaaccacaagccttccaatacaaaagtggataaaagagtcgaacctaagtcatgtgacaagacacatacatgtccaccctgccctgccccagagcttttgggtggtccttcagtgttcctgttccctcctaagcctaaggacactctgatgatttcaagaacacctgaagttacttgcgtcgtagtcgatgtgagccacgaagatccagaggttaagttcaactggtacgtcgatggagtggaggtgcataacgcaaaaactaagccaagggaggagcagtacaattccacctatcgtgtagtgagcgtcctcacagtactccatcaggactggctgaatggaaaggagtataagtgtaaggtttcaaacaaggcactgccagctccaatagagaagacaatctccaaggccaagggccagccccgcgagcctcaggtttacacccttcctcctagtagagaggagatgacaaagaaccaggtaagcttgacctgtctcgtgaagggcttctatccctctgacatcgccgtcgagtgggagtccaatggtcagccagagaataactacaaaaccacacctccagtcctggactccgatggctcatttttcctctactcaaaactcacagttgacaagagtagatggcagcagggtaacgttttttcttgctctgtgatgcacgaggctctgcacaatcactacacacagaagtccctctcactgtctcctggcaaa

SEQ ID NO: 15887 - DNA, 1422 bp, Artificial Sequence
  Description of Artificial Sequence: Synthetic coding sequence
atggcagtgatggcgccacgcaccctggtgcttttgctttccggagcactggcactgacccaaacttgggcacaggtcacgcttagagagtcgggacctgcgctcgtgaagccaacccaaacgctgactctgacttgtaccttttcaggattttcgttgtcaacttcgggtatgtcggtgggatggattcgccaacctccaggtaaggctctggagtggctggccgacatatggtgggacgacaagaaggattacaatccctcgcttaagtcgcggctgaccataagcaaggatacttcaaagaatcaggtggttcttaaagtgactaacatggaccctgcagatactgcaacttactactgtgcccgctcgatgatcactaactggtactttgacgtgtggggtgccgggactactgtgactgtgtcgtccgcatcgaccaagggaccttcggtttttccactggcgccttcatccaaaagcacttccggtggcacggccgcgttgggatgtctcgtgaaggactacttccccgaacctgtcacggtgtcctggaactcgggagcactgaccagcggagtgcatacgtttcccgcagtgcttcaatcgtccggtctttactcgcttagtagcgtcgtcactgtcccatcatctagcctgggcactcaaacctacatctgtaacgtgaatcataagccatcgaataccaaggtggacaagagagttgagcccaaatcctgtgataaaacccatacgtgccctccctgtcctgcccctgagctgttgggaggaccttcggtctttctgtttcctcctaaaccaaaggataccctgatgatttcacggacccccgaagtgacctgtgtggtggtggatgtgtcacatgaagatcctgaggtcaaattcaactggtacgtcgatggtgtcgaagtgcataatgcaaagaccaagcctcgggaagagcagtacaattcgacctatagagtggtttcggtcctgacggtgctccatcaagattggcttaacggaaaggaatacaagtgcaaagtctcaaataaggctcttccagccccgattgaaaagaccatttcgaaggcaaaaggccagcctcgagaacctcaggtttacactttgccaccttcgagggaagagatgaccaagaaccaggtgtccctgacctgccttgtgaaaggtttctacccatcagacattgcagtcgagtgggagtcgaatggccagcctgagaacaactacaaaactacgcctccagtgctcgattccgatggatcgttctttctgtactcaaagctgactgtggataaatcccgctggcaacaaggaaacgtgttttcatgttcggtgatgcacgaagccctgcacaaccattatactcaaaaatcgctgtcactgagccctggcaag

SEQ ID NO: 15888 - DNA, 1422 bp, Artificial Sequence
  Description of Artificial Sequence: Synthetic coding sequence
atggccgtcatggccccaaggactctcgtcctgctgcttagtggggcacttgccctcactcagacctgggctcaggtaacccttagagagtcgggccctgccctggtcaagcctactcagactctgacgctgacttgcactttttcgggattttccctttctacctcaggtatgtccgtgggctggattcgccaaccccctggaaaggcactggaatggcttgcagatatttggtgggacgataagaaagactacaatccttcattgaagagtcggctgactataagcaaggacacgtcaaagaatcaggtggtcctgaaggtgactaacatggaccccgctgataccgcgacgtactattgcgcaagatcaatgattacgaactggtacttcgacgtgtggggagctggtaccaccgtgaccgtgagcagcgcatcgactaaaggaccttcggttttccccctcgcaccgtcgtcgaagtccacgagcggcggcactgcagcactgggttgtcttgtcaaagattacttccccgagccagttaccgtgtcgtggaactcaggcgcattgacctcaggggtgcataccttccctgcagtcctccaatcaagcgggctctactccctttcctcggtcgtaaccgtaccatcgtcatcgttgggaacccaaacctacatttgcaatgtgaatcataaaccttccaacacgaaggtggataagagggtcgagccaaaatcgtgtgacaaaactcatacctgtcctccatgtcccgcgcctgagcttttgggagggccgtccgtgtttctgtttccaccaaagcctaaggatactcttatgatcagccgtactccagaagtaacttgtgtggtggtggatgtctcacatgaagatccggaagtgaagtttaactggtatgtggacggtgtggaagtgcacaacgccaagactaagcctcgagaggaacagtacaattccacctaccgtgtcgtttccgtgctcactgttctccatcaggattggctgaacggaaaagaatacaagtgtaaggttagcaacaaagctctgcccgcaccgattgaaaagacgatctcgaaagcgaaaggacaacctcgagaacctcaagtctacaccctcccaccatcgagagaagagatgaccaagaaccaagtcagcctcacttgtctcgtgaagggattttacccatcggatatcgcggttgaatgggaatcaaatggtcaaccagaaaacaattacaaaactacgccgcccgtgcttgattcggacggatccttttttctttacagtaaacttaccgtggataagtcccgctggcaacaaggaaacgtgttcagctgctcggtgatgcacgaggcactgcacaaccattacactcagaagagcctttcattgtctccgggtaag

SEQ ID NO: 15889 - DNA, 1422 bp, Artificial Sequence
  Description of Artificial Sequence: Synthetic coding sequence
atggccgtgatggcccccagaaccctggtcctcctgttgtctggagccctcgcactcactcaaacgtgggctcaggttactcttagggagtccgggcccgccctcgtcaaaccaacccagactcttaccctgacctgcacattctctggtttctcactgagcacatcaggcatgagcgtcgggtggatacgccaaccccctgggaaagccctggaatggcttgctgatatatggtgggacgataaaaaggattataatccaagcctgaagtccagactgacgatcagtaaggacacaagcaaaaaccaggttgtgctgaaggtcactaacatggatccagctgataccgccacatattactgcgcaaggtccatgatcactaattggtacttcgacgtctggggggccggtacaacagtgacggtgtcatctgccagcacaaaaggcccctccgtctttccccttgcccccagttctaaatccacatccggcggcacggctgcgctggggtgcctcgtgaaggactattttcctgagcccgtaacggtgtcatggaacagtggggcactgacctccggagtccacaccttcccggccgtcctgcagagctctggcctgtactccttgtcatccgtggttacggtgccatcatccagcctgggaacccagacttacatttgtaatgtgaatcacaagccttctaatacaaaggtcgataagagggtggaaccaaaatcctgtgataagacccacacatgcccaccatgtccggcccccgagctgctcggcggtccgagcgtctttctctttccccccaagcccaaggacaccctgatgatttccaggactcccgaagttacctgcgttgtggtcgacgtgtctcacgaagaccctgaagtcaaattcaattggtacgttgacggagtcgaggtgcacaacgcgaagactaaacccagagaagagcagtacaactccacctatcgcgtagtctcagtgcttacggtgctgcaccaggactggctcaacggcaaggaatacaagtgtaaggtttccaacaaggccttgccagcgcctatagaaaagacgatcagcaaggcgaagggtcagcctcgggaaccccaggtgtataccctgcctccatccagagaagaaatgaccaagaaccaggtgtctctgacctgtctggtaaagggtttctaccctagcgacattgcggtggaatgggaatcaaacggacagcccgaaaacaactacaagacaactcctccggtgttggactcagacggcagcttcttcctttattccaagctgacagtagacaagagcaggtggcagcagggcaatgtgttttcatgtagcgtgatgcacgaagctttgcataaccattacacacagaaatctctcagcctgagcccaggcaag

SEQ ID NO: 15890 - DNA, 1422 bp, Artificial Sequence
  Description of Artificial Sequence: Synthetic coding sequence
atggctgttatggcaccacgaactcttgtacttcttttatcaggagcacttgcccttactcaaacatgggcacaagttactttaagagaatccggaccagctttagttaaaccaactcaaacattgactcttacatgtacatttagtggattttcactttcgacaagtggtatgtctgtgggatggatcagacaaccaccaggtaaggcattagaatggttagcagatatttggtgggatgacaagaaagattataatccatctctcaagtctagacttacaattagtaaagatacatctaaaaatcaagttgtattaaaagtaacaaatatggacccagcagatacagctacttattattgtgctagatctatgataacaaattggtattttgatgtctggggtgcaggaacaacagttactgtatcatcagcttcaacaaaaggaccaagtgtttttcctttagctccatcatcaaaaagtaccagtgggggaactgctgcattaggatgtctagttaaagactattttccagaaccagttactgtttcttggaattcaggtgctcttacttctggagttcatacttttccagctgttttacaaagttcaggtttatattcattatctagtgttgttactgtaccatcatcttctttgggaacacaaacatatatttgtaatgttaatcacaaaccatctaatacaaaagttgataaaagagttgagccaaaatcttgtgataagactcatacttgtccaccatgtccagcaccagaattattaggtggaccatcagtttttctttttccaccaaaaccaaaggatactcttatgatttcaagaacaccagaagttacttgtgtagttgtcgatgtttcacatgaagatccagaagtaaaatttaattggtatgttgacggggtagaagtgcataatgctaagactaagccaagagaagaacaatataattcaacatatagagttgttagtgttttaacagttcttcatcaagattggttgaatggaaaagaatataaatgtaaagtctcaaataaagctttaccagcaccaattgaaaaaacaatttcaaaggcaaaaggacaaccaagagagccacaagtgtatactttaccaccatctagagaagaaatgacaaagaatcaagttagtctaacttgtttagtcaaagggttttatccatctgacattgcagttgaatgggaaagtaatggacaaccagaaaataattataaaacaacaccaccagttcttgatagtgatggaagtttttttttatattccaaacttactgtagataaaagtcgatggcaacaaggaaacgttttttcatgttcagttatgcatgaagcattacataatcattatactcaaaaaagtttaagtttaagtccaggaaaa

SEQ ID NO: 15891 - DNA, 1422 bp, Artificial Sequence
  Description of Artificial Sequence: Synthetic coding sequence
atggctgtcatggcacccagaaccctggtgcttttgttgtcaggcgccctcgctctcacacagacatgggcccaggtgactttgcgcgagtccggcccggccttggtgaagcctacacagaccctgacactgacatgcactttcagtggtttcagtctgtcaaccagcggcatgagcgtggggtggatcagacagccacccggaaaggccctggaatggctggccgacatatggtgggacgacaagaaggactataaccccagcctgaagtcccgactgaccatcagcaaagacacaagtaagaaccaggtggtcctaaaagtgaccaatatggaccctgccgacacagcgacatattactgtgccaggtctatgattacaaattggtacttcgacgtgtggggggcgggtaccacggtgacagtgtcctccgctagcactaagggcccaagtgtgtttccgcttgccccttcttccaagagcaccagcggaggcactgcagcgctcgggtgtttggtcaaagactactttccagaaccggtgacagtgagctggaattctggcgcactgacttccggagtccacactttccctgccgtcttgcagtcctcgggactgtactctctctctagtgttgtaactgtcccatccagttccctcggtacacagacctatatctgcaacgtaaatcataagcccagtaataccaaggtagataagcgtgtggagcccaaaagctgtgataagacccacacatgcccaccctgccccgccccagagctgttgggcggccccagtgtctttctgtttcccccaaaacctaaagacacattgatgatctcacggacacctgaggtcacatgtgtcgtggtggatgtctcccacgaggatccagaggtgaaattcaactggtatgtggatggcgtggaagtgcacaatgcaaagacgaaaccccgggaagagcaatacaatagtacctaccgggtcgtttccgtcctgacagtactccatcaggactggctgaacggtaaggaatacaagtgcaaagtgtcgaacaaagctctccctgctccgatcgaaaagaccataagcaaagcgaaaggccagcctagagagccgcaggtttataccctgccacctagtagagaggagatgaccaagaaccaggtgagtctcacatgcctcgtgaaaggattttaccccagtgacattgccgtcgagtgggagtctaatgggcagcctgagaacaactacaagaccaccccaccagtgctggattctgatggaagctttttcctgtactctaagcttaccgttgataagtcaagatggcagcagggcaacgtgttcagttgttctgtcatgcacgaagcactccataaccactatactcaaaaatccctgtccctgagccccgggaag

SEQ ID NO: 15892 - DNA, 1422 bp, Artificial Sequence
  Description of Artificial Sequence: Synthetic coding sequence
atggcagtgatggcgccgaggacccttgtcctgcttttgtctggagcccttgcactgacccaaacgtgggctcaggtgaccctgagagaatccggacctgctttggttaagcctactcaaactctgaccctcacttgtactttctcaggcttttcgttgtcaacctcagggatgtctgtgggatggatcaggcagccccctgggaaggcactggaatggctcgcagatatttggtgggatgacaagaaggattacaatccatcgttgaagtcacggctcacgatatccaaggatacctccaagaaccaagtcgtgctgaaagtgactaatatggacccggcagatacggcaacttactactgtgcaagatcaatgattacgaactggtacttcgatgtgtggggagcgggaaccactgtcacggtgtcgtcggcatccaccaagggcccttccgtgttcccactggctcctagctccaagagcactagcgggggaactgcagcactgggctgcctggtgaaagattactttccagagccagtcacggtgtcctggaactccggagcgctcaccagcggagtgcatactttcccagcagttcttcagtcgtcagggctttattcgctgtcgagcgtggtcactgtgccatcgagctcgctcgggacccagacgtacatttgcaacgtgaatcacaaaccgtcgaacaccaaggttgacaaacgtgtggaacctaagtcatgtgataagactcacacttgtcctccttgtccagcaccagagcttcttggaggcccctcggtgttcctgtttccaccgaaacctaaagacacccttatgatttcgcggactccagaagtgacctgtgtggtcgtcgacgtgtcgcatgaagatcctgaagtgaagtttaactggtacgtggatggagtcgaggtgcataacgccaagactaagcctagggaggagcaatacaatagcacttaccgtgtcgttagcgtcctgacggtcctccatcaagattggttgaacgggaaggagtacaagtgtaaggtgagcaacaaggccctcccagcaccgatcgaaaagaccatttcaaaggcaaagggtcaacctagagagccccaggtctacacccttccgccatcaagagaagaaatgaccaaaaaccaggtatcgttgacctgtcttgtgaagggcttttacccatcggatatcgcagtggaatgggagtcgaatggtcagcctgagaacaattacaaaacgacccctcctgtattggacagcgatggatcgtttttcctttactcaaaacttacggtggataagtcccgctggcaacaaggtaacgtctttagctgttctgtgatgcatgaagcattgcacaatcattatacccagaaatcactgagcctctcacctggtaag

SEQ ID NO: 15893 - DNA, 1422 bp, Artificial Sequence
  Description of Artificial Sequence: Synthetic coding sequence
atggcggttatggcgccgcgtacgttagtactattactatcgggtgcgttagcgctaacgcaaacgtgggcgcaagttacgttacgagaatcgggtccggcgttagtaaaaccgacgcaaacgttaacgctaacgtgtacgttttcgggtttttcgttatcgacgtcgggtatgtcggttggttggatacgtcaaccgccgggtaaagcgctagaatggctagcggatatatggtgggatgataaaaaagattataatccgtcgctaaaatcgcgactaacgatatcgaaagatacgtcgaaaaatcaagttgtattaaaagttacgaatatggatccggcggatacggcgacgtattattgtgcgcgatcgatgataacgaattggtattttgatgtttggggtgcgggtacgacggtaacggtttcgtcggcgtcgacgaaaggtccgtcggtatttccgttagcgccgtcgtcgaaatcgacgtcgggtggtacggcggcgctaggttgtctagtaaaagattattttccggaaccggtaacggtttcgtggaattcgggtgcgctaacgtcgggtgtacatacgtttccggcggttttacaatcgtcgggtttatattcgctatcgtcggttgtaacggttccgtcgtcgtcgttaggtacgcaaacgtatatatgtaatgtaaatcataaaccgtcgaatacgaaagttgataaacgtgttgaaccgaaatcgtgtgataaaacgcatacgtgtccgccgtgtccggcgccggaactactaggtggtccgtcggtatttctatttccgccgaaaccgaaagatacgctaatgatatcgcgaacgccggaagtaacgtgtgtagttgttgatgtatcgcatgaagatccggaagtaaaatttaattggtatgtagatggtgtagaagtacataatgcgaaaacgaaaccgcgtgaagaacaatataattcgacgtatcgtgttgtatcggtactaacggttttacatcaagattggttaaatggtaaagaatataaatgtaaagtttcgaataaagcgctaccggcgccgatagaaaaaacgatatcgaaagcgaaaggtcaaccgcgtgaaccgcaagtttatacgttaccgccgtcgcgtgaagaaatgacgaaaaatcaagtttcgttaacgtgtttagttaaaggtttttatccgtcggatatagcggtagaatgggaatcgaatggtcaaccggaaaataattataaaacgacgccgccggtattagattcggatggttcgttttttctatattcgaaactaacggttgataaatcgcgatggcaacaaggtaatgttttttcgtgttcggttatgcatgaagcgttacataatcattatacgcaaaaatcgttatcgctatcgccgggtaaa

SEQ ID NO: 15894 - DNA, 1422 bp, Artificial Sequence
  Description of Artificial Sequence: Synthetic coding sequence
atggcagtgatggccccccgaactctcgtattactcctctctggggccttggccctgacccagacctgggcccaggtcaccctgcgggaatctggtccagcactcgtgaagcccactcagaccctgacattaacatgtactttctcggggttcagcctgtccaccagcggaatgagtgtcggatggatccgccagcctccgggtaaggccctggagtggctcgccgatatctggtgggatgataaaaaagactataaccctagcttgaaatctaggcttactatctctaaagatacaagcaaaaaccaggttgtgctgaaggttacaaacatggatcccgccgatacggccacctactattgtgcccggagtatgattacgaactggtatttcgacgtgtggggagcagggacaacagtcacagtcagctctgcaagcacgaaaggtccgagcgtgtttcccctggccccctcttcgaagtctacgagcggcgggacagcagctctcggctgcctggtgaaggattatttccccgaacccgttactgtatcctggaatagtggagctttgacatctggcgttcatactttcccagccgtgctgcaaagctccggtctctacagcttaagttcagtcgttaccgtcccttcatcatcactggggacgcagacatatatctgcaatgtgaatcataaaccctccaacactaaggtggacaaaagggttgagcctaagtcttgtgataaaacgcacacgtgtccaccctgtcctgcccccgaactgctcggtggtccatccgtttttctgtttccaccaaaacctaaggacaccctgatgatcagcaggacccctgaggttacttgtgtcgtggtggacgtgagccacgaggaccctgaggtgaagttcaattggtatgttgatggagtcgaagttcacaacgctaagaccaagccccgagaagaacagtacaactcgacttatagggtggtgagcgtcttgacggtgctgcaccaagactggttgaacggaaaagaatataaatgcaaagtctcaaacaaagccctgcccgccccgattgagaaaaccatttcgaaggccaaaggacagccgagagaaccgcaggtgtatacactgccaccatccagggaagagatgacaaaaaaccaggtgtctctgacctgtttggtcaaaggattctatccttccgacatagccgtggaatgggagtccaatggccaaccagagaataattataagaccaccccccccgtgctcgatagcgacggtagtttttttctgtacagcaaattaaccgtcgacaagtcccggtggcagcaagggaacgtgttttcatgcagcgtgatgcatgaggccctccacaaccattatacccagaagagcctctccttgagtccgggaaag

SEQ ID NO: 15895 - DNA, 1422 bp, Artificial Sequence
  Description of Artificial Sequence: Synthetic coding sequence
atggctgttatggcacctagaaccctcgtgttgcttttgtctggggcactcgcccttacacagacatgggctcaagtgacccttcgggagagcggcccagccttggtcaagcctacccagactctcactttgacctgtaccttcagcggcttcagtttatccacctctggtatgtcggtcggatggatccgccagccacctggcaaggcgctggagtggctggctgatatttggtgggacgataaaaaagactacaatccgtccctcaaatcccggctcactatttccaaggacacaagtaaaaatcaggtcgtactcaaagtgacaaacatggatccagctgacaccgccacctactattgcgcccggtccatgatcacaaactggtacttcgacgtctggggcgcaggtacaacggtgaccgtgagtagcgcttccaccaaaggaccttccgtgtttcccctggctcctagtagtaagtcgacgagcggtggcaccgccgcactaggctgcctcgtgaaagattatttccctgagcccgttactgtttcctggaactctggcgctctgacctccggggtacacacatttccggcagtgttgcagtctagcggcctctacagtctctcaagcgtcgtcacagtccccagctcatctctaggcacccaaacatatatttgtaacgtcaatcacaaaccttctaacaccaaagtcgacaagcgtgtggagcctaaaagttgcgacaaaacccatacctgtcctccatgtcccgcaccagaactgctgggggggcctagtgtatttctgttcccccccaaacctaaggacacactaatgatcagtcgcacccctgaggttacatgcgtggttgtagatgtgagtcacgaggacccagaggtgaagttcaattggtacgtggatggcgtagaagtccataacgcgaagactaagccaagagaggaacaatacaatagcacttacagggtggtctccgtacttacagtgctgcaccaggattggctgaacgggaaggagtataagtgcaaagtaagtaataaagctctgcctgctcccatagagaagactatttcgaaggctaagggtcagcctagggaaccccaggtttacactctcccaccctcacgcgaggagatgactaagaaccaggtttctttgacttgcctcgtgaagggtttctaccccagcgatatcgctgttgagtgggaaagtaatggccaacctgagaacaactataagaccacccccccagtgctcgatagcgatgggagcttttttctgtacagtaagctcactgttgacaaatcacggtggcaacaggggaacgtcttctcatgctctgtaatgcacgaggctcttcataaccactatacacagaaatccctgtcgctgagcccaggaaaa

SEQ ID NO: 15896 - DNA, 1422 bp, Artificial Sequence
  Description of Artificial Sequence: Synthetic coding sequence
atggccgtcatggcacccaggactcttgtgctgcttcttagcggtgccctggccctcactcaaacttgggctcaggtaactttgcgtgaatcgggtccagcgctcgtcaagccaacccaaactctgactctgacctgcacgtttagcgggttctcgctgtcaacttccggaatgtccgtgggttggattcgacagccaccaggaaaagcgctggagtggcttgcagatatttggtgggacgacaagaaagactataaccccagccttaaatcgcgactgactatttccaaggataccagcaaaaaccaggtggtcttgaaagtgactaatatggacccagccgacactgccacttactactgcgctcgctcgatgattacgaattggtactttgacgtgtggggcgcgggaaccaccgtgaccgtgtcgtccgcaagcaccaagggacctagcgtgtttccactggctccgtcctcaaaatccacgtcagggggcactgcagcactggggtgtctggtcaaggactactttccagagccagtcaccgtgtcatggaattcgggagcccttactagcggcgtgcacacctttccagcggtcctccagagcagtggtctgtactccctgtcgtcagtggtgaccgtcccctcgtcatccctgggtacgcaaacttacatttgtaatgtgaatcataagcctagcaacactaaggtcgataagcgtgtggagcctaagtcgtgcgacaagactcatacctgtcccccttgcccagcgcctgaactgctcggtggtccaagcgtgtttcttttccctccaaagcctaaggatactttgatgatatcgagaaccccggaagtgacctgcgtcgtggtggatgtctcccatgaggaccctgaggtgaagttcaactggtacgtggatggagtggaagtgcacaatgccaagaccaaacctagagaagagcaatacaactcaacttacagagtggtttccgtccttaccgtgctgcatcaggattggcttaacggcaaggagtataagtgtaaagtctccaacaaagcactccctgctccgattgaaaaaacgatctcaaaggcaaaggggcaaccccgggagccgcaggtgtacactttgcctccatccagggaagaaatgactaaaaaccaggtatccctcacgtgcctggtcaaaggattctatccaagcgacattgctgtggaatgggagtcaaacggtcagcctgaaaacaactacaagaccaccccaccagtgcttgatagcgatggttcgttctttctttactcgaaactcaccgtggataaaagccgctggcagcagggtaatgtgttttcatgttccgtcatgcatgaagccctccacaatcattacacccaaaagtcgctgtccctgagccctggtaaa

SEQ ID NO: 15897 - DNA, 1422 bp, Artificial Sequence
  Description of Artificial Sequence: Synthetic coding sequence
atggccgtcatggcaccaagaacgctcgtcctgctgctgagcggggcgctcgctctgacccaaacatgggctcaggttacactgcgcgaaagcggtccggcgttggtcaagccaacccagaccttgacactgacctgtaccttttcaggattttctctaagcaccagcggtatgagcgtaggttggatccgccagccaccaggcaaagcactggagtggctggcggatatttggtgggatgataagaaggattacaacccttcactgaagagccgtttgaccattagcaaggataccagtaagaatcaggtggtgctgaaggttacaaatatggaccctgcagacacagctacctattactgcgcgcgctccatgattaccaactggtacttcgatgtctggggtgccggaactaccgtgactgtgtcttctgcgagcacgaagggtccatcggtgttcccgctagctccttctagcaaaagcacctcaggtggtacggcggcgctgggttgcctggttaaagattatttccctgagccagtcaccgtttcctggaactccggcgccctgacctctggagttcatacgttccctgctgtgcttcaaagcagcggcttgtacagcttgtcttccgtagttaccgtaccgagcagcagcctgggtacacagacctatatttgcaatgtgaatcacaagccaagcaacaccaaggtagacaagcgagtagagccgaaaagctgcgataaaacccacacctgtcccccttgtccggctcctgagctgctgggtggcccttctgtgtttctgttcccaccgaagccaaaggacaccctgatgattagccgcacgccggaggtgacttgcgtagtggtggacgttagccacgaggatcccgaagtcaagttcaattggtacgtggacggtgtcgaggtgcataacgcgaaaaccaagccacgcgaggagcaatataattcgacctatcgggtcgtgtctgttctcacggtcctgcatcaagattggctgaatggcaaggaatataagtgcaaagtttccaataaggcacttcctgcgcctatcgagaaaacgatcagcaaggcgaagggtcagccgcgcgagccgcaggtttacacactcccaccgagccgcgaggagatgacgaaaaatcaggttagccttacctgtttggtcaaaggtttctatccttccgacattgccgttgaatgggagtccaacggccagccagaaaacaattacaagaccaccccaccggtcctggatagcgacggttccttcttcctgtacagcaaactgacggtggataagagccgttggcaacagggaaatgtcttctcttgcagtgtcatgcatgaagccttgcacaatcattacacccagaaaagcctgtccctctctcccggtaaa

SEQ ID NO: 15898 - DNA, 1422 bp, Artificial Sequence
  Description of Artificial Sequence: Synthetic coding sequence
atggctgtcatggctccccgtactctggtgctgctgctgtcaggggcactagctctgacccagacctgggctcaggtgactctgagggaaagcggccccgctctcgtcaaacctacccagacactgaccctcacttgtaccttcagcggcttttcattatcaacctccgggatgagcgtcggctggataaggcagccccctggcaaagctctggagtggctagccgatatttggtgggacgataagaaagactataatcctagcctcaaatcaagactgacaatcagtaaagatacctctaaaaatcaggtcgtgctcaaggtgacaaatatggacccagctgacactgccacatattactgtgcccgatccatgatcacaaactggtacttcgacgtgtggggggccggtaccactgtgaccgtcagcagcgcttctactaaggggccaagcgtcttcccactagccccaagttccaagtccacatctggggggactgctgctctgggctgcctggtcaaggactattttcccgagccagtgactgtgtcttggaactcaggcgcactgacttctggagttcatacattccctgcagttctgcagtcctctggcctgtattcactgagctccgtcgtgacagtgccctcctcttcactgggcacccagacctatatatgtaacgtgaaccacaaaccaagtaacaccaaagtggacaagagggtggaacccaaatcttgcgataaaactcatacttgtcccccttgtcctgctccagagctgctaggaggacctagtgtctttctcttccccccaaaacccaaagacacactgatgatatcccggacccctgaggttacatgcgtcgttgttgatgttagccatgaagaccccgaagtgaaatttaattggtacgtggacggcgtggaagtgcacaacgctaagacaaagcccagggaagaacagtataattcaacataccgggttgtatcagtacttaccgtgctgcaccaggattggcttaacggtaaagaatacaaatgtaaagtgtctaacaaggccctgcccgcccctatagaaaagacaatctcaaaggccaagggccagccaagagagcctcaagtttacactctgccaccatctcgagaagaaatgacaaagaatcaggtatctctgacctgcctggtgaagggcttctacccaagcgacatcgccgtggagtgggaatctaatggccaaccagaaaacaattacaaaaccaccccccccgtgctggactccgacggcagctttttcctgtatagcaagttgaccgtggataagtcccggtggcagcagggcaatgtgttctcttgcagtgtgatgcatgaggctctccacaaccattacacacagaaatctttgagcctgtccccagggaag

SEQ ID NO: 15899 - DNA, 1422 bp, Artificial Sequence
  Description of Artificial Sequence: Synthetic coding sequence
atggccgtgatggctcctcgaacgctcgtgttgctgctaagtggtgccttagcactaacccaaacctgggctcaggtgacgctccgcgaatcagggccagctctggtaaaaccaactcaaactttgacactaacatgtacattctccggcttcagccttagcacctccgggatgtccgtgggctggattaggcagccgcctggaaaagccctcgagtggctggctgatatctggtgggatgacaaaaaagactataatcccagtctgaagagtcgtctcaccatcagcaaagacacctccaagaatcaggtggtgctcaaagttacaaatatggacccggctgatactgccacctattactgcgcccgttctatgatcacaaactggtattttgacgtgtggggggccggcaccaccgtgaccgtgagttccgcctccactaaggggccttctgtttttccgctggcacccagctctaaatcaacaagtggggggacggccgcactgggatgtctggtaaaagattactttccggaacccgtaacagtgtcgtggaactcgggcgcccttactagcggcgtgcatacgttccccgcagttttgcaatcctctgggctgtattctctcagctccgtcgttacggtgccatcttcgagtctcggaacgcaaacgtacatctgtaacgtgaaccataaacctagcaataccaaggttgataaaagagtcgaaccaaagtcatgcgacaagacccatacctgccccccctgccccgccccagagctgttgggggggccatccgtgtttttgttccccccgaagccgaaagacactctcatgatctcaaggaccccggaggtgacctgcgttgttgtggacgtttcccatgaagatccagaagttaagttcaactggtatgttgacggggtggaggtgcacaatgctaaaaccaagcctcgggaggaacagtataatagcacctaccgcgtcgtgtcggttctgacggtgctgcaccaggactggcttaacgggaaagaatataaatgtaaagtaagcaataaagccctgccagctcctatagaaaagactatcagcaaagctaaaggacagccgagggagccacaggtctacaccttgccgcctagcagggaggaaatgaccaaaaaccaggtgagcctgacttgcctcgtaaaggggttctacccatccgatattgcagtggaatgggaatccaacgggcagcctgagaataactacaaaacaactcccccggttttagactctgatgggagcttctttctgtattccaaactgacagttgacaagtccagatggcagcagggaaacgtcttctcttgctcagtcatgcacgaagctttgcacaaccactacacacagaaatcactgagcttgtcccccggaaag

SEQ ID NO: 15900 - DNA, 1422 bp, Artificial Sequence
  Description of Artificial Sequence: Synthetic coding sequence
atggcggtgatggcgcctaggaccctcgtattattgctcagcggagctttggccctcacccagacatgggcgcaggtcacgctgagagagagcggcccggctctggtcaaacccacccagacgctgactctgacttgtacgttctctgggtttagcttaagcacatccggcatgagcgtgggatggattcggcagcctcccggaaaagccctcgaatggttggccgacatttggtgggacgataagaaggactataacccatcattgaagagccgtcttaccatatccaaagatacaagtaagaatcaggtggtcctaaaagtcactaatatggatccggcagatacggccacttattattgtgccaggagcatgattaccaattggtacttcgatgtttggggtgccgggactacagtcactgtgtcaagcgccagcactaagggtccctctgtttttcctttagccccatcaagcaaatccactagcggtggcaccgcggctttagggtgcctcgtcaaagactactttccagaaccagtcacggtgagctggaactccggtgccttaacatccggtgtacacactttcccagccgttttgcagtcctccgggctctattctctgtccagcgtcgtgactgtcccctcaagtagcctcggtactcagacttacatctgcaacgtcaatcacaagcctagcaacaccaaggtggacaagcgcgtggagcctaagtcgtgtgataaaacacacacgtgcccaccctgccccgcgcctgaacttctcggtggcccctccgtgtttctctttccacctaaacccaaggacacccttatgattagtcggacgcccgaagttacatgcgtggtggttgatgtgagccatgaagatcctgaagtgaaattcaactggtacgtggacggagtggaagtacataacgccaaaacaaagcctcgggaagaacagtacaattctacataccgtgtcgtcagtgtgctgacagtgttgcaccaggactggctgaatggcaaagagtacaaatgtaaggtgagcaataaggcccttccagctccaatcgaaaagacaatcagtaaggccaaaggccagcctcgagagcctcaggtttatacccttcccccttcccgcgaggaaatgacgaagaaccaggtgtcactcacctgcctggttaaggggttctatccaagcgacatagcagtcgagtgggagtccaatggccagcctgagaacaactacaagaccaccccgccagtattagatagcgatggtagcttcttcctgtattccaagcttactgtggataaatcccgctggcagcagggtaatgttttttcatgttccgtaatgcacgaggctctgcataaccattatacacagaagagtctgagcctgtcccccggtaaa

SEQ ID NO: 15901 - DNA, 1422 bp, Artificial Sequence
  Description of Artificial Sequence: Synthetic coding sequence
atggcagtgatggcccctcggaccctggttctgctgctctccggtgccctcgccctcacccagacctgggctcaggttacactgagagagtcagggcccgccttggtcaaaccgactcagacgcttacgcttacctgtactttcagcggtttcagcttgtctacgagtggcatgagcgtgggatggattcgacagccgcctggcaaggctctggagtggctagccgatatatggtgggacgacaagaaggattacaatccttcgttgaaaagtagactcaccattagcaaagacacttccaaaaatcaagtggttcttaaagtgaccaatatggacccggccgatacagctacgtactattgtgcccggtccatgatcactaattggtactttgacgtttggggcgccgggactacagttaccgtgtcctctgcttcaacgaaagggccgtcagtgtttccattggctcccagcagtaagtcaacctctggcggaacggctgctctgggctgtctggttaaggattactttcctgagcccgttacggtcagctggaattcaggcgccttgacttccggggtccatactttccccgctgttctccagagtagcgggttgtactctctaagctccgtggtgaccgtacccagctcctccctaggtacccaaacatatatctgcaacgttaaccacaaaccctccaatacaaaggtagataaaagagtcgagcccaagagctgtgacaagacccacacatgccccccttgtcccgcaccagagctgctcggtggtccctcagtgttcctcttcccgcccaagcccaaggacaccctgatgatctctcgaaccccagaagtcacatgtgtggtggtggatgtctctcacgaggaccctgaagttaaattcaactggtacgtggacggtgtggaggtccataacgcgaagaccaagccgcgcgaagaacagtacaattcaacctaccgggtggtgtctgtcctcacagtcttacatcaagactggctgaacggcaaagaatacaaatgcaaggtgtccaataaggccctgcccgctccaatcgaaaagaccatcagcaaggcaaagggacagcctcgggaaccccaggtctataccctccctccttcacgtgaggagatgaccaagaaccaggtcagtctgacctgcctggtcaagggattctacccgagcgatatcgcggtcgagtgggaatccaatggtcagccagagaacaactataagaccacgccgcctgtgctagactccgacgggtcattctttctgtattccaagttgacagtcgataagagccggtggcagcagggaaatgtgttcagctgctctgtgatgcatgaggccctgcacaaccattacacacaaaaatccctctccttgtctccgggtaag

SEQ ID NO: 15902 - DNA, 1422 bp, Artificial Sequence
  Description of Artificial Sequence: Synthetic coding sequence
atggccgtgatggccccccggaccttggtgctgttactatccggtgccctagccttgacccaaacctgggctcaggtcaccttaagagagagcggacctgccttagtgaagcctacccagaccctcactctgacttgcacattcagcggcttcagtctgtccacttcaggaatgtcagttggctggatccggcagccacctgggaaagccttggaatggctcgctgatatttggtgggatgataagaaagactacaacccctctcttaagagccgtctgaccattagcaaagacacttccaaaaaccaggtcgttcttaaggtgaccaatatggaccctgcagacaccgcaacatattactgtgcccggtctatgataacaaactggtattttgatgtgtggggagccgggaccactgtgacagtgtcctcggcaagcacaaagggcccttcggtcttccctcttgccccaagctcgaaatccacctcaggtggaacagctgcgctgggatgcttggtcaaagactattttccagagccagttacggtgtcctggaactctggtgccttgacctctggcgtgcatacattccctgcagtactgcaatcatctggtctgtacagcctgtcttccgtcgtgaccgtacccagcagctcactagggacacagacctacatttgtaatgtaaaccataaaccttctaataccaaggtggataagagggtcgaaccaaaaagttgtgataagacacacacatgtcccccttgcccagcaccagaactgttgggtgggccttctgtttttctgttcccgcccaagccaaaagataccctgatgattagcagaacacccgaggtgacttgcgttgtggtggacgtgtcccatgaggaccctgaggtgaagtttaattggtacgtcgacggagtggaggtacataatgcgaagaccaagcccagggaggaacagtacaactctacctaccgagtggtcagtgttctgacagtgctgcatcaggactggttaaatggaaaagagtacaagtgcaaggtgtcaaataaggctctgccggccccgatcgaaaaaaccatctctaaggccaaaggtcagcctagggagccccaggtgtatacactcccgccctctcgagaagagatgaccaaaaatcaggtgtcgttgacttgtctggtcaagggattctatccgagcgacattgccgtcgagtgggaatcgaatggccagcccgaaaacaattacaaaactaccccccctgtcttggattcagatggatctttctttttatactcgaaacttaccgttgacaaatcacgatggcagcagggcaatgttttctcatgctccgtaatgcacgaagcacttcacaatcattacacacagaaatccctcagtctctctcctggaaaa

SEQ ID NO: 15903 - DNA, 1422 bp, Artificial Sequence
  Description of Artificial Sequence: Synthetic coding sequence
atggctgtcatggcaccgcggaccctggtccttctgctgtccggagcactggcacttactcaaacttgggcacaggtcacccttcgggaatccggaccagcactggtcaaaccaactcagaccctgaccctcacctgcacctttagcggtttctccctgtcgacctcgggaatgtccgtcggatggatacgccagccaccaggtaaggcactggagtggctggctgatatttggtgggacgataagaaagattacaacccatccctgaagtcaaggcttactatttcaaaggatacttccaaaaaccaggtggtgcttaaggtgactaatatggatcctgcagatactgcaacctattactgtgcaaggtcgatgatcactaattggtacttcgatgtctggggagcaggtaccaccgtgactgtgtcatccgcctctacgaaaggtccctccgtgtttccacttgcaccttcaagcaagtccacttcgggaggaacggcggcccttggttgcctcgtgaaggattacttccctgaacctgtgactgtgagctggaactcaggcgcccttacttcgggagtccatacttttccagctgtgctccagagctcgggactttactcacttagcagcgtggtgacggtcccttcaagctcactcggtactcagacttacatttgcaatgtgaaccacaagccttcaaacaccaaagttgacaaaagagttgagcccaagtcgtgcgataagacgcatacctgcccaccttgtcctgcacctgaacttctggggggacccagtgttttcttgtttcccccaaagcctaaagataccctcatgatctcaaggactccggaggtgacttgtgtcgtggtggatgtttcacatgaagatcctgaagtgaagtttaactggtacgtggacggagtcgaggtgcataacgcaaagactaaaccaagagaagaacaatacaattccacctaccgagtcgtcagcgttctgacggtgctgcaccaagactggttgaatggaaaagaatacaaatgcaaggtgagcaacaaagcattgcccgcgcctatcgaaaagactatctcgaaggcgaaaggtcagccgagagagcctcaggtgtacactcttccacctagcagggaagaaatgactaagaaccaagtgtcgcttacctgtctggtgaaaggattctacccatccgatattgccgtggaatgggaatcaaatggacagccagagaataactacaagactactccacctgtcctggattcggatggctcctttttcctgtactcaaagttgacggtggataagtcccgctggcagcagggaaatgtgttttcgtgtagcgtcatgcacgaggccctccataaccattacacccagaagagcctttccctgtcgcctggcaaa

SEQ ID NO: 15904 - DNA, 1422 bp, Artificial Sequence
  Description of Artificial Sequence: Synthetic coding sequence
atggcggtgatggcacctagaaccctcgttctcctccttagcggggccctggcacttacccaaacttgggctcaggtgactctgagagaatccgggccggcccttgtgaagccaacccagaccctgaccctgacctgtactttttccgggttctccctctccacctcggggatgtcggtgggatggattaggcaacctcctggcaaggcacttgaatggcttgcagacatctggtgggatgacaagaaggattacaacccttcgcttaaatctcgcttgaccatcagcaaggatacttctaagaatcaggtcgtgctgaaagtcacgaatatggatcccgcagataccgcaacttactattgtgcaaggtccatgatcaccaattggtactttgacgtgtggggagcaggtactacggtgaccgtctcttcagcttcaacgaaagggcctagcgtgttccctcttgcaccatcaagcaagtcaacctccggaggaactgccgcactgggttgtctcgtgaaggactactttccggaaccagtgacggtgtcctggaactccggtgcactgacctcgggagtccatacctttcctgccgtgctgcagtcctcgggattgtacagcctgtcgtccgtggtcaccgtgccatcctcttcccttgggacccagacctacatttgcaacgtgaatcataaaccgtccaacaccaaggtcgataagcgcgttgagccgaagtcctgtgataagactcatacctgcccgccctgtcctgcccccgaattgcttggaggaccttcagtgtttctgtttccaccaaaacctaaggataccctcatgatttcgcgtaccccggaagtgacctgcgtggtcgtcgatgtgtcacacgaagatcctgaggtgaagtttaactggtacgtggatggagtcgaagtgcataacgccaagactaagccccgggaagaacagtacaactccacttaccgggtggtcagcgtcctgactgtgctgcatcaagattggcttaacggtaaggaatacaagtgtaaagtttcgaacaaggccctgcctgctcctattgagaaaactatttctaaggcaaagggacagccaagggaacctcaagtgtacacccttcccccatcccgggaggagatgactaaaaaccaggtatccctgacgtgcctggtcaagggtttctacccctcggatattgcagtcgagtgggagtccaatggacaacctgaaaacaactataagaccacccctccagtgcttgattccgacggttcgttcttcctttacagcaagctgactgtcgataagtcccgctggcaacaaggaaacgtgttctcctgtagcgtcatgcacgaagcgctccataaccactacacccaaaagtcgctgtccctctcccccggaaag

SEQ ID NO: 15905 - DNA, 1422 bp, Artificial Sequence
  Description of Artificial Sequence: Synthetic coding sequence
atggctgtgatggccccccgaactctagtactgttgctgagcggcgctctggccttaacccagacctgggcgcaggtgacactgcgcgagtcaggtcccgccttggttaaacctactcaaactctcactcttacatgcaccttttccggattctcactgagcactagtgggatgagcgttggttggattcgacagcctcccggcaaggccctggaatggctagcggatatctggtgggatgataaaaaagattacaaccccagtctgaaaagcagactgacaatcagcaaagacaccagtaagaatcaggtcgtgctgaaagtgaccaatatggaccccgccgacactgcgacctactactgtgctcgctcaatgatcacgaattggtatttcgatgtgtggggcgccggcacgacagtcactgtcagctcggcctcgaccaaggggccgtcagtgttccctttggcaccctcttctaagagcacttccggaggcacagctgcactgggctgtttagtgaaggactacttccctgagcctgtcaccgtctcctggaattctggggccctcaccagcggcgttcacacttttcctgcagtccttcagtcgtcaggtttatactcgctgtcttctgtggtcacagtgccctcttcctcactgggaacacaaacttatatctgcaatgtgaaccataaacccagcaacaccaaggtggacaagagagtggagcccaagagttgtgacaaaactcacacatgtcctccctgccctgctccagagctactcggcggcccatctgtattcctattccctccaaaacctaaagataccctgatgatttctagaactccagaagtgacctgcgtggtggtggatgtctcccacgaggatccagaggttaagtttaattggtatgtcgacggggtggaagtgcacaatgccaaaacaaagccccgggaggaacagtataattctacctatagggtagtatctgttcttacagtgctgcatcaagattggcttaatgggaaggagtacaaatgcaaagttagcaacaaagctctgcctgcacccattgagaaaactatctcaaaggccaagggacagcctagagaaccccaggtctatactctgccgccatcccgggaggagatgacaaaaaaccaggtgtctttgacatgcctggtgaagggtttctatccgagcgacattgctgttgagtgggagtcaaatggccaacccgagaacaactataaaaccaccccccccgtgcttgactccgatggctccttctttctgtattctaaactcacagttgataagtcgaggtggcagcagggcaacgtattcagttgcagcgttatgcacgaagcgctacacaaccactatacacagaaatccctatctctaagtccagggaaa

SEQ ID NO: 15906 - DNA, 1422 bp, Artificial Sequence
  Description of Artificial Sequence: Synthetic coding sequence
atggcagtcatggccccgcgcaccctcgtgctgctgctctcaggagcacttgccctgacccagacttgggcacaggtgaccctcagggagtcaggaccggcgctggtcaaaccgactcagacgcttaccctgacttgtactttctccggcttctctctgtctacttcgggaatgtcagtcggatggattcggcaacctccgggcaaggcgctcgagtggttggctgatatctggtgggatgacaagaaagactacaacccgtccctgaaatccagactgactatctcaaaagacacctcgaagaatcaggtcgtgttgaaggtgactaacatggatccggctgacaccgccacctactactgcgcgaggtcgatgatcaccaactggtacttcgacgtgtggggtgccggaactactgtgactgtgtcatcggcaagcactaagggaccgtcggtgtttccgctggcgccaagctcgaaaagcacctccggcggaactgcggccctgggatgcctggttaaggattacttcccggagccggtcaccgtcagctggaactcgggagccctcacctccggggtgcatacctttccggcggtcctccagtcaagcggcctctactcgctctcctcggtggtgaccgttccgtccagctcgctcggtacccagacctacatctgcaacgtcaatcacaagccatcgaacactaaagttgacaagagagtggaacctaagtcctgcgacaaaacccatacttgtccgccgtgccctgccccggagctcctgggaggacctagcgtatttcttttcccgccaaaacccaaagatactctgatgatttcacgcactcctgaggtgacctgcgtggtcgttgacgtgagccatgaagacccggaggtcaagttcaattggtatgtggacggagtcgaagttcataatgccaagactaagcctagagaggaacagtataattcaacttacagagtggtgtcggtcctgactgttcttcatcaggactggcttaacggaaaagaatacaagtgtaaagtgagcaataaggcattgcccgccccgatcgagaagaccatcagcaaggcaaagggacagccgcgagagccacaggtctacactctcccgccttcccgcgaggaaatgactaagaatcaggtgtcgctgacttgcctggtgaagggattctatccttcggatatcgctgtggaatgggaaagtaacggccaacctgaaaataactacaagaccaccccaccggttctcgattccgatggctcgttcttcctttacagcaagctgaccgtcgacaagtctcggtggcaacagggaaacgtgttctcctgctccgttatgcacgaagccttgcacaatcattatactcaaaagtccctcagcctgagccccgggaaa

SEQ ID NO: 15907 - DNA, 1422 bp, Artificial Sequence
  Description of Artificial Sequence: Synthetic coding sequence
atggcagtaatggcgcctcgcaccctcgtgctccttcttagcggtgcactggctcttactcagacgtgggctcaggtcaccttgagagagtcggggccggcgctagtcaagcccacccagactctgacactcacatgcactttttccgggttttccctctctacatctggcatgtctgtaggctggatacggcagccccctgggaaagcccttgaatggctagccgacatctggtgggatgataaaaaggattataatccgtcactcaagagtcggctgactatcagcaaagacacctctaaaaatcaggtggtgctgaaagtgaccaatatggacccagctgatactgccacatactattgcgctagaagcatgatcacaaactggtatttcgacgtgtggggggctggcaccactgtgacagtgtcgtcagcatcaaccaagggcccaagtgtgtttccattagctccctcaagcaaatccacaagtgggggtacggctgcgctcgggtgcttggtaaaggactacttccccgaaccagttaccgtttcttggaactctggggcactcactagtggggtgcataccttccccgctgtgttgcagtcctccggcctctatagcttgtctagtgtcgtcacggtaccctcatcctccctgggcacccagacctacatttgtaatgtgaaccacaaaccatcaaataccaaggtcgataaacgagtcgagccaaaatcttgcgataagacacatacttgtccgccttgtccagctcctgaactcctgggaggccccagcgtgtttctgttccctccgaaacccaaggataccctcatgatctccaggacgccagaggtcacatgtgtggtggtagacgtcagtcacgaagatccagaggtaaagttcaattggtacgttgatggagtggaagttcataacgctaaaactaagccccgggaagaacagtacaacagtacttacagagtggtctccgtcctgactgttctgcatcaggactggctcaacggtaaggagtataaatgcaaagtgagcaacaaggcactgcccgcgccaatagagaaaacgatctcaaaagccaaaggtcagcccagagaaccacaagtctataccctgcccccctcccgagaggaaatgaccaaaaaccaagtttctcttacgtgtctggtgaagggattctacccctcagacattgctgttgagtgggagtccaacggacagcctgagaacaactacaaaacaacgccgccggttctggactcagacggcagttttttcctctactccaagctgaccgtggataaaagcagatggcagcagggcaatgtgttttcatgttccgtgatgcatgaggctttgcacaaccattacacgcagaaaagtctatccctctcgcctgggaag

SEQ ID NO: 15908 - DNA, 1422 bp, Artificial Sequence; identical to SEQ ID NO: 15869
  Description of Artificial Sequence: Synthetic coding sequence

SEQ ID NO: 15909 - DNA, 1422 bp, Artificial Sequence
  Description of Artificial Sequence: Synthetic coding sequence
atggcggtcatggccccgcggactcttgtgctgctcttgtctggagcgctggcgttgacccagacctgggcgcaggtgactcttagagaatcggggcctgccctggtgaaaccgacccaaaccctcactctgacttgcaccttctccgggttcagcctgagcacgtcgggtatgtccgtgggatggatacgccagccgccaggtaaagctctggagtggctggctgacatctggtgggatgataagaaggattacaatccttcgctcaaatccaggctgactatctcgaaagacacttcgaaaaaccaggttgtgttgaaggtgacgaacatggatcctgctgacacggccacctactattgtgcgcggtcgatgattaccaactggtactttgatgtgtggggagcggggactacggtcaccgtctcttccgcgtcaaccaagggccctagcgtgttcccacttgctccgagctcaaaaagcacttccggtggaactgccgccctgggttgcctggtcaaggattacttccccgagcctgttaccgtgtcctggaatagcggtgcactgacttctggagtgcacacgtttccggctgtgctgcagtcctccggactttactcgctctccagcgtcgtgactgtcccctcatcctccctgggaacccaaacttacatctgtaacgttaaccataagccgtcaaataccaaagtggacaagcgcgtggagccaaagagctgcgacaaaactcacacctgccctccttgcccagcgccagaactgctgggaggcccatcggtgttcctgtttccgccgaaaccgaaggacaccctgatgatttcgaggactccagaggtgacctgcgtggtcgtggacgtctcacatgaagatccggaagtgaagttcaattggtacgtggacggtgtggaagtgcacaacgccaaaacgaaaccgagagaggagcagtacaactcaacctaccgcgtggtcagcgtgctgactgtgttgcaccaggactggttgaacggtaaggagtacaagtgcaaagtctccaacaaagcactgccagccccgatcgaaaagactattagcaaggctaagggacagccgcgggaaccacaagtgtacaccttgccgccatcacgggaggaaatgaccaagaaccaagtctctctgacttgtctggtgaagggattctacccgtctgatatcgcggtggaatgggaatcaaacggacagccagaaaacaattacaagaccaccccacctgtcctggacagcgacggatccttcttcctgtactcgaagctgaccgtcgacaagtcacgttggcagcaggggaacgtcttttcatgctccgtgatgcatgaagcacttcacaaccactacacccaaaagtccctgtcgctctcaccgggaaag

SEQ ID NO: 15910 - DNA, 1422 bp, Artificial Sequence
  Description of Artificial Sequence: Synthetic coding sequence
atggccgtcatggcaccaaggaccttggtgctcctccttagcggtgccctcgcactgacccaaacttgggctcaggtgacccttcgggagtccggcccggctctggtcaagcctactcagaccctcactctcacgtgcaccttcagcggattttcactttcgacctcgggcatgagcgtgggatggattagacagcctcccggaaaagcgctcgagtggcttgcagatatttggtgggatgataagaaagattacaaccccagcctgaagagcaggctgaccatctcgaaggatacttcgaagaaccaggtggtgctcaaggtgactaatatggatccagccgacactgcaacctactactgtgcaagatcgatgatcaccaattggtacttcgacgtgtggggagcgggtactaccgtcactgtgtcgtcggcatcgactaagggaccttcggtgttccctctcgcaccaagcagcaaaagcacctccggcgggaccgcagccttgggttgtctggttaaagattactttcccgaaccagtcaccgtctcgtggaactcaggtgccttgacctccggtgtgcatacttttccagcagtgctccagtcgtcgggactgtactcactttccagcgtggtgaccgtgccttcttcctcgctcggtactcagacgtacatctgtaacgtgaaccacaaaccatccaacacgaaggtggataagagagtcgaaccaaagtcctgtgacaagactcatacctgcccaccatgtcctgccccagaactccttggtggtcctagtgtgtttctgttcccgccaaaacctaaagataccttgatgatatcccgaacccccgaggtgacctgcgtcgtcgtcgacgtctcccatgaggaccccgaagtgaaattcaattggtacgtggatggcgtcgaggtccacaacgcaaaaactaagcctcgagaggaacaatacaactcaacctaccgagtggtgtccgtgcttaccgtgctccaccaggactggctgaacggaaaggaatacaagtgtaaggtgtcaaacaaagcgctgccagcgcccatcgaaaagacgatttcgaaggcaaaaggccagccccgggaaccacaagtttatacgcttccaccatcccgggaggagatgactaagaatcaagtctcgctgacttgcctggtcaaaggattctacccttccgacatcgcagttgaatgggagtcgaatggacaaccagagaataactacaaaacgactcctcctgtcttggattccgatggatcgtttttcctttactccaaactgaccgttgacaagtcccgatggcagcaaggaaatgttttttcatgctccgtgatgcacgaagcacttcacaaccactacactcaaaagtcactgtcgctgtcgccaggaaaa

SEQ ID NO: 15911 - DNA, 1422 bp, Artificial Sequence
  Description of Artificial Sequence: Synthetic coding sequence
atggctgtcatggcacccaggacccttgtactgttgttgagcggtgctttggctttgactcaaacctgggcgcaggtgaccctgagggaatccggccctgccctcgtaaagcctactcagactctcaccctgacttgtacattcagcggtttctcactcagcacttccggtatgtccgtgggctggatccgccagcctccgggtaaggcactggagtggctggccgatatttggtgggacgacaagaaagattacaacccgtcactcaaaagtcgcctgaccatctccaaggacacctccaagaatcaagttgtcctcaaggtgacaaacatggatcccgcagacactgctacttactattgcgcccgcagtatgatcaccaattggtacttcgatgtctggggcgctggcaccaccgtcacagtgagcagcgctagtactaaaggaccctcagtgttcccactggcaccctcaagcaagagcacgagcggcggcaccgctgctttgggatgtcttgtgaaagactatttccctgagcctgtaacagtgtcttggaacagtggtgccctgacatcaggtgtgcacacatttccagccgtgctccagtcctctggcctgtattcattgagttctgtggtgactgttccaagcagttctttgggtactcagacatacatctgcaacgttaatcataagcctagtaacacaaaggtcgataaaagggtggagcccaagagctgtgataagacgcatacatgccctccttgccctgcccccgagctgcttggtggtccaagtgtttttctgtttccccccaagccaaaggacacccttatgatcagcaggaccccagaggtcacctgcgtcgtggtcgacgtaagccatgaggatccagaggtgaagttcaactggtacgttgatggtgtcgaggtccacaacgccaaaacaaaaccaagagaggagcagtataacagtacatatagggtggtgtccgtcctcactgtgctgcatcaggactggctgaatggtaaggagtacaaatgtaaggtgtccaacaaggcgcttcctgctcctattgagaaaacaatctctaaggcaaagggccagccccgcgagccccaagtatacacactcccgcccagccgcgaagagatgaccaaaaaccaggtctctttgacatgccttgttaaaggattttacccttccgatatcgccgtcgaatgggagagcaatggccaacccgagaataattacaaaacgacaccccccgttctggatagcgacggttcattcttcctgtacagcaaacttacggttgacaaatcccgctggcaacagggtaacgtgttctcctgttctgttatgcacgaggccctgcacaaccattacacccagaagtccctctccttgtctcctggcaaa

SEQ ID NO: 15912 - DNA, 1422 bp, Artificial Sequence
  Description of Artificial Sequence: Synthetic coding sequence
atggccgtgatggcccctaggacactagtcttacttttgagtggggctttagctttgacacagacctgggctcaggtcactctgcgtgaaagcggtccagccctggtcaaacccacccaaaccctgacactcacctgtactttttccggcttcagcctctctactagcggtatgagcgtgggatggataaggcagcctcccggcaaggcgctggaatggttggcagatatttggtgggacgataagaaggactacaacccatccttgaagtcacgccttacaatcagtaaggataccagcaagaaccaggtggtcctgaaagtaacaaatatggaccctgcggacaccgccacgtactattgtgcacgctcgatgattaccaattggtattttgacgtgtggggcgccggcaccactgtgactgtctccagcgcctcaactaaaggcccttccgtgttcccactggcgccctcctcgaaatcgacctctgggggtacagccgcccttggatgcctggttaaggactacttccccgagcctgtcactgtgtcctggaacagtggtgctctgacatccggtgtgcatacgttcccagctgttctgcagagtagtggtctgtacagcttgagctcagtggtcactgttcccagttccagcctgggcacccagacctacatctgtaacgtgaaccacaaaccatcgaacacgaaagtggataagcgcgtcgagcctaagtcgtgcgacaagactcatacatgcccgccctgccctgctcccgaactgctgggcggtccttccgtgttcttatttcccccaaagccaaaggacacactcatgatcagcagaacacccgaggtgacctgtgttgtggttgatgtgtcccacgaagaccctgaagttaagtttaattggtacgtggatggcgtcgaggtccacaatgctaagaccaaaccacgggaggagcagtacaattccacatatcgagtggtgagcgttttgacagtgctgcatcaggactggcttaacggaaaagagtacaaatgcaaggtttccaacaaggccctgcccgccccaattgaaaaaaccatctctaaggcgaaagggcagcctagagaaccccaggtctacactttgccaccaagcagggaggagatgactaaaaaccaggtgagcctgacttgcttggttaagggtttttatccatccgacattgccgtggagtgggagtctaacggccagcctgaaaacaattacaaaacgacaccacccgtcctggattctgacggatccttcttcctctattccaagctgaccgtagacaaatctcggtggcaacagggtaatgtgttctcttgtagtgtgatgcacgaggcgcttcacaatcactacactcagaagtcactctccctatcgcccggcaag

SEQ ID NO: 15913 - DNA, 1422 bp, Artificial Sequence
  Description of Artificial Sequence: Synthetic coding sequence
atggcagtgatggctccaagaacactcgtgctcctactcagtggggccctagcactcactcagacatgggcacaggttactctgagagagtcggggcccgccctagtgaaacccactcagacgttaacactgacatgtactttctctggattctcactgagtacatccgggatgtctgtagggtggattcgccagcctcccggaaaagcgctggaatggctagcggatatctggtgggacgataagaaagattacaacccctctttgaaatccagactcactatatctaaagatacttctaaaaatcaggtggttctaaaagtcacaaatatggatccagccgacacagctacttattactgtgcaagatctatgattactaattggtatttcgatgtctggggggccggaactactgtgacagtttcttctgcctctactaaagggccctccgtttttcctctggccccttcctctaaaagtacatcagggggaacagcagctttagggtgtctagtcaaggattactttcccgaacctgtaacagtttcttggaatagtggagcccttacttccggggtacacactttcccggccgtgctccagagttctggactttattctttatcatccgtcgtaacagtaccatcttctagtctaggaactcaaacttatatatgtaacgtgaatcataaaccttctaacacaaaagtagataaacgggtggaacctaaatcttgtgacaaaacacacacgtgcccaccatgtcccgcccctgagctgctgggggggccttctgtatttctgttccctcccaagccaaaggatacactgatgatatcccgcactccagaagtgacatgcgtcgtagtcgatgttagtcatgaggatccagaagtgaaattcaattggtatgtggatggggtggaagtacacaatgccaaaactaagcctcgcgaagaacagtataacagtacataccgcgttgtttcagtgcttacagtcctccatcaggattggctaaacgggaaagagtataaatgcaaggtttctaacaaagccctccctgcccccatagaaaaaacaatttctaaagcaaagggacagccaagagaacctcaggtctatactctccctccatcccgcgaggagatgactaagaaccaggtgtcactgacttgcctggtcaagggattttacccctctgacatagcagtcgaatgggaaagtaacgggcagcctgaaaacaactacaaaacaacgcctcccgtacttgatagtgatgggtctttttttctctattctaagctaactgtagataaatcacggtggcagcaggggaatgtgttcagttgctctgtgatgcatgaggctttgcataaccactatacacagaaaagtctgtccttaagtcccgggaag

SEQ ID NO: 15914 - DNA, 1419 bp, Artificial Sequence
  Description of Artificial Sequence: Synthetic coding sequence
atggccgttatggccccgcgcaccttggtccttcttctctccggagcattggcgctgactcagacctgggccgaggtccagctggtggaatccggaggaggacttgtccagcccggcggatccctgcgcctctcgtgtgcagcatcggggttcaatatcaaagacacttacatccactgggtccggcaagccccaggcaaaggcctggagtgggtggcgcgcatctaccctaccaacggatatactcgctacgccgatagcgtgaagggaagattcaccatttctgccgatacctcaaagaataccgcgtatcttcagatgaactcccttcgggctgaggacactgcggtgtactactgcagcaggtggggtggggacggattttacgcgatggactactggggtcaaggcactcttgtcactgtatcatcggcttcgaccaaggggccatccgtattccctctggctccttcatcgaagagtacttccggcggaactgccgctctgggctgtcttgttaaggactacttcccggagcccgtgaccgtaagctggaactcgggtgcgctgacgagcggagtgcacaccttcccagccgtgctccaaagctcgggactgtactcactgtcgtcagtcgttactgtcccgtcatcctcgctgggaactcagacgtacatctgcaatgtcaatcacaagccatccaacaccaaagtggacaagaaggtggagccgaagagctgcgataagactcatacctgtccaccatgccccgcaccggaacttctcggcggtccgagtgtgttcctgttcccgcctaagccgaaggacacgctcatgataagcagaaccccggaagtgacctgcgtggtcgtcgacgtttcacacgaagatcccgaggtgaagttcaattggtacgtcgacggagtggaagtgcataacgctaaaaccaaaccgagagaggagcagtacaactcaacttaccgggtggtttccgtgctgactgtgctccaccaggactggctcaacggaaaagaatacaaatgcaaggtgagcaacaaggccctgccggcgcctattgaaaaaacgatcagcaaagctaagggccaaccccgcgaaccgcaggtgtacactcttccaccctccagggacgaactgaccaagaaccaagtctcgctgacctgcctcgttaagggattctatccatcagacatcgccgtggaatgggaatcgaacggtcaaccagagaacaattacaagacgacccctcctgtgttggattccgatgggtccttttttctgtactccaagctgactgtggataaaagccggtggcagcagggaaacgtcttttcgtgctcggtgatgcatgaagccctgcataatcactacacgcagaagtcgctcagtctgtcccctggc

SEQ ID NO: 15915 - DNA, 1419 bp, Artificial Sequence
  Description of Artificial Sequence: Synthetic coding sequence
atggctgtgatggccccgcggactctggtcctcctcctgtcaggcgcattggccctgacccaaacttgggccgaggtgcagttggtggaatcaggaggtggacttgtgcagccgggtggatcgttgcgcttgtcctgtgccgcctcgggcttcaacatcaaggacacctacatccattgggtgcgccaggccccgggaaaaggcctggagtgggtcgcacggatttacccaactaacgggtacaccagatacgccgactcggtgaaaggccggttcaccatcagcgccgacactagcaagaacactgcctacctccaaatgaactcgctgagagcggaggatactgcggtttactactgcagccgctggggaggcgatgggttttacgccatggattactggggacaaggcaccctggtgaccgtttcctcagcgtctaccaagggaccctcggtgttccctcttgccccgtcctccaagagcacttcaggtggtaccgcagctctcggatgcctcgtgaaagattacttcccggaaccagtcactgttagctggaactcaggagcgctgacctcgggcgtgcatactttccccgcggtgctgcagagcagcggactctacagcctgtccagcgtggtcaccgtgccctcctcgtccctgggaactcaaacttacatctgcaacgtgaatcataagccatcgaatactaaagtggataagaaggtcgaaccaaaatcctgcgacaagacccatacctgccctccgtgccccgcccctgaactcttgggaggtccgtcggtgttcttgtttccgcctaagccaaaggacactctgatgatcagccggacgccggaggttacctgcgtggtcgtggacgtatcgcacgaggatcctgaggttaagttcaattggtacgtggacggagtggaggtgcacaacgccaaaactaagccgagagaggagcagtacaactcgacctaccgggtggtgtcggtgctgactgttctccaccaagattggttgaatggcaaggaatacaagtgtaaagtcagcaataaagctctgccggcgccaatcgaaaagaccattagcaaggcgaaaggacagcctagagaacctcaagtgtacactctcccaccgtcgagggacgagctcactaagaaccaggtgagcttgacgtgtctggtgaagggattctacccgtccgacatcgctgtggagtgggagtccaacggccagccggaaaacaactacaagaccactcctccagtgttggactcagacggctccttcttcctctactcaaagttgaccgtcgacaagtcccggtggcaacagggaaacgtgttcagctgctcggtcatgcacgaagcgctgcacaaccactacactcagaagtcgctctcgctttccccagga

SEQ ID NO: 15916 - DNA, 1419 bp, Artificial Sequence
  Description of Artificial Sequence: Synthetic coding sequence
atggctgtgatggcccctcggacgcttgtcttgctgctgtccggtgcattagctcttacacagacatgggccgaggtccagctggtcgaatctggtgggggtctggtgcagcctggtgggtcattgcggttgagctgcgctgcgtctggctttaatattaaagatacatacattcattgggtcagacaggcacccggcaaagggctggaatgggtggcccgaatctaccctaccaacggatacactcgctatgctgattctgtaaagggaaggttcacgatttcagctgacacaagcaaaaacaccgcctacctgcagatgaactccttacgcgcagaggataccgcagtctattattgctctcggtggggcggagacggcttctatgcaatggattactggggtcagggtaccctcgttaccgtgtcgtccgcctcgacaaaaggtccgtccgtttttcccctcgccccatctagcaaatccactagtggagggactgctgccttaggatgcctggtgaaagattattttcctgaaccagtaacggtgagctggaactccggagcccttacatccggggtccatacttttcctgccgtgctgcaaagcagtggcctgtatagcttgtcttccgtcgtgacagtgccttcttccagcttagggacacagacttacatatgcaatgtgaaccacaagccctcgaacacaaaagttgacaaaaaggtggagcctaagtcctgcgataagacccacacctgtccgccatgtccagccccagagttactgggaggcccgagcgtgtttttgtttcccccaaagcccaaggatacgctcatgatcagccggactcccgaggtgacgtgcgtggtggttgatgtttctcacgaagatcctgaagtgaagttcaactggtatgttgatggcgttgaagttcataacgctaaaactaagccccgcgaggagcagtataatagtacctacagagtagtttcggtgctgacggttctacaccaagattggctaaatgggaaagagtacaaatgcaaagttagcaacaaggcgctgcctgctcccattgagaagactatctccaaagccaaggggcagccaagagaacctcaagtatacaccctgccaccttcgagagacgaactgaccaagaatcaggtaagcctcacttgtctggtaaagggattttatccgagcgatattgccgtggagtgggagagcaacgggcagcctgagaataactacaagaccactccaccagtgttggacagcgatggaagcttctttctgtatagtaagctgacggtggataagtctcggtggcaacagggaaatgtgttcagctgctcagtcatgcacgaggcgttgcacaatcactatacacagaaatctctgtccttgagcccaggc

SEQ ID NO: 15917 - DNA, 1419 bp, Artificial Sequence
  Description of Artificial Sequence: Synthetic coding sequence
atggctgtgatggcaccacggactctcgtccttcttctgagcggtgccctggcacttactcaaacctgggccgaagtgcagcttgtggaaagcggagggggtttggtgcaacctggtggatccctgcgcctgagctgcgcagcatcgggattcaacataaaggatacttacattcactgggtgagacaagctccggggaaaggtcttgaatgggttgcaaggatctatccgactaatgggtacactcggtacgccgactcggtgaagggccggtttaccatttcggcagatacctccaagaacactgcatacctgcaaatgaattcgcttcgggcagaagataccgcagtgtactactgttcgagatggggtggcgacggattttacgctatggattactggggtcaaggcaccctggtgactgtgtcctcagcctcaacgaaaggacctagcgtgttccctctggcgcctagctcgaagtcgacctccggaggcactgcagcactcggttgcctcgtgaaagattacttccctgagcccgtgactgtgtcttggaactcgggagctttgacgagcggagtccataccttccccgcagtccttcagtccagcggactttactcgctcagctcggtggtcaccgtgccaagcagctctctgggtactcagacgtacatctgtaacgtgaaccataagccttctaacactaaggtggataagaaggtggagcctaagtcctgtgataagacccatacctgccctccttgtccggcgccagaactgctcggtggaccatcagtctttctctttccacctaagcctaaagacactctgatgatatcacgaaccccagaggtgacttgcgtggtggtcgacgtctcacacgaagatccagaggtgaaattcaattggtacgtggacggggtggaagtccacaacgcaaaaaccaagccgcgagaagaacagtacaactcgacttaccgtgtggtgagcgtccttaccgtcctccaccaagattggcttaatggaaaggaatacaaatgtaaggtgtcgaacaaggccttgccggcaccgattgaaaagaccattagcaaagccaagggacaacctcgagagccacaggtgtacacgcttccaccttcgcgggatgaacttaccaaaaaccaggtgtcccttacctgtctcgtcaaggggttttacccttcagacatcgcagtcgagtgggaatcgaacggacagccggaaaacaactacaagactaccccacccgtcctggattccgatggatcattcttcctgtacagcaagctcaccgttgacaagtcacgatggcaacagggcaatgtattctcgtgctccgtgatgcatgaggcgcttcacaatcattacactcaaaagagcctgtccctgtcgccagga

SEQ ID NO: 15918 - DNA, 1419 bp, Artificial Sequence
  Description of Artificial Sequence: Synthetic coding sequence
atggctgtgatggcaccgcgtacactggtccttttactttctggagcattggctttgacacagacttgggcagaagtccaacttgtggagtcaggtggtggccttgtacaaccgggaggatcattaaggctctcctgtgccgcgtctggttttaacattaaggatacatacattcattgggttaggcaagcacctgggaaagggttagaatgggttgcacgaatttacccaacaaacggttatacgcgatacgcagattctgttaaaggccgcttcacgatatctgctgacacatccaagaacacagcttatcttcaaatgaattctttacgtgcagaggacactgcagtttattattgctcccgctggggtggcgatggattctacgcgatggattattggggacaaggaacactcgtcacggtttcgtcggcctcgaccaaggggccgtcagtttttccactggctcctagtagtaaatctacaagcggaggaacggccgcgctaggttgtctcgttaaagactacttcccagaaccagttacggtttcgtggaatagcggagcacttacatctggcgtccatacttttccggcagttttgcaatcgtcagggttgtactcactttcatcagtagtgacggtaccatcttcgtctttgggaacacaaacatacatttgtaacgtaaaccacaagccgtcaaatactaaagttgataagaaagtggagccgaagtcttgtgataagacacacacgtgcccaccatgccccgctccagagctgctcggaggaccatctgtatttctttttccaccgaaaccaaaagatacacttatgattagtagaactccggaggtgacgtgcgtggtcgtagatgtctcacatgaagatccagaagttaaatttaattggtatgtggatggcgttgaggtgcataacgcaaaaaccaaacctagagaggaacagtacaactcaacctaccgtgtggttagtgtcttgaccgtcctccaccaagattggctcaatggtaaggaatataaatgcaaggtttccaataaagctcttcctgcgccaatagaaaaaacaatatcaaaggctaaaggccaaccgcgagaaccgcaagtctacaccttgcctccatccagagacgagctgacaaagaatcaagtgtcactcacttgccttgttaaaggattttacccttccgatatcgccgttgaatgggaatctaacggacaaccagaaaataattataagacaactccaccagtgctggacagtgacggaagtttttttctttactctaagttgaccgttgataaatcgaggtggcaacaaggaaatgtgttttcatgtagtgtgatgcacgaggcactccataatcattacacgcagaaatctttgtcgctgagccctgga

SEQ ID NO: 15919 - DNA, 1419 bp, Artificial Sequence
  Description of Artificial Sequence: Synthetic coding sequence
atggcagtcatggccccgcggacccttgtcctgctgctgtcaggagcgctggctctgacgcagacttgggcagaggtgcagctggtcgaatccggcggaggtcttgtgcaaccaggagggtcgttgcgcctgtcctgcgcggccagcggattcaacattaaggacacttacatccactgggtgcgacaagctccgggaaaggggttggaatgggtggcgcggatctacccgaccaacggatacactaggtatgccgattcagtgaaaggacgctttaccatctcggctgacacctccaaaaacaccgcctacctccagatgaattccctccgcgctgaggatactgcagtctattactgttctaggtggggaggcgatggattctacgcaatggattactggggacagggcacgctcgtgaccgtttcctcggcgtccactaagggaccaagcgtgtttcctcttgccccgtccagtaagagcacctcaggagggaccgcagccctgggctgccttgtgaaggactactttccggagccggtgaccgtcagctggaactcaggagccctcacttcaggtgtccacaccttcccggccgtcctgcaatcctcgggcctgtactccctgtcgagcgtggtcacggtgccgtcctctagcctgggcacccaaacttacatctgcaacgtgaatcacaagccctccaacactaaggtggacaagaaggtggaacctaagagctgcgataaaacccatacctgtcccccttgccccgctccagaactgctgggtggcccctcagtattcctgttccctccaaagccaaaggacaccctgatgatctcgagaactcccgaagtgacttgcgtcgtcgtggacgtgtcccacgaagatccggaagtgaagttcaattggtacgtggatggggtcgaagtgcacaacgccaagactaagccaagagaggagcagtacaattcaacctaccgcgtcgtgtcagtcctcactgtcctccatcaggactggctcaatgggaaggagtacaaatgtaaggtgtcgaacaaagcattgccggcccctatcgagaaaactatctccaaagcgaagggtcagccgcgggaaccgcaggtgtacactctgccaccgtcacgggacgagctcacgaaaaatcaggtttcgctcacctgcctcgtgaagggattctacccatcggatattgccgtggaatgggagagcaatggtcagccagaaaacaactacaaaacgacccctcctgtgctggacagcgacggatcgtttttcctgtacagcaaactgactgtggacaagtcgagatggcagcaaggcaacgtgttctcgtgcagcgttatgcatgaagcgttgcataaccactacacccaaaagtccctctcgttgtcgccggga

SEQ ID NO: 15920 - DNA, 1419 bp, Artificial Sequence
  Description of Artificial Sequence: Synthetic coding sequence
atggccgttatggcgcctcggactttggtgttgctgcttagcggagccctcgccctgactcagacctgggccgaagtgcaactcgtggaatcgggaggtggactcgtgcaaccgggcggatccctgcggctgtcttgcgccgcatcgggattcaacatcaaagatacttacatccattgggtgcggcaggcaccgggcaagggactggaatgggtcgctcggatttacccgaccaatggttacactcgctacgccgactccgtcaagggacgctttaccatcagcgcggacaccagcaagaacactgcttacctccagatgaactcgcttcgggcggaggataccgcagtctactattgttcccgctggggcggagatggattctacgcgatggattactggggccagggcacgctggtcaccgtctcaagcgcgagcactaagggaccatcagtctttcccctggccccttcttcgaagtcgacgtcgggaggcactgcggcgctgggatgcctggtcaaagattacttcccggaaccagtaaccgtgagctggaactcaggcgcactgacgtcaggtgtgcataccttccctgcggtgctgcagtcgagcgggctgtactccctgtcgagcgtggtcactgtgccttcatcaagcctgggaacgcagacctacatctgcaacgtgaaccacaaaccgagcaatacgaaagtggacaaaaaggtggagcctaagtcctgcgacaagacgcatacctgcccgccgtgcccggcgcctgagttgctgggtggaccttccgtgttcctgttcccaccaaagcctaaggataccttgatgatctcccggaccccggaggttacctgcgtggtggtggacgtctcacacgaagatccggaggtcaagttcaactggtacgtggacggagtggaggtgcacaatgcaaagaccaagccacgggaagaacagtacaacagcacttacagagttgtgtcagtgctgaccgtgctccaccaggattggctgaacgggaaggagtacaagtgcaaggtgtcgaacaaggccttgcccgcaccaatcgaaaagactatctccaaagccaaggggcagccgcgcgagccgcaagtgtacaccctgccgccgtcaagggatgaactcacgaagaaccaagtctcgctcacctgcctcgtgaaaggattctacccgagcgacatcgcagtggagtgggagtcaaatggccaaccggaaaacaattacaaaactacgccgccagtcctggactctgatggcagcttctttctctactctaagctgactgtcgacaaatcgcgatggcaacagggcaacgtgttctcatgctccgtcatgcatgaggccctgcacaaccattacacccaaaaaagcctttcgctctcacccgga

SEQ ID NO: 15921 - DNA, 1419 bp, Artificial Sequence
  Description of Artificial Sequence: Synthetic coding sequence
atggcagtgatggcacctcgtacgcttgtcctgctcctttcgggagcactggccctcacccagacttgggcagaggtgcaactggtggagtccggtggcggacttgtccaaccggggggctcgctccgcctttcctgtgcagcctcgggattcaacattaaggacacttacattcattgggttcgtcaagccccagggaagggactcgagtgggtcgcgaggatctaccccacgaacggttatacccggtacgcggattccgtgaaaggcagatttaccatctctgccgacaccagtaaaaacaccgcgtacctgcaaatgaactcccttagagccgaggacaccgctgtgtactactgctcaaggtggggtggggatggtttctacgcaatggattactggggccaaggtactctcgtcaccgtgagctccgcatcgactaagggcccctcggtgtttcctctggctccatcgtcaaagtcgacctcaggaggtacggcagcacttggatgtctcgttaaggattactttccggaacctgtgaccgtgtcatggaacagcggagccctgactagcggagtacacacctttcctgccgtcctccaatcaagcggactttactcgctctcgtcggtggtgaccgtgccctctagcagccttggaactcagacgtacatctgtaacgtcaaccataaaccgtcgaacactaaagtcgataagaaggtcgaaccaaaatcatgtgacaaaactcatacttgtccaccatgtcctgccccagagctgcttggcgggccctccgtgtttctgttcccaccaaaaccaaaggatactctgatgatttcacgaacgccagaagttacttgcgtggtcgtggatgtgtcccacgaggaccctgaggtgaagttcaattggtacgtcgacggagtggaagtgcataacgcaaagactaagcctagagaggagcaatacaactctacttaccgagtcgtctcagtcctgaccgtgttgcatcaggactggcttaacggcaaagaatacaagtgtaaggtgtccaataaggcattgccagccccgattgaaaagaccatttccaaggccaagggccaacctagagaaccccaagtctacaccctgcctccttcaagagacgaactgaccaagaaccaggtgtccctcacgtgccttgtgaagggtttctatccatcagatattgctgtggaatgggaatctaacggacaacctgagaacaactacaaaaccacccctcctgtgctggattccgacggatcgttttttctctactccaaactgactgtggataagtcgcgctggcagcaggggaatgtgtttagctgcagcgtgatgcatgaggcactgcataaccattacactcagaagtccctctccctttctcccggt

SEQ ID NO: 15922 - DNA, 1419 bp, Artificial Sequence
  Description of Artificial Sequence: Synthetic coding sequence
atggctgtgatggcacctagaaccttggttttgctgctcagcggggccctcgccctgacccaaacctgggccgaagtgcagctggtggaatccgggggtggcctggtccaaccgggtgggagtctccgactaagttgcgccgcttccggtttcaatattaaagacacctacattcactgggtgcgacaggctcccggcaaaggactggaatgggttgcgcgtatttaccctaccaacgggtacacgcgatacgcggacagcgtcaaaggccgattcacaatatccgctgatacatccaagaataccgcctatcttcagatgaactcgctcagggccgaagacacagccgtttattactgctcacgatgggggggggacgggttttacgccatggactattggggccaaggcaccctggtcacggtttctagtgcgagcactaaaggacccagtgtattcccactggctccatcctctaagagtacttcaggtgggacagcagctcttggctgcctggtcaaggactactttccagaaccggtcacagtcagttggaatagcggggctctgacatctggagtgcacacctttcctgcggtgctgcagagttccggattgtattccctgtcctcagtggtgactgtacccagttcctcccttggcacccagacttatatctgtaatgtgaaccataagccaagcaatactaaggtggataaaaaagtcgagcctaagagctgcgataaaacacatacctgccccccctgccccgcacctgaactgttgggcggccccagtgtgttcctcttcccacctaagcctaaggacacattgatgatctcccgaacacccgaagtgacttgcgtcgtggtggacgtgtctcatgaagacccggaagtgaaattcaactggtacgtcgacggagtggaagtccataatgccaaaaccaaacccagagaggagcagtataacagtacctaccgcgttgtgagcgtcctgactgtactgcaccaagactggttgaatggaaaagagtataagtgtaaggtctctaataaggctctgccggcgcctatcgaaaaaacaattagtaaggctaaaggtcagcctagggagcctcaagtgtacactctgcctcctagcagggacgaacttacaaagaaccaggtttcgctaacttgtctcgtgaagggattttatccctctgacatcgccgtggagtgggagtccaacgggcaacccgagaacaactataagactacacccccggtgctagactccgacggaagcttctttctttactccaaactaaccgttgataaaagcagatggcaacaagggaatgtgtttagctgtagcgtgatgcacgaagccctgcacaatcattacacacaaaagtcgctgtctctgagcccaggg

SEQ ID NO: 15923 - DNA, 1419 bp, Artificial Sequence
  Description of Artificial Sequence: Synthetic coding sequence
atggccgtgatggcaccacgcacactggtgttgttgctgagcggcgcgctagccctcacacagacctgggcagaagtgcagctcgtggaaagcggcggaggattggtgcagcccgggggctcactgaggctttcatgtgccgctagtggattcaacatcaaagatacctacatccactgggtacgccaggcaccaggcaaaggactggaatgggtcgctcgtatttaccccaccaacgggtatacccggtacgccgattcagttaagggccggttcaccataagcgccgataccagcaagaacacagcctacctgcagatgaacagcctccgggcggaggataccgccgtttactattgctctcgatggggaggtgatggcttctacgctatggattactgggggcagggtactcttgtaacggtctcctcagctagtaccaaaggcccaagcgtcttcccactggccccctcttcaaagtctactagcgggggaactgccgccttgggctgtctcgtgaaagattactttcctgagcccgtcaccgttagctggaatagcggagcccttacaagtggagtgcataccttcccggctgtactacagagttccggattgtattccctgtcttccgtggtaaccgtgccttccagctctcttggtacacaaacctatatatgcaatgtcaaccacaagccttctaatactaaggtggataagaaggtagaacccaagtcttgcgataaaacccatacgtgccctccttgcccggccccagagctgttgggaggtccttcagtcttcctcttccctcctaaacctaaggataccttaatgatttcacgcaccccggaagtgacatgtgtggttgtcgatgtgagtcatgaggatccagaagtaaagttcaactggtatgtcgacggggttgaggttcacaacgcaaagacaaaaccccgcgaagaacagtacaactcgacttacagggtggtgagcgtgcttaccgtgctgcaccaggattggttaaatggtaaagagtacaaatgcaaggtgtctaacaaagcacttcccgctccgatcgagaaaaccattagtaaggccaaggggcagccacgagagccccaggtttatacattaccgccaagtcgcgacgagttaaccaagaaccaagtcagtctgacctgcctagtaaaagggttctacccatctgacatagccgtggagtgggagtccaatggccagcccgaaaataattataagactacccctccagttctggactctgacggcagcttctttctgtacagcaaactcaccgtcgacaaaagccgctggcaacaaggaaatgtgttttcctgctccgtgatgcatgaggctcttcacaatcactatacacagaagagtctgagccttagccctggc

SEQ ID NO: 15924 - DNA, 1419 bp, Artificial Sequence
  Description of Artificial Sequence: Synthetic coding sequence
atggcagtgatggctccgaggaccctggttctgctcctgtccggggcacttgccctcacacagacttgggcagaggtccagctcgtggaatccggaggtggactggtgcagccagggggatcgctcagactgagctgtgctgcttccgggtttaatataaaggatacctatatccattgggtccgtcaggcgcctgggaaaggcctggagtgggtcgctcgaatctatcccacaaacggatatacgcgatatgccgactctgtgaaagggaggttcactatatccgctgatactagtaagaacacagcgtacttgcagatgaatagtctgcgagccgaggatactgctgtgtattactgctccaggtggggtggggatggcttctatgccatggattattggggccagggtacattagtgaccgtttcctccgcatccaccaagggtcctagtgtgttccctttagcgcccagctccaagagcacctccggcggcactgcagcactcggctgtctggtcaaagactactttccagaaccggtcactgtgtcttggaacagtggcgccctgacatccggtgtccatacattccccgctgtgcttcaatcgagcggcctatacagtctgtccagcgtggtgactgttccttcatcttcactcggaacccagacatatatctgcaacgtaaatcataagccaagcaacacgaaagtcgacaagaaagtggagcccaagtcctgtgacaaaactcacacatgtcccccctgtccagcacctgagctcctggggggccccagtgtatttcttttccctccgaaacccaaggatactttgatgataagccgcacccctgaggtgacctgtgtggttgtggatgtgtcgcatgaggatccagaagtgaagttcaattggtatgtggacggggtcgaagtgcataacgccaaaaccaagccaagagaggaacagtataactctacctacagagtggtaagtgtgttgacagtgctccaccaggactggctcaacggcaaggagtataaatgtaaggtgtcaaacaaggcactgccagccccaatcgagaaaacgatctcgaaggccaaaggccagcctcgggaaccacaggtctacactctcccaccaagccgtgacgagctgaccaaaaaccaagtcagcttaacttgcttggtcaaggggttctatcctagcgatatagcggtggagtgggagagcaatggacaacctgagaataactacaagaccactcctcccgtcttggacagtgatggatcgttcttcctgtactctaagctgaccgtggataaatcgcggtggcagcaggggaacgttttcagctgctctgtcatgcacgaggccctgcataatcactacacacagaagtctttgtccctgtcccctggg

SEQ ID NO: 15925 - DNA, 1419 bp, Artificial Sequence
  Description of Artificial Sequence: Synthetic coding sequence
atggcagtgatggcacctcgtacgctggtcctgctgctttcgggggcacttgccttgactcaaacgtgggcagaagtacagcttgtagagtccggcgggggacttgtgcaacctggtggatcccttcggctgtcctgcgcagcatcaggctttaacataaaggatacctacattcactgggtgagacaagctccaggaaaagggctcgaatgggtggcacggatttacccgacgaacgggtacacccgctatgccgactcggtgaagggcaggtttactatttccgcggacaccagcaagaataccgcctaccttcagatgaactccctgagggcagaagataccgcagtgtactactgttcaagatggggtggtgatggcttttacgccatggactactgggggcaggggaccctcgtgaccgtgtcctcggcttcgaccaaaggaccctcagtgtttccactggcccccagttcgaaatccacttcaggaggaaccgcggccctcggatgccttgtcaaggattacttcccagagcccgtgaccgtctcctggaattccggagccctgaccagtggagttcatacttttccggcggtccttcagagctccggactttacagcctttccagcgtcgtgaccgtgccatcgagctcgctgggtacccaaacttacatctgcaacgtgaaccataagccttccaacactaaggtggacaaaaaggttgagcctaagtcctgcgataagacccatacttgtcccccttgtccagcaccagaacttctgggtggaccttcggtgttcctctttccccctaagccgaaggatacccttatgatctcgcgtacccccgaagtgacctgcgttgtggtggatgtgtcccatgaagatcctgaggtgaagtttaactggtacgtcgacggagtcgaagtccacaacgcaaagactaagccacgcgaggaacagtacaattctacgtacagggtcgtgagcgttctgaccgtgctgcatcaggattggctgaacggcaaggagtacaagtgtaaagtctccaacaaagcacttccagcacccattgaaaagactattagcaaggcaaaaggtcagcccagagaacctcaagtgtacaccttgccgccaagccgggatgagcttactaagaaccaggtgtccctgacctgccttgtcaaagggttctacccatcagacatcgcagtcgagtgggagtccaacggccaacccgaaaacaattacaaaactaccccaccagtcctcgacagcgatggctccttttttctgtacagcaaacttaccgtcgacaagtcgcggtggcaacagggaaatgtgttctcctgctcggtgatgcatgaagcacttcataatcactacactcaaaagtcgctctcactgtcccctgga

SEQ ID NO: 15926 - DNA, 1419 bp, Artificial Sequence
  Description of Artificial Sequence: Synthetic coding sequence
atggcagtgatggccccccggacactggtgcttctgctgtctggggccctggcgctcacacagacctgggcagaggtgcagctcgtggagtccggaggtggactcgtgcagcctggggggtcccttcggctctcctgtgctgcgtccggcttcaatattaaggatacctacatacattgggtgagacaggcccctggaaaggggctcgagtgggtagctaggatatatcctaccaatggatatactcggtacgcggacagtgtaaaaggccgattcacaatctcagcggatacaagtaagaacaccgcatatctgcagatgaattctctcagagccgaggacacagcagtgtattattgcagtcggtgggggggtgatgggttctatgctatggattattggggtcagggcactctggtgaccgtttcaagcgccagtacaaaaggcccaagcgtctttcccctggctcccagctccaaatctactagtgggggtacagccgcgctgggatgccttgtgaaggactacttcccagagcccgttaccgtgagctggaactcaggagctttgacgtccggcgttcataccttccccgccgtgctgcaatcttccggactgtatagtctgtccagtgttgtcaccgtgccctcctcctctctcggcactcagacctacatctgtaacgtgaaccacaaacccagcaataccaaggtggacaaaaaggtggagcctaaatcatgtgacaaaacacacacctgtcctccctgcccggcgcctgaattgcttgggggaccaagtgtttttcttttcccaccaaaaccgaaggacacactgatgatttctcggaccccagaagtgacctgtgtggtcgtggacgtgtctcatgaggatcccgaggtcaaatttaattggtatgtagacggggtggaagtgcacaatgcaaaaacgaaacccagggaagaacaatacaactcaacttaccgcgtggtctccgtgcttaccgtgcttcaccaggactggcttaatgggaaggaatacaaatgcaaggtcagcaataaggccctgccagcacctattgagaagacaatcagtaaggccaagggacagcctagagagccgcaggtttacacgctgcctccaagcagggacgagctgacaaagaaccaggtatccctcacatgcctggtaaagggtttctacccctccgacattgctgtggagtgggagtcaaacggacagcccgagaataattacaaaactaccccacccgttttggatagcgacggctcattttttctgtacagtaagctcactgtggataagagcagatggcagcagggaaacgtgttctcatgcagtgttatgcatgaagcactccataatcactacacccagaaatcactgagcctttcccccggg

SEQ ID NO: 15927 - DNA, 1419 bp, Artificial Sequence
  Description of Artificial Sequence: Synthetic coding sequence
atggcagtcatggccccgcgcaccctggtgctgctgctttccggtgccctcgcactcactcaaacttgggccgaagtgcagctggtggaaagcggaggcggacttgtgcagccgggaggctcccttagattgtcctgcgcagcatcgggttttaacattaaagacacctatattcattgggtgcgacaagcgcctggaaagggccttgaatgggtggcacgaatctacccaaccaacggatacacccgttacgcagattccgtgaaaggtagatttaccatatccgcggacacgtcaaagaatactgcatacctgcaaatgaattcccttcgcgccgaggacaccgcggtctactactgctccagatggggaggagatggcttctacgctatggactactggggtcaaggtactctcgtcacggtgagcagcgcctccactaagggaccatccgtgttccctttggccccaagcagcaagtccacctcaggcggtactgcagcacttggttgtctcgtcaaggactatttccctgagcctgtcactgtcagctggaacagcggggcacttaccagcggtgtgcatacgttcccagcggttctccaatcgtcgggactgtactcactgtcgtctgtggtcaccgtgcccagctcaagcctgggaactcaaacttacatttgtaacgtaaaccataagcctagtaatacgaaggtcgataagaaggtggagcctaagtcatgtgacaagactcacacgtgtccaccatgccccgccccagaactgctgggtggtccatccgtgtttctgtttcccccgaagccaaaggatactctcatgatctcgagaaccccagaagtgacctgcgtggtggtcgatgtgagccatgaggatccagaagtgaagtttaactggtacgtggacggagtcgaggtccacaatgcaaagacgaagccgagagaagaacagtataactccacttaccgggtggtgagcgtgctcactgttttgcatcaggactggctgaacggtaaggaatacaagtgtaaagtgtccaacaaggcgctgcctgcacctattgaaaagaccatctcgaaagccaagggtcagccacgtgagccccaagtgtacaccctgccgccatcgcgggatgagctcaccaagaaccaggtgtcgctgacttgtcttgtcaaaggtttttacccttccgatatcgcagttgaatgggagtccaatggacaacccgagaataactacaagaccactccccctgtgcttgattccgatgggagcttttttctttattccaagctcactgttgataagagccggtggcaacaaggaaacgtgtttagctgctccgtgatgcatgaagcactgcataaccattacactcagaagtcgctttccctttcgccgggg

SEQ ID NO: 15928 - DNA, 1419 bp, Artificial Sequence
  Description of Artificial Sequence: Synthetic coding sequence
atggctgtaatggcacctagaacattggttttacttttaagtggagctttagctttaactcaaacttgggcagaggtacagttagtagaatctggaggaggattagttcaaccaggaggatcacttagattatcatgtgctgctagtggatttaatattaaggatacttatattcattgggttcgacaagctccaggaaaaggattagaatgggtagctagaatttatcctacaaatggatatactcgatacgctgattcagttaaaggtagatttacaatttcagcagatacttcaaagaatactgcttatttacaaatgaattctttaagagcagaggatacagctgtttattattgttccagatggggaggagatggattttatgcaatggattattggggacaagggacacttgtaacagtctcatctgcttctactaaaggtccaagtgttttcccattagcaccatcatccaaatctacttcaggtggtacagctgctttaggttgtttagttaaagattacttcccagaaccagttactgtatcttggaattcaggtgcacttacttcaggagttcatacatttccagcagttcttcaatcttctggattatattcattaagttctgtagttacagttccaagtagttctcttggaactcaaacatatatttgtaatgtcaatcacaaaccatcaaatactaaagttgataagaaggtcgaacctaaatcatgtgataaaactcatacatgtcctccatgtccagcaccagaacttttaggaggaccatcagtttttcttttccctccaaaaccaaaggatactcttatgatttcaagaactccagaagttacttgtgttgttgtagacgtatcacatgaagaccctgaagtaaaatttaattggtatgttgacggagttgaagttcataatgctaaaacgaaacctagagaagaacagtataattctacatatagagtagttagtgttttaacagtattacatcaagactggttaaatggaaaagaatataaatgtaaagtatctaataaagcacttccagctccaattgagaagacaatttcaaaagcaaaaggacaaccaagagaaccacaagtttatactttaccaccatctagggatgaattaacaaaaaatcaagtatcattaacatgtttagttaaaggattttatccttcagatattgcagttgaatgggaaagtaatggacaaccagagaataattataaaacaactccaccagttttagattccgacggatcattttttctttattcaaaacttactgtagataaatctagatggcaacaaggaaatgtattttcttgtagtgttatgcatgaagcacttcataatcattatacccagaaaagtttatcattatcaccagga

SEQ ID NO: 15929 - DNA, 1419 bp, Artificial Sequence
  Description of Artificial Sequence: Synthetic coding sequence
atggcggtgatggctccccggaccctcgtcctgttattaagtggggctttggctctgacacagacgtgggcggaggtgcagctggtcgagtctggcggggggctggtacagcctggcgggtcactgagattgtcctgcgcagcgtcaggtttcaatatcaaggatacatacatccattgggttcgccaggcacctggaaaaggtctggaatgggtggccaggatctatcccaccaatggctataccaggtacgccgattccgtgaaaggtcggttcaccatctccgctgacacttcaaagaacacagcctacttacaaatgaactccctacgtgcggaggacacagcggtgtactactgctcacgttggggtggtgacggcttctacgcgatggactattggggtcaagggactctcgtcactgtgtcttcagcctctaccaaaggaccatccgtctttcctctcgctccaagttcaaaatccacatccggcggcaccgccgccctgggatgtttggtcaaagactactttccagaacccgtgaccgtgagttggaattcaggcgccctcacctccggcgtacatacgtttccagctgtacttcaatcttccgggctgtacagcttaagctctgtggttacagtgccttcgagtagtttgggcacccagacttatatttgtaacgtgaaccataaaccatcaaataccaaagtggacaagaaggtcgagccaaagagctgtgacaaaactcatacatgtccgccttgtccagctcccgagctgcttggggggccgtcagtgttcttgttcccccctaagccgaaggacacgctaatgattagccggacgccagaggtgacatgtgtagtcgtagacgtaagtcatgaagatccggaagtgaaattcaattggtacgtcgatggcgtcgaggtccacaacgccaaaactaagcccagagaagaacagtacaactcaacctatagagttgtaagtgtgctaacggtcctgcaccaggattggctcaatggaaaggagtataagtgcaaggtgtccaacaaggctctacctgctccaattgagaagacaattagcaaagctaagggtcagccacgggaaccccaggtctacacactgccacccagtcgggacgagcttaccaaaaaccaggtttctttgacctgcctggtgaagggcttttacccatctgacattgctgttgagtgggagtccaatggccagcctgagaacaattacaagactaccccccctgttctggacagcgatgggagcttcttcctgtactccaaattgacggttgacaagtctcgatggcagcagggcaatgtctttagttgctctgtaatgcatgaagcgcttcataaccactatactcagaaaagtttgagtttatctcccgga

SEQ ID NO: 15930 - DNA, 1419 bp, Artificial Sequence
  Description of Artificial Sequence: Synthetic coding sequence
atggcagtgatggctcctagaactctcgtccttcttctgtcgggagcgcttgcgctgactcagacgtgggcggaagtgcagttggtcgaatcggggggtggtctggtgcagcccggcggatcgctgagactgtcgtgcgccgcctcggggttcaacatcaaggatacctacatccactgggtgagacaagccccgggaaaggggcttgaatgggtggcacggatctacccgaccaatggttacacgcggtacgccgacagcgtgaagggacgcttcaccatctccgccgacacttcgaagaacaccgcctacctgcagatgaactccctgcgggctgaagataccgcggtttactactgttccaggtggggaggggatgggttctacgccatggactattggggacaaggcaccctcgtgactgtgtcaagcgcgtccactaagggaccatccgtcttcccactcgccccttcgtccaagtcaacctcgggtggaaccgccgcactgggatgtctggtcaaagactattttcctgagccggtcaccgtcagttggaattcaggtgcgctcacctctggcgtccacaccttcccggccgtcctgcagtcaagcggcctgtacagcctgtctagcgtggtcaccgtgccttcctcctcgctcggcacgcaaacttacatctgtaatgttaaccacaagccctctaacactaaagtcgacaagaaggtggaaccgaagtcatgcgacaagacccacacttgcccgccatgcccggccccagaactcctgggaggaccgtcggtgttcctcttcccgccgaagcctaaggataccctcatgatctcgcgaactcctgaagtgacttgcgtcgtggtggacgtgtcgcacgaagaccccgaggtcaagttcaattggtacgtggacggagtggaggtgcacaacgcgaagactaagccaagggaggagcagtacaattcaacctaccgggtcgtgtcagtgttgactgtgcttcatcaggattggctgaatggtaaagagtacaaatgtaaagtttccaataaggccctgcctgctcctattgaaaagaccatttcaaaagcgaagggccagcctcgcgagccacaagtgtacaccctgcctccttcgagggacgaacttaccaaaaatcaggtgtcgctgacctgtttggtgaaaggcttctaccctagcgatatcgccgtcgagtgggaatcgaacggacaaccggagaacaactacaagaccaccccgcctgtgctggactcggacggttcattcttcctgtactctaagctgactgtcgacaagtcgcggtggcagcagggcaatgtctttagctgctcagtgatgcacgaagcccttcacaatcattacacgcagaaatccttgtcgctgtcgcctgga

SEQ ID NO: 15931 - DNA, 1419 bp, Artificial Sequence
  Description of Artificial Sequence: Synthetic coding sequence
atggcggtgatggcaccccgcaccctggtgctgctcctgagcggtgccctcgcgctgacacaaacgtgggctgaggtgcagctggtagaatcgggcggcggtctggttcagccgggcggctctctgcgactgtcttgcgcagcttcaggatttaatatcaaagatacctacattcactgggtgcgtcaggcgccaggtaaaggactggagtgggtggcaagaatctatcccacaaacgggtacacccggtacgccgatagtgttaaaggccgattcaccattagcgcagacacatcgaagaacaccgcctacttgcagatgaactcacttagggcggaggatacagcagtatactactgcagtcgctggggcggcgatgggttctatgccatggattactggggacaaggcaccctggtgaccgtgagtagcgctagcacaaagggccccagcgttttccctctggccccttccagtaaatctacttcagggggaaccgcggcgctgggttgcctggtcaaggactatttccctgagcccgtgacggtgtcatggaactcgggcgccctgacctccggagtccatacatttccggcggtgctgcagtcgagcggcttgtactccttgtccagtgttgtaaccgtaccctctagctccctgggaacgcagacttatatttgcaatgttaaccacaagccctcgaacaccaaggtcgacaagaaggttgagcccaagagttgcgacaagacgcatacttgcccgccatgccctgcccccgaattgctgggtggccctagcgtgttcttgtttccgccgaagccgaaggataccttgatgataagccgcacccccgaagtcacatgcgtggtagtggacgtgagccacgaagatccggaagttaagtttaactggtatgtcgatggcgtggaagttcataatgccaaaaccaagccgcgcgaggagcaatataattcgacttacagagtggtctcggtgttgactgtacttcatcaagattggctaaacggcaaggaatataagtgcaaagtgtctaataaggcgcttccggcgccgattgagaaaaccatctccaaggccaagggacaaccaagggagcctcaggtgtacacgctgcctccgagccgggatgagctcacgaagaatcaggtgagtctaacttgcctggttaaaggtttttatccctccgacattgcagtggaatgggagtcaaatggtcaacccgagaataattacaagacaacgcccccggtactggacagcgatggatccttcttcttgtatagtaagctgacagtggataaaagtaggtggcagcagggcaacgtcttcagctgcagtgtcatgcacgaggctctccacaatcattatactcagaagtctctgtccctgagtccagga

SEQ ID NO: 15932 - DNA, 1419 bp, Artificial Sequence
  Description of Artificial Sequence: Synthetic coding sequence
atggccgtcatggcccctcgaacgttagtgttgctgctcagtggagctttagcactcacccagacgtgggccgaggtgcagctggtagagtctggcggtggcctggttcagcccggcggttcccttcggctgtcgtgcgcagcctccgggttcaacattaaagacacctatatccactgggtgcgacaagcgcccggaaagggcttggaatgggtcgctaggatttatcccacaaacggttacactagatacgccgattcagtcaagggtcgctttaccataagcgctgacacctccaagaataccgcttacctgcagatgaactctctcagagccgaggataccgccgtgtactactgctcacgctggggcggagatggcttttacgcgatggactactggggccaggggaccctggtcactgtgtcctccgccagcactaagggcccatctgtgttccccctggccccatcttccaaatccacatccggcggaactgccgcgctgggctgccttgttaaagattacttccccgagcctgtaaccgtttcttggaatagcggggccctgacgtctggtgtgcatactttcccggccgtgttacagtccagtggtctgtattccctttcctccgtcgttaccgtgccaagctccagcctgggaactcagacttacatctgcaatgtgaatcataagccaagcaacacaaaggtcgataaaaaggtagaaccaaagtcttgtgataaaactcatacctgtccaccctgtccagcccctgaactgctggggggaccgtctgtgttcttgtttccccccaaaccaaaggatacactcatgatcagccggacacccgaggtgacctgcgtcgtggtcgatgtgagtcatgaagacccagaggttaagttcaactggtatgtcgatggcgtggaggtgcacaatgccaagactaagccccgtgaggagcagtacaactcaacatatagggtggtgtcagtcttaacggtactgcatcaagactggctcaacgggaaggagtataaatgtaaggtgagcaataaagcattaccggcccctatcgagaagacaatctccaaggccaagggacagccacgcgaaccccaggtctatacgctgcctccatcacgcgacgaactaaccaagaatcaggttagcctgacctgcctggtgaagggattttacccctccgacattgcagtggaatgggagtctaacgggcagccagagaacaattacaagacaacacccccggtgctggatagcgacggaagcttctttctgtacagcaagctgacagtggataagtcaaggtggcaacagggcaacgtcttttcttgctcggtcatgcatgaggctctccataatcattacacacaaaagagtctgagcttgtcacccggt

SEQ ID NO: 15933 - DNA, 1419 bp, Artificial Sequence
  Description of Artificial Sequence: Synthetic coding sequence
atggccgtgatggccccacgaaccctcgtccttctcctatcaggcgcccttgccctgactcaaacctgggcggaggtgcagcttgtcgagtcaggaggggggctcgtacagcctggtggctctctgcgtctgtcctgtgcagcaagcggttttaatataaaggacacctacatccattgggtcaggcaagctccggggaaaggtctcgagtgggtcgctagaatttatcctactaacggatacactcgctacgctgattcagtcaagggccggttcactatcagcgccgacacctcgaagaacacggcctatctacagatgaactccctgcgcgctgaagatactgccgtgtattactgttcccggtggggtggcgatggcttttatgccatggattactggggccagggtaccctggtcaccgtgtccagcgcatcaaccaaaggcccttcggtcttccctctggccccaagcagcaagtcaacaagtggggggactgctgcactgggttgtctagtcaaggattacttcccagagcccgtcaccgtgtcatggaactctggcgctctgaccagtggtgtgcatacatttccggctgtgctgcaatcatccggcctttattctctgtccagcgttgtgaccgtgcctagctcttccctcggcacacagacatatatctgtaatgtgaatcacaaaccctccaataccaaggtcgacaaaaaagtggaacccaagagctgtgataaaacccatacctgtccaccgtgccccgcacctgaactactgggcggtccatctgtcttcctttttccacctaaacccaaggacacattaatgatatcaaggacgcccgaagtgacgtgtgtagtcgtggacgtgagccacgaggaccccgaagtgaaattcaattggtatgtggatggggtggaagttcacaatgccaagacgaagccaagagaggagcagtacaacagcacataccgggttgtctctgtgctgaccgtgctgcaccaggactggctaaacggtaaggaatacaaatgcaaggtgtctaacaaggcgctgcccgccccaattgaaaagaccatttctaaagcgaaaggacagcctcgggagccacaggtatacacactaccgccatcgagggatgagctgaccaagaatcaggtgtctctgacctgtcttgtgaaaggcttctatccgtctgacatagctgttgaatgggagagcaacggccagcctgagaataactacaagactaccccacccgtcttggacagtgatgggtcttttttcctgtactctaaactgaccgtggataaatcgagatggcagcagggcaacgtcttcagctgttctgtcatgcatgaagctttgcataaccactatacccagaagtctctgtctctcagcccggga

SEQ ID NO: 15934 - DNA, 1419 bp, Artificial Sequence
  Description of Artificial Sequence: Synthetic coding sequence
atggccgtgatggcacctaggacgctagtgcttctcctatcaggtgcgcttgctctgacgcaaacatgggcagaagttcagctggtggagtcaggaggaggtctagtccagcccgggggaagcctaagactttcctgtgccgcttctggatttaacatcaaggatacttacatccattgggttcgccaggcaccaggcaaaggcttggaatgggtggcccggatctaccctaccaacggatacacaaggtatgcggacagtgtcaaaggccggttcactatttcagcagacacttcaaaaaacacggcttacctgcagatgaactccctgcgagccgaggacactgccgtttattattgtagtcgatggggtggagatggtttttatgccatggattactggggacaggggaccttagtgacggtgtcaagtgccagtacaaaaggcccctccgtgtttcctctagcgcccagtagcaagagcacatccggaggaacagccgctctgggttgtctcgtgaaagactattttccagagcccgtgacggtgagttggaacagcggcgcgctgacttccggtgtacatacattccccgccgtgcttcaatctagcggcttatatagtctgtcctctgtggtgactgtgccaagctcatctcttggaacccaaacctacatatgcaacgtgaaccataaaccttcaaatactaaagtggataagaaagtggagcccaaatcatgtgacaagactcatacctgcccaccttgtcccgcacccgaactcctcggcgggcccagtgttttcctgttcccccccaagcccaaggatacacttatgataagccgcaccccggaagtaacctgtgtggtggtcgatgtgtcccacgaagatccagaggtaaagtttaactggtacgtggacggcgtggaggtgcacaacgctaagaccaagcccagagaagagcagtacaactccacttatagagtcgtgagcgtcctgacggtcctgcatcaagactggctgaacgggaaagaatacaaatgtaaagtatcgaataaggccctcccagctcccattgagaaaaccatttccaaggcgaaagggcagccacgcgagccccaggtgtatacactccccccgagtagagacgagctgaccaagaatcaggtgtcccttacatgtctcgtaaaagggttttacccgtcagacatcgctgtcgagtgggaatcgaatggacagccagaaaacaactataagacaactccccctgtcctcgactccgatgggagtttttttctctactccaaattaacagtcgataaatccagatggcagcagggaaacgtgtttagctgctcagtgatgcatgaagcgttgcacaaccactatacacagaaatccttatccctgtctcccggg

SEQ ID NO: 15935 - DNA, 1419 bp, Artificial Sequence
  Description of Artificial Sequence: Synthetic coding sequence
atggccgtcatggcgccaagaacgctggtcctgctgctctcgggagcgctggccctgactcagacttgggcagaggtgcagctggtcgagtcgggcggaggcctcgtccagcccgggggttcacttcgcctgtcatgcgccgcatcaggtttcaatatcaaagacacttacatccattgggtccgccaggcacctggcaaggggctcgagtgggtggcccgaatttaccccactaacggctacaccaggtacgcagattcggtaaagggtaggttcactatttcggctgatactagcaagaataccgcttatctgcaaatgaattctctgagagccgaggacaccgccgtctactactgctcacggtggggaggcgacggattttacgccatggattactggggacaaggaactctcgtgacggtgtcctccgcatccaccaaggggccatcggtattcccactggcgccgtcgtctaagtccaccagcggtggaaccgcggccctcgggtgcctcgttaaggattactttccagagccggtgactgtgagttggaattctggcgcactcacctcaggtgtccatactttcccggcggtgttgcaatcctctgggctctacagcctcagttctgtcgtgaccgtccccagctccagccttggaacccaaacttacatctgcaatgttaaccacaagccgtctaacaccaaggtcgacaagaaagtggaaccaaagtcgtgtgacaaaactcatacttgcccgccatgccctgctccagaattgctcggcggcccctcggtgttcctgttccctccgaaaccgaaagacacgctgatgatcagccggaccccagaggtgacctgtgtcgtggtggacgtgtcccatgaggaccctgaagtgaaattcaactggtacgtcgacggagtggaagtgcacaacgccaagactaagccgcgcgaggaacagtacaatagcacgtaccgcgtggtgtccgtgttgaccgtgctgcaccaagattggctgaacgggaaagagtacaagtgtaaggtgtcgaacaaggctctgcctgcacctatcgaaaaaaccatctccaaagcgaagggacagcctcgggagcctcaagtgtacaccctgccgccgagtcgcgatgaactgactaagaatcaggtgtcgttgacgtgccttgtcaagggattctacccgagcgacattgccgtcgaatgggaaagcaatggacagccggaaaacaactataagaccaccccgccggtgttggactcggatggctccttttttctctattcaaaactgaccgtagataagtcccggtggcagcagggaaacgtgttcagctgtagcgtgatgcacgaagcgctgcataaccactacactcagaagagcctttcgctgtcaccaggg

SEQ ID NO: 15936 - DNA, 1419 bp, Artificial Sequence
  Description of Artificial Sequence: Synthetic coding sequence
atggcggtgatggctcctcgcactctggtgcttcttctttcgggagcactcgctctgacccaaacttgggcagaagtgcaactcgtagagtccggagggggactcgtccaaccggggggctcactgagactttcctgtgcagcgtcaggattcaatatcaaggacacttacattcactgggtgagacaggcacctgggaaaggtctggaatgggtggctcgtatttaccctactaatggttacacccgatatgcagattccgtgaagggtcgcttcactatctcagctgacacctccaagaacaccgcatacctgcagatgaatagcctgcgagcggaggatacggccgtgtactactgttcccgctggggtggagatggattttacgcaatggattactgggggcagggtactctcgtgaccgtgagcagcgcttcgactaagggaccttcagtctttccgctcgccccgagctcgaagtccacttccggaggtacggctgcactcggatgcctggtgaaggattacttccctgaacccgtgactgtgtcgtggaacagcggtgccctgacttcgggcgtgcatacctttccagccgtcctgcaatcatcgggtctttactcgttgtcgtccgtggttaccgtcccctcatcgtcgctcgggacgcagacttacatttgtaatgtcaaccataagccttcaaacaccaaggtggataagaaagttgagcctaagtcatgtgacaaaacgcatacctgcccgccctgccctgcaccagaacttctgggcggaccctcagtttttctttttccaccaaagcccaaggatactctcatgatctccaggactccagaggtcacctgtgtggtggtcgacgtgtcgcacgaagatcctgaagtgaagtttaactggtatgtcgacggtgtggaagtgcacaatgccaagacgaagcctagggaagaacaatacaactcgacctatcgagtggtgtccgtgcttaccgtcctgcatcaggattggcttaacgggaaggagtacaagtgtaaggtgtcaaataaggcacttcccgcacccattgaaaaaactatttcgaaagcgaagggccaacccagggagcctcaagtgtacactctgcctccctccagagacgaattgacgaagaaccaagtctccttgacctgtctggttaagggcttttacccgtcggacatcgcagtcgaatgggagtctaacggtcagcccgagaacaattacaagaccacccctccagtgctcgattccgatggcagctttttcctttacagcaagctgactgtggataagtcaagatggcaacaggggaacgtgttttcctgctccgtgatgcatgaagcattgcataaccactatactcaaaagtcactttccctttcgcctggg

SEQ ID NO: 15937 - DNA, 1419 bp, Artificial Sequence
  Description of Artificial Sequence: Synthetic coding sequence
atggccgtgatggcaccgcggaccctggtgctgctgctgtcgggggccttggcattgactcaaacctgggctgaagtgcaactggtggagagcggaggaggcctggtgcaacctggcggatcgctccgccttagctgcgcggcgtcgggatttaacatcaaggacacttatatccactgggtcagacaggcgccgggcaagggccttgagtgggtggcgagaatctacccaactaatgggtacacgaggtacgccgactcggtgaagggaagatttaccatcagcgcagacacctccaagaatactgcatacctgcagatgaactccctgagagcagaagataccgctgtgtactactgctccagatggggtggtgacggattctacgccatggattattggggacaaggaacgctcgtcaccgtgagctccgcttccactaagggaccgtcagtgttcccgctggcgccgtcgtcgaaatccacttcaggcggaaccgctgccctcggatgcctggtcaaagattacttcccggagccagtcactgtgtcctggaacagcggtgccctgacttccggcgtgcatactttcccggccgtgcttcagtccagcggactgtactccctctcgtcggtggtgaccgtgccgtcatcatcactgggaacccaaacttacatttgcaacgtgaaccataaacccagcaacaccaaagtggacaagaaggtcgagcccaaaagctgcgacaagactcacacgtgccctccatgcccggcacccgaactcctgggtggccctagcgtgtttctgttcccaccaaagcctaaggatactcttatgatcagccgcactccggaggtcacctgtgtggtcgtggacgtgagccatgaagatccggaagtgaagttcaattggtacgtcgacggggtcgaagtccataatgccaagacgaagccgcgggaagaacagtacaattcgacttacagagtggtcagcgtgctgaccgtgcttcaccaggactggctgaacggaaaggaatacaagtgcaaagtctcgaataaagcgctgccagccccgatcgaaaaaaccatcagcaaggcaaagggacaaccgagagagccgcaagtgtacactctgccaccctcaagagacgaactgaccaagaatcaagtgtccctgacctgtcttgtgaaggggttctacccatccgacatcgcagtggagtgggagtcgaacggacagccagagaataactacaagactactcctccagtgttggattcagacggatcctttttcctgtactcgaagctgaccgtggacaagtcgcgctggcaacagggaaatgtgttctcgtgttcggtcatgcacgaagcgctgcacaaccattacacccaaaagtccctctcactgtccccgggt

SEQ ID NO: 15938 - DNA, 1419 bp, Artificial Sequence
  Description of Artificial Sequence: Synthetic coding sequence
atggcggtgatggcgccgcggaccctcgttctcctgctgtctggggccctcgcactgactcagacctgggcggaagtgcagctcgtcgaatcggggggaggactggtgcaaccaggcggatccctgcgcctgtcatgcgccgcctccggcttcaacatcaaggacacctacattcactgggtgcggcaggccccagggaaaggtttggagtgggtggctcgcatctatccgaccaacggatacacccggtacgccgatagcgtgaaaggaaggttcaccatcagcgcagatactagcaagaacaccgcgtacctgcaaatgaacagcctgcgcgctgaggacacggcggtgtactactgtagccgatggggcggagatggattctacgcaatggactactggggacaaggaaccctcgtcaccgtgagctccgccagcactaaggggccctcagtgttccctctggcgccgtcgtccaaaagcacctctggcgggaccgccgcactgggatgcctcgtgaaggactatttcccagagcctgtcacggtgtcttggaattcgggagccctgacttcaggagtccacacctttccagcagtgctgcagagctcgggactgtactcactgagctcggtcgtcaccgtgccatcgagctctctcggcacccagacgtacatctgcaacgtgaaccacaaaccatcgaacaccaaggtcgataagaaggtagaacccaaatcctgcgataagactcacacctgccctccgtgccctgctcctgaacttctgggaggaccttccgtattcctgttcccaccgaagccgaaggatactctgatgatcagcagaactccggaggtgacctgcgtggttgtggatgtgagccatgaggacccggaagtgaagtttaactggtacgtcgacggagtggaggtgcataacgcaaagacgaagcctcgggaagaacagtacaattccacgtacagggtggtttccgttctgaccgtgctgcatcaggattggttgaacggaaaggagtacaagtgcaaggtgtcaaataaggctctccctgctcctatcgaaaagactatttcaaaggctaagggtcagcccagggagcctcaggtctacactctgccgccatcgcgcgacgaacttacgaagaaccaagtcagcctcacttgcctggtcaagggattctacccgtcagacattgcggtggagtgggaatccaacggccaaccggagaacaactacaaaaccactccgccggttctggatagcgacgggtccttctttctgtactccaagctgactgtggataagtcacgctggcaacagggaaacgtgttctcatgtagcgtcatgcacgaagccttgcataatcattacactcagaaatccctgtcactgtccccgggt

SEQ ID NO: 15939 - DNA, 1419 bp, Artificial Sequence
  Description of Artificial Sequence: Synthetic coding sequence
atggccgtcatggctcccaggacattggtgctcctcctctcaggcgcattggcattaacacaaacctgggctgaggtgcagctggtcgagagtggaggcggactcgtgcaacccggaggaagcctgagactgagttgtgcagcttccggtttcaacattaaggacacctacatccactgggtgcgccaggcaccaggtaaaggcctggagtgggtcgccaggatataccctacgaacggctatacacggtatgccgattctgtgaaaggtcggtttactatatccgcagacaccagcaagaacacagcgtacctgcagatgaactctctgcgcgcagaggacactgctgtgtactactgttccaggtggggaggagacggcttttacgccatggattactggggacagggcaccttggtgaccgtaagctcggccagtactaaggggccaagcgtctttccactggcaccgagttctaagagcacctctgggggtacagccgctctcggttgcctcgtaaaagactacttccctgagccagtgaccgtgagctggaactccggcgcattgacctctggcgtgcacacatttcctgccgtgttgcagtcatcagggttatactctcttagtagcgtcgtgaccgtgccctcctcttccttgggcacacagacgtatatatgtaacgtcaatcacaaacctagtaatactaaggtggataagaaagttgagcctaagtcatgcgataagacccacacttgccccccctgtcccgcccccgaattgctgggtggcccttccgtcttcctgtttccaccaaaacccaaagacaccttaatgataagccgtacacctgaggtgacttgtgttgtggtagacgtcagccatgaggacccggaggttaaatttaactggtacgtagacggagtggaggttcataatgcaaaaaccaagccacgggaggaacaatataactccacctacagagttgtctctgtgctcacagtccttcaccaggactggctcaacggtaaggagtacaagtgtaaggtctcaaataaagctctgccagcccctattgagaagaccatctccaaagctaaggggcagcccagggagccgcaggtgtatactctgcctccctcccgcgacgaactgaccaaaaatcaagtcagcctaacatgcctggtgaaaggcttctacccatctgacatagccgtggagtgggagagcaatgggcagcctgagaacaactacaaaaccaccccacctgtcctggattccgatggttcattctttctatattccaagctgacggtcgataagagccggtggcaacagggcaatgtattctcttgcagcgttatgcacgaggccttgcacaatcactacacacagaaatcactttctttgagcccaggg

SEQ ID NO: 15940 - DNA, 1419 bp, Artificial Sequence
  Description of Artificial Sequence: Synthetic coding sequence
atggctgtgatggctccgcggactctggtgctgctcctgtcaggagcgctggctctgactcaaacgtgggccgaagttcaactggtggaatcgggaggaggccttgtccaacctggaggctccttgcgcctgtcatgcgcggcgtcggggttcaacatcaaggacacttacatccattgggtcagacaggcacctggaaagggattggagtgggtcgcccgaatttacccaactaacggatacaccagatacgccgacagtgtgaagggtcggttcaccatcagcgcagacacctctaagaatacggcctacctgcagatgaactctctgcgcgcggaggacactgccgtgtactactgctcgcgctggggcggagatggattctacgccatggattactggggccaggggactctcgtcactgtgagctcagcatcaactaagggaccgtccgtctttccactggccccgtcgtcgaagtctacctcggggggaaccgcggccctgggatgcctcgttaaggattacttccctgagcctgtgaccgtgtcatggaattctggtgcgctgaccagcggtgtgcataccttcccagccgtgctccagtcctccggcttgtatagtctcagctccgtcgtcaccgtcccatcatcctcccttgggacccaaacgtacatctgcaatgtgaaccacaagccatcgaacaccaaggtcgataagaaagtggagccgaaatcatgtgacaaaacgcacacgtgcccgccgtgtccggctccggagctcctgggcggcccgtccgtgtttctgtttccccctaaaccgaaggacaccctgatgatatcgcgcactccagaagtcacctgcgtcgtcgtcgatgtctcccacgaggaccccgaggtgaagttcaattggtacgtagacggtgttgaagtgcacaacgccaaaaccaaaccgagggaagaacagtataacagcacttaccgggtcgtgtcggtgctcactgtgttgcatcaagattggctcaatggaaaggagtacaagtgcaaagtatccaataaggcactgcctgcgcccatcgaaaagaccatcagtaaagctaaggggcagccgagggaaccgcaggtttacacccttccacccagccgagatgagcttactaaaaaccaggtttccctcacttgcttggtgaaggggttctatcctagcgacattgctgtggaatgggaatccaacggacagccagagaataactacaaaactacgccacccgtgctggactcggacggcagttttttcctgtactcaaagctcactgtggacaagagccggtggcaacagggaaacgtgttcagctgttccgtgatgcacgaagcactgcataaccactacacccagaagtccttgtccctctctcctgga

SEQ ID NO: 15941 - DNA, 1419 bp, Artificial Sequence
  Description of Artificial Sequence: Synthetic coding sequence
atggctgttatggcaccccgaacccttgtcctactgctttcgggggctctggcccttacacagacttgggccgaggttcaactggtggaatccggtggaggtctcgtccaacctggcggctcacttaggctttcctgcgccgcttctgggttcaacatcaaagatacctacatccattgggttcggcaagctccggggaaaggtctggaatgggtggcgcggatttatcccaccaatggttacaccaggtatgctgattctgtcaagggacgattcacaatctcggccgatacctcgaagaacacagcatacttgcaaatgaatagcctccgggctgaggacacagctgtgtattattgctcacgctggggaggtgatggcttctatgcgatggattactggggacagggcacgcttgtgaccgtctcaagcgcaagcacgaagggcccgtccgtgttccctttagccccatcctccaaatcaacctcggggggtactgccgccttaggatgcctggtcaaggactattttccagaacccgtgactgtgtcctggaattcgggggctctgacctccggtgtccatacgttccccgctgtgttgcagagtagcggcctttattccttatcctcagtggtgactgtcccgtcaagctccttgggcactcagacctatatctgtaacgtcaatcacaagccgagtaacacaaaagtggacaaaaaggttgaaccgaagtcgtgcgacaagacacacacttgccctccgtgtcccgctccagagttattaggcgggccgagtgtgttccttttccctcctaagcctaaagataccctgatgattagtcgcaccccagaagtcacatgcgtggtggtcgatgtctcacatgaggacccagaagttaaattcaactggtatgtagacggagtcgaggtccataacgcaaagactaagccccgtgaagagcagtacaactccacatatcgcgttgtttctgtgttgacagtcttacaccaggactggttaaatggtaaagaatacaagtgcaaggtcagcaataaagcattgcctgcacctattgagaagacgatctcaaaggccaagggccaaccccgagagccccaggtttataccttacctccgagcagagacgagcttactaaaaaccaggtttcacttacatgcctcgtcaaaggattttatccctcagatatagcagttgaatgggagagcaacggacagcctgagaacaactataagacaacaccacccgttcttgactccgatggtagcttctttttgtattcaaagcttacagttgataaatctcggtggcagcaggggaacgtattctcgtgttcagttatgcatgaggcgctacacaaccactatactcaaaagagcctgagcctctcccctggg

SEQ ID NO: 15942 - DNA, 1419 bp, Artificial Sequence
  Description of Artificial Sequence: Synthetic coding sequence
atggccgtgatggctccaagaacgctggtgctgttgctgtcgggggccctcgccctcacccaaacctgggcagaggtacaacttgtcgagtccgggggcggactggtccagccaggaggctcgctccgtctgagctgcgcagcctccggattcaacattaaagacacgtatatccactgggtgcgccaggcgccgggaaaggggctcgagtgggtcgcccggatatacccgaccaacggatacacgcgctacgcagatagcgtcaagggaagattcactatcagcgccgatacgtcaaagaacactgcttatctgcagatgaattcgctgagagctgaagataccgcagtgtactactgctcgcgctggggtggagatggcttttacgccatggactactggggacagggaacccttgtgactgtgtcgtctgcgagcactaaaggcccatcggtgtttccgctggcgccatcctcgaagagtacctccggtggcacggcggcgcttggctgtctcgtgaaagactactttccagagccggtcactgtgtcttggaacagcggagcactgacttcgggggtgcacactttcccagccgtgcttcagtcgtccggtctgtacagtttgtccagcgtggtgactgttccatcgagctctctgggaacccaaacttacatttgcaatgtgaaccataagccgtcaaataccaaggtggacaagaaggtcgagccaaagtcgtgcgacaagacccacacttgccctccgtgcccagccccagaactgctgggtgggccgtctgtgttcctcttcccgccgaaaccgaaggatacccttatgatctccagaactccggaagtgacctgtgtggttgtagatgtgagccatgaggatccggaagttaagttcaactggtacgtggacggagttgaagtccacaacgctaagactaagcctcgcgaggagcagtacaatagcacttacagggtcgtgtcagtcttgaccgtgcttcaccaagactggctgaacggcaaggaatacaaatgcaaagtctctaacaaggccctccctgcacctatcgagaaaactatctccaaggcaaagggacagccccgcgagccccaggtgtatactctgcctccgagccgggacgaattgaccaaaaatcaggtgtcactgacctgcctcgtcaagggcttttacccttcagacatcgctgtggaatgggaatccaatggacagccggaaaacaattacaagaccacccctccggtgctggactcggatggatccttcttcctctactccaaactgacggtggacaaatcacggtggcaacaggggaacgtattctcctgttcagtcatgcacgaagcgctccataaccattacacccaaaaaagcctgtctttgtcgccgggg

SEQ ID NO: 15943 - DNA, 1419 bp, Artificial Sequence
  Description of Artificial Sequence: Synthetic coding sequence
atggcggttatggcgccgcgaacgttagttttactattatcgggtgcgttagcgctaacgcaaacgtgggcggaagttcaactagtagaatcgggtggtggtttagtacaaccgggtggttcgttacgtttatcgtgtgcggcgtcgggttttaatataaaagatacgtatatacattgggtacgtcaagcgccgggtaaaggtttagaatgggtagcgcgtatatatccgacgaatggttatacgcgatatgcggattcggttaaaggtcgttttacgatatcggcggatacgtcgaaaaatacggcgtatttacaaatgaattcgctacgagcggaagatacggcggtatattattgttcgcgttggggtggtgatggtttttatgcgatggattattggggtcaaggtacgctagtaacggtttcgtcggcgtcgacgaaaggtccgtcggtatttccgttagcgccgtcgtcgaaatcgacgtcgggtggtacggcggcgttaggttgtttagtaaaagattattttccggaaccggtaacggtatcgtggaattcgggtgcgttaacgtcgggtgtacatacgtttccggcggttctacaatcgtcgggtttatattcgctatcgtcggtagttacggttccgtcgtcgtcgctaggtacgcaaacgtatatatgtaatgtaaatcataaaccgtcgaatacgaaagtagataaaaaagtagaaccgaaatcgtgtgataaaacgcatacgtgtccgccgtgtccggcgccggaattattaggtggtccgtcggtatttttatttccgccgaaaccgaaagatacgctaatgatatcgcgaacgccggaagttacgtgtgttgtagtagatgtatcgcatgaagatccggaagttaaatttaattggtatgttgatggtgtagaagtacataatgcgaaaacgaaaccgcgagaagaacaatataattcgacgtatcgtgtagtatcggtattaacggtattacatcaagattggttaaatggtaaagaatataaatgtaaagtatcgaataaagcgctaccggcgccgatagaaaaaacgatatcgaaagcgaaaggtcaaccgcgagaaccgcaagtatatacgctaccgccgtcgcgagatgaattaacgaaaaatcaagtatcgctaacgtgtttagtaaaaggtttttatccgtcggatatagcggtagaatgggaatcgaatggtcaaccggaaaataattataaaacgacgccgccggtattagattcggatggttcgttttttctatattcgaaactaacggtagataaatcgcgatggcaacaaggtaatgtattttcgtgttcggttatgcatgaagcgttacataatcattatacgcaaaaatcgttatcgttatcgccgggt

SEQ ID NO: 15944 - DNA, 1419 bp, Artificial Sequence
  Description of Artificial Sequence: Synthetic coding sequence
atggccgtgatggcaccccgcacgttggtgctgctgcttagcggggcgctggcactgacccagacttgggcggaggtccaactggtcgaatcaggtggggggcttgtgcagccaggtggttccctgagactttcttgtgcggcatccgggtttaacatcaaggacacctacattcactgggtcagacaagcccccggaaaaggactggaatgggtcgcacgcatttaccccactaacggctacactagatacgctgactcggtgaagggtaggtttaccatcagcgcagacacttcgaagaatactgcgtatcttcagatgaactcactcagagcagaggacacggcagtgtactactgctcccgttggggaggtgatgggttctacgcaatggattactggggtcaaggtactctggtgactgtcagctctgcatcgactaagggaccttcggtgtttcctcttgctccatcgtcaaagtccacctcaggtggaactgcggcacttggatgtcttgtgaaggactactttcctgagccagttactgtgtcttggaactcgggtgccctcactagcggtgtgcatacctttccagccgtcctccaatcctcgggtctgtacagcctctcctcggttgtgacggtgccaagctcctcactgggcacccagacctacatctgtaatgtgaatcacaagccctccaatactaaagtggataagaaagtcgagcctaagtcgtgcgacaaaacccatacgtgccctccatgcccagcaccggaactgcttggcggaccatcggtctttctcttccctccgaagcctaaggacacccttatgatcagcaggaccccagaagtcacttgcgtggtggttgacgtgtcccatgaagatccggaagtgaagtttaactggtatgtggacggtgttgaggtgcataacgccaagactaaaccccgggaagaacagtacaactcaacctaccgcgtggtgtcggtgctgaccgtgcttcaccaggattggctgaatggaaaagaatacaagtgtaaagtctctaataaggcattgcctgcccctatcgaaaagactatctccaaggcaaagggtcaaccacgagagcctcaagtgtacactctcccgccttcgagggacgagctgacgaagaaccaggtcagcctcacctgtcttgtcaagggcttttaccctagcgatatagcagtggaatgggagagcaacggacaacccgaaaacaactacaagaccacccctccagtgctcgattccgatggcagcttctttctttactcgaagctgacggttgataaatcccgctggcaacaaggtaatgtgttctcatgtagcgtgatgcatgaggcgctgcataatcactacacccaaaaatcgctgagcctgtcaccgggg

SEQ ID NO: 15945 - DNA, 1419 bp, Artificial Sequence
  Description of Artificial Sequence: Synthetic coding sequence
atggccgtgatggcgcccagaacactggttttgttgctttcaggggcccttgccttgacgcagacatgggcggaggtgcagctggttgaatccggagggggcctggtgcagcccggcggatccttacggttgtcctgcgcagcttctgggttcaacatcaaggatacctatatacactgggttagacaagctcccggaaagggactagagtgggtggcacgcatttatcctacgaacggctatacgcggtacgctgactctgtcaaaggacgatttactatctccgccgatacgagcaaaaatacagcctacctgcagatgaattccctgagggcggaagatacagctgtgtattactgttctagatgggggggcgatgggttttatgcaatggattattgggggcagggaacactggtgactgtctcatcggcttcgactaagggaccctcagtgtttcctctggcccccagtagcaagtctactagcggaggcaccgccgctctgggatgcctcgttaaggattatttccccgagcccgtaaccgtttcttggaacagtggagctctgacaagtggggtacatacctttcccgcagtcctccagagcagtggactatactcccttagctcagttgtcaccgtgccttcttccagcctcgggactcagacatacatttgcaatgtgaaccacaaaccctccaacaccaaagtggacaagaaggtagagcctaagagttgcgataaaacacacacctgccctccttgtcctgccccagaactgctgggcggaccctccgtcttcctgttcccaccgaaaccgaaagacaccctcatgattagtcgtactcccgaggttacctgcgtcgttgtggacgtttcgcacgaagatccagaagttaagttcaattggtacgttgacggcgttgaggttcacaatgctaagaccaagccaagggaggaacaatacaattctacatatcgagtggtgtctgttctgactgtgctccaccaggactggctgaatggcaaagaatacaaatgtaaagtctccaacaaagcactgccggcccctatcgagaagacgatctccaaagccaagggccaacccagggagcctcaagtttataccctgccaccaagtcgcgatgaattaactaagaatcaggtcagtctcacctgcctggtgaaagggttctacccaagtgatatcgcagtggaatgggaaagtaacggccagccggagaataattacaaaacaaccccgccagtgctggatagcgatggatccttctttctgtatagcaaactgaccgtcgacaagagcagatggcagcagggtaatgtgttttcatgtagcgtcatgcatgaagcgttgcacaatcactacacacagaagtccctgtcactgtcacccggg

SEQ ID NO: 15946 - DNA, 1419 bp, Artificial Sequence
  Description of Artificial Sequence: Synthetic coding sequence
atggctgtaatggccccccggactctggtactcctgctttcaggagctctcgcattgacacagacttgggcggaggtacagctagttgaatctgggggagggctcgtacagcccggaggaagtttaagactctcatgtgcagcctctgggttcaatattaaagacacttatattcactgggttcgacaggccccaggaaaagggttggaatgggttgcacgaatttatcccacaaacgggtatacacgttatgcagattccgtgaaaggaaggtttacaataagtgccgatacatcaaaaaacactgcgtacctgcagatgaactccttacgggccgaagacacggccgtgtactactgttccagatgggggggggatgggttctatgctatggattattggggacaggggactctggtgactgtatctagtgccagtactaagggaccttcggtctttcccctggcaccatccagtaagtctacatccggagggacggccgccctagggtgtttggtcaaagactatttccctgaacccgtgacagtgtcatggaactccggagccctcacatccggggtccacacattccccgccgtgctgcagtcttctggactgtactccctttcttccgtggtcactgtaccttctagttcactcgggactcagacttatatctgcaacgtcaaccacaaaccatccaacacaaaagttgacaaaaaagtcgagcccaagtcctgcgataaaactcacacatgcccaccttgtcccgcgccagaactactgggaggaccatccgtattcctgttccccccaaagcccaaagatacactgatgataagtcggacacccgaagttacatgcgtggtggttgatgtgtcacatgaagatcccgaagtcaaattcaattggtatgtagatggagtcgaagtccacaatgcaaaaacaaagccacgggaggaacagtataattcaacttacagggtcgtatcagtgctgactgtgctccaccaggattggctcaacggaaaagaatataaatgtaaggtatcgaataaggctttacccgcaccaatagagaaaactatttctaaagccaaagggcagcctcgcgaaccccaggtgtatacgttgccccccagtcgggatgaactcactaagaaccaggtgagtctaacatgtctcgtgaaagggttctaccctagtgatatcgcagtggaatgggaatctaatggacagcccgaaaacaactataagactactccacctgtcctcgattcagatgggagtttttttctatatagtaagctgactgtcgataaatctcggtggcagcaagggaatgtcttctcttgttctgtgatgcacgaagctctgcataaccactacacacagaaaagtttaagtctgtctcctgga

SEQ ID NO: 15947 - DNA, 1419 bp, Artificial Sequence
  Description of Artificial Sequence: Synthetic coding sequence
atggcagttatggccccacgaaccctggtgctgctgttgtctggcgccctggcattgacccagacctgggctgaagtccagctcgtggaaagcggaggcggactggtgcagcccggaggatctctgcgtctgagttgtgccgcttcaggcttcaacataaaagacacctatattcattgggtgcgtcaggcccctggaaagggtctcgaatgggtggcaaggatttaccccactaatgggtacacccgctatgctgactctgtcaaagggaggtttacgatctccgcagatactagtaagaatactgcctacctgcagatgaattcgctgagagcagaggacactgctgtttattactgcagtcggtgggggggcgacggcttttacgcgatggattactggggtcagggcacccttgtgactgtcagctccgcatcaacaaaaggccctagcgtttttccactggcaccttcatccaagagcacttccggagggacagccgccctgggatgcctggtcaaggactattttccagaaccagtcactgtgtcttggaactcaggggcactcacaagcggcgtccacacctttcccgcggtgctacagtcttcagggctctatagtttaagttcagtggttaccgtcccgtcctcatctctggggacacaaacgtatatctgcaatgtgaaccacaagccgagtaatacaaaagtcgataagaaggtagagccaaagtcatgtgacaagacacatacatgccccccttgcccagcccctgagctcctggggggaccaagcgtgtttttgttcccccccaagcccaaagatacgctgatgatttccaggacacccgaggtgacatgcgtcgtcgtggacgtctctcatgaagacccggaagtgaagttcaactggtatgtggatggcgtggaggtccataacgcaaaaacgaaaccgcgagaggaacagtataactccacctatagggtggtttctgtgcttacagtccttcaccaggactggctgaacggcaaggaatacaagtgtaaggtatctaacaaagccctgcccgcgcctattgagaaaacaatatccaaggcgaaaggccagccccgtgaaccacaagtatacactcttccgccatctcgagatgagctgacgaaaaaccaggtgtccttaacatgtctggtgaaaggtttctatccctccgatattgccgtcgaatgggagtctaacgggcagcccgagaataactataaaacaaccccgcccgttctggatagtgatggctccttttttctgtatagtaagctgaccgttgacaaatcaaggtggcagcagggcaacgttttctcttgctctgtcatgcatgaagccctgcacaatcattacacgcaaaagagcctaagcctgtcacccgga

SEQ ID NO: 15948 - DNA, 1419 bp, Artificial Sequence
  Description of Artificial Sequence: Synthetic coding sequence
atggcggtcatggcccccaggacactcgtgttacttttaagtggggctctcgcgctaacacagacatgggctgaagtgcagctggttgagtctggaggaggattggtgcagcctggagggtcattgcggctgagttgcgcagcatccgggtttaacataaaagatacatacatccattgggtgagacaggccccagggaaaggactagaatgggttgccaggatctatccaactaatgggtatacacgctacgctgactctgtgaaaggaaggttcacaatttccgccgatacaagtaagaacacagcctacctccagatgaattccctgagagctgaggatactgctgtgtattattgtagtcggtgggggggggatggattctatgccatggattattgggggcagggaactttggttacagtttcttccgcctccacaaaagggccaagtgtgtttcccttggcgccctccagtaagagtacttctggagggacagccgctcttggatgtttggtcaaggattattttcctgaacccgtaacagtatcttggaatagtggggcacttacttcaggggtacatacattccccgctgtgcttcaatccagtggactctactccctctcatcagtggttactgtgcctagtagttctctcggaactcagacttacatttgtaacgttaaccataagccaagtaacacaaaagttgataagaaagtcgagccaaagtcttgcgacaaaacacacacttgtcccccatgcccagcccccgaactcttaggaggaccctctgtgttcctgttccctcctaaacctaaagatacattgatgatatctagaacacctgaagtcacttgtgtagtagtggatgtgagtcatgaagatcctgaagtcaaatttaactggtacgtagatggggtggaagtgcataatgctaaaactaaaccacgggaagaacagtacaattctacataccgggtggttagtgtgcttacagttcttcatcaagactggctaaatgggaaggagtataagtgcaaagtcagtaataaagccctccctgctccaatcgaaaaaacaatctctaaagccaaagggcagcctagggaaccccaggtctatactctcccaccatcacgcgatgagcttacaaaaaatcaggtgtccctaacttgtctggtcaagggattttacccttccgatatcgccgtggagtgggaatccaacggacagccagagaataactataaaactacacccccagttctcgactcggatgggtcctttttcttgtattctaagctgacagtagataaatctaggtggcagcagggaaacgtgttcagttgcagtgtgatgcacgaagcactccataaccattacactcagaaatctctttcgctctcgcccgga

SEQ ID NO: 15949 - DNA, 1419 bp, Artificial Sequence
  Description of Artificial Sequence: Synthetic coding sequence
atggcggtcatggccccaagaaccctggtgctgctactaagcggtgcattggcacttactcagacctgggctgaagtgcagctcgtggaatccggaggagggcttgtccagcctggaggatctctgagactgagctgcgcagcctctggcttcaatatcaaggacacatacatccactgggtacggcaggcccctggaaagggactggagtgggtagctaggatctatcctacgaatggatacacgagatacgccgatagtgtcaaggggaggttcacgatcagtgccgatactagcaaaaacaccgcatacctccagatgaactccctccgggccgaggataccgcagtctactactgcagtcgctggggcggggatggcttctacgcgatggattactgggggcagggcacactggtgacagtctccagcgccagcactaagggaccaagtgtgttccctctggctccttcctctaagagcacttccggcggaacagcggctctaggctgtctagtgaaggactattttccagagcctgtcacagtgagctggaactcaggggcacttaccagcggagttcatacattcccggccgtgctccagtcctcagggctgtactcgctctcttctgtagtgaccgttccttcctcatccctcggcacccagacttacatatgtaatgtgaatcataaaccctccaacacaaaagtggacaagaaagtggaaccaaaatcgtgcgataaaacacatacatgccccccttgtccggcgccggagcttttagggggcccctcggtgttcctctttcccccgaaaccaaaggatacactgatgataagccgcacacccgaagtgacctgcgtggtggttgatgtcagccacgaagaccccgaggtgaagtttaattggtatgtggatggcgtggaggtacacaatgcgaagactaagccacgggaggagcagtacaattctacataccgtgtggtttcagtcctgacagtgttacatcaggactggttaaacgggaaagagtacaagtgtaaggtttccaataaggctctacccgcgcctattgaaaagacgatcagcaaggccaaaggacagccaagagagccccaagtctatactttgcctccaagccgcgacgagctgactaaaaatcaagttagcctcacgtgcctggttaaaggattctatccttctgatatcgccgtcgagtgggaatctaatggacagcctgagaacaattacaagacaacaccacctgtactggatagcgacggcagttttttcttgtacagtaaacttactgtggataagagcaggtggcagcagggcaatgtgttttcctgtagcgtcatgcatgaagctcttcacaaccattacacacagaaatcgctctcactgtcacccggg

SEQ ID NO: 15950 - DNA, 1419 bp, Artificial Sequence
  Description of Artificial Sequence: Synthetic coding sequence
atggctgtgatggcaccgaggacactggtgctcctgctttctggcgcactagctctaacgcagacatgggccgaagtccagcttgtcgagtccggaggtggactggttcaacctggcggcagcttgcggctatcctgtgcagcatctggatttaacatcaaggatacctacatccattgggttcgtcaagccccgggtaagggtcttgagtgggtggcacgcatctatccgaccaacggctatacacgttacgccgatagcgtaaaggggcgtttcaccatcagtgcggatacaagtaagaataccgcctacctgcagatgaacagtctgcgcgcggaggacaccgctgtctactactgttcgcgctggggtggggatggattctacgccatggactactggggacagggaactctggtgactgtttcgtccgccagcaccaagggtcccagcgtcttcccgctcgctccctcctccaagtctacctccggcggtacggcggctctcggctgcttagtcaaggattacttccctgagccggttaccgtgtcgtggaatagcggcgcgctgacctcaggtgtccacaccttccccgcagtgcttcaatcctccggactgtactccctgtcctccgtggtcacagtgccctcctcgagcctaggcacacagacctatatttgcaacgtcaaccacaagccgtccaataccaaggttgacaagaaggtggagccaaaaagctgtgataagactcacacatgccctccctgccccgcacccgagctgctgggtggaccctccgttttcctctttcccccaaaacctaaggataccctgatgatctcgcggaccccggaggtgacatgtgtagtggttgacgtttcgcacgaggaccccgaggtgaagtttaattggtacgtcgacggtgtcgaagtgcacaatgctaagaccaagccgcgcgaggagcaatacaactccacttaccgagtagtcagcgttctcacggtcctgcaccaggactggttgaatggcaaggagtacaagtgcaaagttagtaataaggcgctcccggcgcctatcgaaaagacgatttcgaaggccaagggtcaaccgcgagaacctcaagtctacactctgccaccgtcgcgggatgagctcaccaagaaccaagtaagtctcacctgtctagttaagggtttctatccctcggacatcgctgtggagtgggagagcaatggtcagcccgagaacaactataagacaactccgccggtcttggattcagacgggagttttttcctctattccaagttgacggttgataagtcccgatggcaacaaggaaacgtcttctcctgtagtgtgatgcacgaggccctccacaaccactacactcagaagtccctgtccttgagccctggg

SEQ ID NO: 15951 - DNA, 1419 bp, Artificial Sequence
  Description of Artificial Sequence: Synthetic coding sequence
atggcggtcatggcaccacgtacactggtactgctccttagtggggctctcgcgctgacccagacctgggcagaggtgcagctggtggaatccggtggaggactggtgcagcctggcgggtctttacgattgtcctgcgctgccagcgggtttaatatcaaggacacatatatccactgggtgagacaagcccccggtaagggactcgaatgggttgctagaatttatccaaccaacggatacacccgatatgccgattctgtcaagggtagatttaccatttccgcagatacgagtaagaacacggcttacctgcagatgaactccctaagagccgaggatactgcagtgtattactgtagccgatggggcggggatggattttatgcaatggactattgggggcaggggacgctggtgactgtgagcagcgcatcgacgaaggggccatcggtattccccctcgccccctcaagcaaatcaaccagtggcggcactgccgcactggggtgcttagtgaaagattattttcccgagcccgtcacagtctcctggaacagtggggccttgaccagcggcgtgcacactttcccagcagtcctacagagctccggactgtacagtctgagtagcgttgttacagtgccttctagctcactagggacacagacctacatctgtaatgttaatcacaaaccatctaatacaaaggtggataagaaagttgaacctaagtcttgcgacaaaacacacacctgccccccatgtccagcaccagaactgttgggagggccaagcgtgttcctctttccccccaagcccaaggataccctgatgatcagccgaactcccgaggtaacttgcgtggtggtggatgtgtcccatgaagatccagaagtgaagtttaactggtatgtggacggcgttgaggtccacaacgctaagaccaaaccccgagaagaacagtataactcaacttaccgagtcgttagcgtattgaccgtcctccatcaggactggcttaacggtaaggaatataagtgcaaggtttctaataaagcccttcccgcacctatagaaaaaacaatctccaaggccaaggggcagcccagagaaccacaggtgtacacgcttcctccgtcaagggacgagcttaccaagaatcaggtttcgctgacgtgtctggtgaaaggcttttatcctagcgacattgcggttgaatgggagtcaaatggacagcccgagaataactacaagaccacccccccggtacttgattctgatggttcatttttcttatactctaagttaacagttgacaaatccaggtggcaacagggcaatgtgttctcttgttctgtcatgcatgaagctcttcataaccactatactcagaaatcgctttcattgtcaccaggc

SEQ ID NO: 15952 - DNA, 1419 bp, Artificial Sequence
  Description of Artificial Sequence: Synthetic coding sequence
atggccgtgatggcaccaagaaccctggtgctgcttctctccggagccctggcactgacccagacctgggcagaggtgcagctggtggagagcggcggtggtctggtgcaaccaggtggaagcctgcggctttcgtgcgcagccagcggttttaacattaaagatacttacattcattgggttcggcaagcacccggaaagggactggaatgggtcgcacgcatttatccaaccaacggttacaccagatacgcggactccgtcaaagggcggtttactattagcgcagacacttcaaagaataccgcgtaccttcagatgaactcactccgagcagaagatactgctgtgtactattgtagccgatggggaggagatggattctacgcaatggattattggggccaaggtactcttgtcactgtctcgtcggctagcaccaagggaccttcagttttccctctggcaccttcgtcaaaatcaacctcgggtggtactgcggcacttgggtgtctggtgaaggactactttccagaacccgtgaccgtgtcatggaattccggagcacttacgtcaggcgtgcacacgttccctgcagtgctgcagtcgtcggggctttacagcctgtctagtgtggtgactgtccctagcagctccctgggtacccaaacgtacatttgcaacgtgaatcataagccatccaatacgaaagtggataagaaggtggaacctaaatcgtgtgataagacgcatacctgtcctccttgtcctgcgcccgaactgctcggcggtccctcggtgtttctgtttccgcccaaacccaaggatactctgatgatatcgcgcacccccgaggtgacttgtgtggtggtggatgtgtcacatgaggaccctgaggtgaagtttaactggtacgtggacggtgtggaggtccataacgctaagaccaagcctcgcgaagagcagtacaattcgacttaccgggtcgtatccgtgttgactgtacttcatcaagattggctgaacggaaaagaatacaagtgcaaggtgtcaaacaaggcacttccagctccaatcgaaaaaactatctcaaaggcaaagggacaaccaagagaaccccaggtgtacactctgcccccatcgagagacgagctgaccaaaaatcaggtttccctgacctgcttggtgaaaggtttttacccttcagatatcgcagtggaatgggaaagcaacggccagcctgaaaacaactacaagaccacccctcctgtccttgattcggacggatccttttttctttactcgaagctcactgtcgacaagagtcggtggcagcaaggaaatgtgttttcctgttcagtgatgcatgaagcacttcacaatcactacactcagaagagcctgtctctgagccccggt

SEQ ID NO: 15953 - DNA, 1419 bp, Artificial Sequence
  Description of Artificial Sequence: Synthetic coding sequence
atggcagtgatggctcccagaacactcgtgctcttgctctccggtgccctagccttgacccagacttgggctgaggttcagttggttgagtcaggcggaggtctggtgcagcccggtggatccttgaggcttagctgcgccgcaagtggcttcaatataaaggacacgtatattcactgggttcgtcaggctcctggcaagggtctggagtgggttgcaagaatttacccaacaaatggctatactcggtacgcagactccgtgaaaggacgcttcactatcagcgccgatacaagcaagaatacagcctacctccagatgaattctctgagagctgaagacacagctgtctattattgctctagatggggcggcgacggcttctacgctatggattattggggacaggggacgctggtgacagtctccagcgcatcgactaaggggccttcagtatttcccctggccccctcctcgaagtcgacttccggtgggacagccgcgctcggctgcctcgtgaaagactactttccagagcccgtgactgttagttggaatagtggcgcattaacatcaggtgtccatacctttcctgcggtgctccagtcaagtggcttatatagccttagctctgtagttaccgttcctagcagttccctcggtacccagacatatatatgtaacgtgaaccacaagccctcaaatacaaaggtggacaaaaaagtagaacctaaaagctgcgataagacccatacttgccctccttgcccagctcccgagctgctgggaggtccaagcgtctttcttttcccgccaaagcccaaagatactctcatgatatcccgcacccctgaggttacatgtgttgtggtggatgtatcacatgaggaccctgaagtgaagttcaactggtatgtggatggtgtcgaagtgcacaacgccaagactaaacctcgcgaggaacagtataatagtacctacagagtcgtcagcgtccttaccgtgctgcatcaggattggcttaacggtaaagagtataaatgtaaggtgtcgaacaaggcgctaccagctccaattgaaaagaccatatctaaagcaaaagggcagcctcgggagccccaggtctacaccctgcccccgagtcgcgatgagttgacaaaaaaccaagtgtcgcttacctgcctagtgaagggtttttatccatccgacattgctgtggagtgggagagcaatggacagcccgagaacaattacaagactacaccgccagtgcttgacagcgacggcagcttcttcctgtactcaaagttgactgtggacaaatcaaggtggcaacaaggaaatgtctttagctgcagcgtgatgcacgaagcactgcacaatcactacacccagaagagcctctcgctgtccccggga

SEQ ID NO: 15954 - DNA, 1419 bp, Artificial Sequence
  Description of Artificial Sequence: Synthetic coding sequence
atggccgtcatggctccccgcacactggtgcttctgctgtcgggagcccttgcattgacacagacgtgggccgaggtacagctggtggaaagcggaggcggcctggttcagcccggaggaagcctcagactgagctgcgcagctagcggatttaacataaaagacacctacattcattgggttaggcaggccccaggaaagggattggaatgggtggcccggatctacccaaccaatggctataccagatacgccgactctgtcaaaggacggttcacaattagcgctgacacatccaaaaacaccgcatacttgcagatgaactcgctcagggccgaagataccgcagtgtactattgctcaagatggggcggagatggattctatgctatggattattgggggcaaggaaccctggtaacagtgagttccgctagcacgaagggaccgtcagtctttcctctggcacctagctctaaaagcacttctggtggcaccgctgcgctgggctgccttgtgaaagactacttccctgagcccgtgaccgtgtcgtggaactctggcgctctgaccagcggtgttcatacctttcctgcagttctgcagagctctggactctacagcttgagttctgtggtgaccgtgcccagctcttccttgggtacgcagacctatatttgcaatgtgaaccacaaaccctctaacactaaagtcgacaagaaagtcgaacctaagtcatgcgataagacacacacttgtccaccttgccccgctcccgaacttctcggcgggccaagtgtctttctctttcctccgaagccaaaagacaccctcatgatttctcgtactccagaggtcacatgcgtggtggtcgacgtaagtcacgaggatcccgaggtgaaattcaactggtacgtcgacggcgtagaggtgcacaacgctaaaactaagccccgtgaggagcagtataactctacataccgcgtggtctccgtcctgactgtcctgcatcaagactggttgaatggcaaggagtacaaatgtaaggtgtctaacaaggctctccccgctcccattgagaagaccatttctaaagccaagggtcagccacgcgagcctcaggtttacaccctgcccccaagtagggatgaactgactaaaaatcaagtttctttgacctgcctcgtcaaaggcttctacccatcagacatcgcagtggagtgggaatccaatgggcaacctgagaacaattataagacaacacccccggttctggactcagatggaagcttctttttgtattcaaaattgactgtggacaagagcaggtggcaacagggtaacgtcttttcttgcagtgtcatgcatgaggccctgcataatcattacacacagaagtccttgtcactctccccaggg

SEQ ID NO: 15955 - DNA, 1419 bp, Artificial Sequence
  Description of Artificial Sequence: Synthetic coding sequence
atggcggtgatggcaccgagaactcttgtcctgctgctgtccggagctctcgcactgacgcagacctgggcagaagtccaacttgtggaatccggaggcggccttgtccaaccaggggggtcccttcggctgtcctgcgcagcatccggatttaacattaaggatacctacatccactgggtgcgccaagctcccggtaagggcttggaatgggtcgcaagaatctaccctaccaatggttacacccggtacgctgattccgtgaaggggaggtttactatttcagcagatactagcaagaacactgcctacctccagatgaattcactgagggcagaggatactgcagtgtactattgttcgaggtggggtggagatggtttctacgcgatggactattggggacagggaaccctcgtgacggtgtcatccgcctcgaccaaagggccctccgtctttccactcgcaccttcctctaaatcgacttcaggcggcaccgccgctctgggatgcttggtcaaagactactttccggaacccgtgactgtgtcgtggaactccggcgccctgacctccggcgtccacacgttccctgcagtgcttcagagctccggtctttacagcctctcaagcgtggtcaccgttccaagctcctccctgggcacccagacctacatatgcaacgtgaaccataaaccttcaaacactaaagttgataagaaagtggaacctaaatcgtgtgacaagacccatacctgtccgccttgtccagcaccagaacttcttggtggcccatccgtgtttttgttccctcctaaacccaaagacaccctgatgatctcgaggactcccgaggtgacttgtgtggtcgtcgatgtgtcgcatgaagatcccgaagtgaagtttaactggtatgtcgacggagtggaagtgcataatgccaagaccaagcctagagaagagcagtataacagcacctaccgggtggtgtcggtccttaccgtgctgcatcaggattggctgaatgggaaagagtacaagtgtaaggtgtctaacaaggcgctccctgcaccaattgaaaagactatttcgaaggcaaagggacaaccacgcgaacctcaagtgtacaccttgccaccctcgagggatgaactcactaagaatcaggtgtccctgacttgtcttgtgaaggggttttacccttcggacattgcagtggagtgggagagcaatgggcaaccagagaataactataagactaccccacctgtgctcgattctgacggttcgtttttcctctacagcaaacttactgtcgataagtcccggtggcagcaaggaaacgtgttcagctgttcggtgatgcacgaagcactccacaaccattacacccagaagagcctctccctgtcacctggt

SEQ ID NO: 15956 - DNA, 1419 bp, Artificial Sequence
  Description of Artificial Sequence: Synthetic coding sequence
atggccgtcatggcccctcgcacgctggtgctgctgttgtcaggggcgctggcgctgactcagacttgggccgaagttcagctcgtcgagtcgggcggaggacttgttcagccaggagggtcgcttaggctttcctgcgctgcttcgggcttcaacattaaggacacgtacatacattgggtgagacaagcaccaggtaagggcctggagtgggtggccagaatctaccctactaatggatacactcgatacgccgatagcgtcaagggacgcttcaccatctcagccgacacttcgaagaataccgcatatctgcagatgaatagcttgagagctgaggacacggcggtctactactgctcacgatggggaggagacggattttacgcgatggactactggggccaagggacgctggtcaccgtctcctccgcctcaaccaagggaccgtcggtgttcccactcgcaccgagctcaaagtcgacttccggaggcaccgcggccctggggtgtctcgtcaaggactacttcccggaaccggtcactgtttcatggaactcaggagcccttacgtcgggcgtgcatacttttcccgcggtgctgcaaagctcgggactttactccctgtcgtcggtggtgacggtgccttcctcttcgctcggaactcagacctacatctgtaacgtgaaccacaagccgagcaacaccaaagtggataagaaggtggaacctaaatcttgtgacaaaactcatacttgcccaccatgcccggcaccggagctcctcggcggcccgtcggtgtttctgttcccgcctaaaccaaaggacactctgatgatctccagaacccccgaagtgacctgcgtggtcgtggacgtttcccatgaggacccggaggtgaaattcaactggtatgttgatggagtggaagtgcacaacgctaagaccaagccgcgggaagagcaatacaactcaacttatcgcgtggtgtcagtgctgactgtcttgcaccaggattggctgaatggtaaggaatacaagtgcaaggtgtccaacaaggctttgcctgccccaatcgaaaaaaccatcagcaaggccaagggtcaaccccgcgaaccgcaagtctacaccctgcctccgagcagagacgaactgaccaagaatcaagtctcactcacttgcctggtgaagggcttctacccctccgatattgcggtggaatgggagtccaatggccagccggagaacaactacaagaccaccccgccagtgctggactcggatggatcgttcttcctgtactccaaacttactgtggacaagtcccgctggcagcaaggaaacgttttctcgtgttcggtgatgcacgaggcgcttcacaaccactacacccagaaatctctgtccctgagcccagga

SEQ ID NO: 15957 - DNA, 1419 bp, Artificial Sequence
  Description of Artificial Sequence: Synthetic coding sequence
atggctgtgatggctccacgaacactggtgctcctactttccggtgccctggccctgacccagacctgggcagaagtccagcttgtagaatccgggggcgggctggtgcagcccggcggcagcttgaggttgtcttgtgcggcctctggcttcaacataaaagacacttacattcactgggtgcgccaggctcccggcaaaggactcgagtgggttgcccgcatctatccaacgaacggctacactcgttatgccgattcagtgaaaggacgttttacaatttctgccgatacaagtaaaaacacagcttatctgcagatgaacagtttgcgcgctgaggatacagccgtgtattactgcagtaggtggggaggcgacgggttttatgccatggactactgggggcaagggacactggtgactgtctcgtcggcctccacaaaaggaccctctgtgtttcctctggcgccaagctctaagtcaaccagtgggggcacggctgctctgggctgtctggtgaaggattatttcccagagcctgtgactgtcagttggaattccggagcgcttacaagtggcgtgcacacatttcccgcagttctacagagttcaggactttactcgctgagcagcgtggtgactgtcccctccagtagtcttggaacccagacatatatttgcaatgtgaatcataaaccatctaacaccaaggtagacaaaaaagtcgagccaaagtcatgcgacaagactcacacctgcccgccttgccctgcccccgagctgctcggaggtcccagtgtatttctgtttccccctaagcctaaggatactctgatgatctcccggacaccggaggtcacctgcgtagtcgtggacgtctcccacgaggaccccgaagtgaagtttaactggtacgtagatggagtggaggttcataacgcgaagacaaagccaagagaggagcagtataattccacttatagagtggtatccgtgctgactgtgcttcatcaagactggctgaacggaaaagaatataagtgtaaggtgtcaaataaggccctgcccgcgcccatcgagaagactatatccaaggccaaaggacagcccagagaaccacaggtttacaccctgcccccttccagagatgagctgactaagaaccaagtctcgctgacttgtttggtgaaagggttttatcctagtgacatcgccgtggagtgggagtccaacggccagcctgagaacaattataaaactacacctcctgtgctggactccgacgggtcttttttcctttacagcaagctaaccgtcgacaagagtaggtggcagcagggaaacgtgttttcatgctccgtgatgcatgaggcactccacaaccactatactcagaagtctctgtccctctcacccggt

SEQ ID NO: 15958 - DNA, 1419 bp, Artificial Sequence
  Description of Artificial Sequence: Synthetic coding sequence
atggctgtgatggcaccccgaaccctggtactcttactgtctggggccttagcattgacgcagacatgggccgaggtgcagctggtggagtctggaggaggcctcgtacaaccggggggatcactccgattaagctgtgcggccagtggattcaacattaaggatacctacatccattgggtccgccaggcccctggaaagggcctcgaatgggtcgccagaatctatcctacgaatggatatacaaggtacgccgacagcgtgaagggtcgctttactatcagtgccgacactagtaagaataccgcctatctgcaaatgaacagccttagagcagaagataccgcagtgtactactgtagccgttggggcggtgatgggttttatgccatggactattggggccaagggacactggtcactgtgagctccgccagcacgaagggtccttccgtatttcctctagcaccatcctcaaagtcaacaagcggaggcaccgctgcactgggctgcctggtgaaggactacttcccagaacccgttacagtgagttggaattcaggcgcgctgacgagcggggtacatacatttcccgccgtgttgcagtcatccggtctttacagcctatcctcagtggtcacagtgccttctagctctctgggcacccaaacttatatctgcaacgtgaatcacaagcctagtaatactaaagttgacaaaaaagtggaaccgaaaagttgtgacaagacgcacacctgtccaccttgtccagcacccgagctgctcggggggccttccgtcttcttgttcccccctaaacccaaagacacactcatgatcagcagaactcctgaagtgacctgtgtagtggtagacgtttctcatgaagatccagaggtgaagttcaattggtacgtggatggcgtggaggtgcacaatgcgaagactaagcctcgcgaggaacagtataactccacgtacagagtggtctctgtcctgaccgtgctacatcaggactggctgaatgggaaggaatataaatgtaaggtgtctaataaggcattgcctgctcccattgagaagactatttcaaaagcgaaggggcagccacgcgaaccccaggtatacacattaccaccttcacgtgacgagttgacaaagaaccaggtcagtctcacatgcctggttaagggcttctatccatctgatatcgccgtggagtgggaatctaatggccagcccgaaaataattacaagacaacacccccagtcctggattcagacggctcattcttcctgtacagcaagctgacagtagacaaatcccggtggcaacagggcaacgtgtttagctgctctgtgatgcacgaggcccttcacaaccattatacccagaagagcctcagtttatcaccaggt

SEQ ID NO: 15959 - DNA, 1419 bp, Artificial Sequence
  Description of Artificial Sequence: Synthetic coding sequence
atggcagtgatggcgcctcggactctcgtccttctgttgtcgggtgcactggcgcttactcaaacttgggcagaagtccaactcgtggaatcgggagggggtcttgtgcaaccaggtggttctctgcgtctgtcgtgtgctgcgtcagggttcaacatcaaggatacctacatccattgggtaaggcaagccccaggcaagggcttggagtgggtggctagaatttaccccaccaacggatacacgaggtacgcagattccgtgaagggtcgattcaccatcagcgcagacaccagcaagaacactgcttaccttcaaatgaattccctcagagcagaagatactgccgtgtactattgctcccgttggggcggagacggtttttacgcaatggactactggggacagggaactttggttactgtgtcctcagcatcgaccaaaggaccatccgtgtttccacttgcaccgtcatccaaatccacctcaggcgggactgccgcactcggatgcttggttaaagattactttcctgaaccagtcacggtgtcctggaattccggagcacttacctcgggggtccatacgtttcctgcagttctgcaaagctctggactctattcgctgtccagtgtggttacggtgccatcgtcgagcctgggaacccagacttacatttgtaatgtgaaccataagcctagtaatactaaggtggacaagaaagtggagccaaaatcctgtgataagacccacacctgccctccttgtcccgcaccagagctgcttgggggaccaagcgttttcctctttcctccaaagcctaaggatactctgatgatttcccggactcccgaggttacttgcgtggtagtggatgtgtcacacgaggacccagaagtcaagtttaactggtacgtggatggcgtggaagtgcataatgcaaagactaagccacgtgaagaacaatacaactcaacgtaccgggtcgtgtcggtgcttaccgttctgcaccaggattggcttaacggaaaggaatacaagtgtaaggtcagtaacaaggcactccccgcaccaattgagaaaaccatctcgaaagcaaagggacagccccgagaaccccaggtgtatacccttcctccctccagagacgaactgactaagaaccaagtgagcctgacctgtcttgtgaagggtttttacccgagcgatatagctgtcgaatgggagtcgaatggccaacctgaaaacaattacaaaaccactcctcctgtcctggattctgatggctcatttttcctttactcaaaacttactgtcgacaagtcgcggtggcagcagggtaatgtgttctcgtgttccgtcatgcatgaggcactccataaccactacactcagaagtcactttcactgtccccaggt

SEQ ID NO: 15960 - DNA, 1419 bp, Artificial Sequence
  Description of Artificial Sequence: Synthetic coding sequence
atggccgtcatggcgccaagaacacttgttctcctgctgtcaggggccctggctctgacccaaacctgggctgaagtgcagctcgtggagagtgggggaggactcgtgcagccaggaggatccctgcgcttatcgtgtgccgccagcgggttcaacatcaaggacacatatatacactgggtccgtcaggccccgggcaaggggctggagtgggtggcccgcatatatccgaccaacggatatacccgctacgccgatagcgttaaagggcgttttacaatttcagccgatacttccaaaaacacagcctacctgcagatgaactctctgcgagccgaagacacagcagtctactactgttctcggtgggggggggatggcttctacgccatggattattgggggcaggggacactcgtgaccgttagttctgccagtacaaaaggaccttcggttttccctctcgcgccctcctctaaaagcacaagcggtggcacggccgcccttggctgtttggtgaaagactattttccagagccagtaactgtttcctggaactccggagctctcacaagtggcgttcacacctttccagctgtgctacagtcgagtggactgtattccctgtccagcgtggttaccgtgccatcctcttccctaggcactcagacctatatctgcaatgtaaaccacaagccatctaacactaaagtggataaaaaagtggagccaaaaagctgtgataagacccacacgtgtccgccgtgtcctgccccagaactccttggaggacccagtgtctttctgtttccccccaagcccaaggacacgctgatgatctcgagaacacctgaggtaacttgtgtggtcgtggatgttagtcacgaggaccctgaggtaaagttcaattggtacgtggacggcgtagaagtgcacaacgctaagacaaagccgcgagaggaacagtataatagtacctaccgggtggtgagcgtgctgacggtgctgcatcaggattggcttaacggtaaagagtataaatgtaaagtgtccaacaaagctctccccgctcccatcgagaagaccataagcaaggctaaggggcaacctcgtgagcctcaggtgtatacgctgccaccctccagggatgagctaactaaaaatcaggtttcgcttacctgcctagtgaaaggattttacccttcggatattgcggttgagtgggagtcaaacggacagcccgagaacaattataaaactacccctcctgtcctcgattcagatgggtcattttttttgtatagtaagcttaccgttgataaatcgaggtggcagcagggcaatgtgtttagttgtagtgttatgcacgaagccctgcacaaccattacacccagaagagtctatccctctcacctgga

SEQ ID NO: 15961 - DNA, 1419 bp, Artificial Sequence
  Description of Artificial Sequence: Synthetic coding sequence
atggccgtcatggcccctagaacattggtcctgctactctcgggcgcccttgccctcacacagacctgggctgaagtgcaactcgtggagagcggcggggggttggtacagccaggcgggagtttgcgactttcttgcgctgcttctgggttcaacatcaaagacacatatatccactgggtgcgtcaagctcctgggaagggacttgagtgggtagctcgcatctacccaacaaacggctacactaggtacgcggactcagttaaaggtcggtttaccataagtgctgataccagtaagaacaccgcttacttgcaaatgaatagcttgcgggctgaggataccgcagtgtactattgcagccgctggggaggggacggattctatgctatggattattggggacagggaacactagtgacggtaagctccgccagcacaaaagggccttccgtcttccccctggccccatctagcaagtctacctcaggtggcaccgccgcattgggttgtttggtcaaggactatttccctgaacccgtcaccgtcagctggaactctggtgcccttactagcggagtccacaccttcccagccgtcctgcagagctccggcctgtattctctgtcgtctgtggtgacagtacccagttctagcctggggacacagacttacatttgtaacgtgaaccataagcctagtaatacaaaggtggataagaaagtcgagccaaaaagttgtgataagacccacacatgtcccccctgtcctgcaccggagcttcttggcggaccttctgtattcctcttcccacctaagccaaaggacacactgatgataagccgtacgcccgaggtcacttgtgtggttgtggacgtcagccatgaggatcctgaggttaagttcaattggtacgtcgacggcgttgaagttcacaacgcaaaaaccaaaccaagagaggaacagtataactcaacatacagggtcgtttcggttctcactgtacttcaccaggattggcttaacggcaaagaatataagtgcaaggtgtcaaataaggcactgcccgccccaatcgaaaagactattagtaaagcaaaggggcagccgcgcgagccacaggtttataccctccctcctagtagagatgagctgaccaagaaccaggtcagccttacttgcttggtaaagggcttttatccctctgacattgcagttgaatgggagagcaacgggcagcccgaaaacaactataagactacaccccccgtactcgattctgatggcagtttttttctgtactctaagctaacggtggataagagcaggtggcaacaaggtaatgtattctcctgctctgttatgcatgaggccctccataatcactatactcagaagagcctttccttgagcccaggc

SEQ ID NO: 15962 - DNA, 1419 bp, Artificial Sequence
  Description of Artificial Sequence: Synthetic coding sequence
atggccgtcatggcaccgcgcactctggtgttgctcctctccggggccctggcattgacccagacctgggccgaagtgcaactcgtggagtctggaggagggctggtgcagcctggaggttcactgcggctttcttgtgccgcttcgggatttaacatcaaagacacctacatccattgggtgcgccaggcaccagggaagggactggagtgggtggcccgcatataccccacgaatggatacacccgctatgcggactcggtgaaagggagattcaccatctcggccgatacttcgaagaacacggcctacttgcagatgaactcgctcagagcagaggacacggcagtctactactgctcacggtggggaggagacggattctacgctatggattactggggacaaggaactctggtgactgtgtcgtcggcttccaccaagggtccttctgtgttcccactggctccgtcgtcaaaatcgacttcaggaggtactgcggccttgggatgcctggtgaaagactacttcccggagcctgtcaccgtgtcatggaactcaggggccctgacttccggcgtgcacacttttccggctgtcctccagagctcgggactgtacagcctgtcgagcgtggtcaccgtgcccagctcctcactcggcacccagacctatatctgcaacgtcaatcacaaaccatccaacactaaggtcgacaaaaaggtggagcctaagtcgtgcgataagactcacacctgtcccccctgcccggccccggaactgctcggaggcccgtcagtctttttgtttccaccaaagcctaaagacaccctgatgatctccaggactccagaggtgacttgcgttgtggtggatgtctcccatgaggaccctgaagtcaagtttaactggtatgttgatggtgtagaagtccacaacgccaaaactaaaccacgagaagaacagtacaactcaacctaccgtgttgtctccgtgctcactgtcctccatcaggactggctcaacggaaaagagtataagtgcaaggtgagcaataaggccctgcctgcgccgatcgaaaaaactatcagcaaggcaaagggccaaccgagagagccacaagtgtacacccttccaccatcaagagacgaactgaccaagaaccaggtgagcctcacttgtctcgtcaagggcttctaccccagcgatatcgcagtggagtgggaaagcaacggccagcctgagaataactacaaaactacgcctccggtcctggattcagacggatcgttcttcctgtactcaaagctcaccgtcgataaatcgaggtggcagcagggcaacgtgttctcgtgctcagtgatgcacgaggccctgcataaccactacacccagaagagcctttccctgagtccgggg

SEQ ID NO: 15963 - DNA, 1419 bp, Artificial Sequence
  Description of Artificial Sequence: Synthetic coding sequence
atggccgtgatggccccgcgcaccctggtcctgctcctctcaggagccctggcactgactcaaacctgggccgaagtgcagctggtcgaaagcggtggcggcctggtgcagcccggaggttccctccggctgtcgtgcgctgcgagcggattcaacattaaagacacgtacattcactgggtgagacaagcccctggaaaaggactggagtgggtggctcggatttacccgaccaatgggtacactagatatgctgattctgtgaagggcagattcaccatctcggctgacacgtcgaagaatactgcctacctgcaaatgaattcactgcgggctgaagatactgcagtgtactactgctcccgctggggaggcgatggattttacgcgatggactattggggacagggaaccctggtgaccgtgagcagcgcgtctaccaagggtccttcagtgttcccgttggccccctcgtcgaagagcacgtctggaggtactgcggcgctgggatgcctggtgaaggactactttccggaaccagtgaccgtgtcatggaattccggtgcgctgacctccggggtgcatactttcccggccgtgctgcaatcaagcggactttactctctttcttcggttgtgactgtcccgagctcgtccctgggaacccagacttacatctgcaacgtgaaccataagcccagcaacactaaggtggacaaaaaggtggaacccaaatcatgcgataagactcatacctgccctccctgtccggcgccagagctgctcggtggaccgagcgtctttctgtttccacctaagcccaaggatactctcatgatctcgaggacccctgaagtgacttgtgtggtggtggacgtatcgcacgaggacccggaagtcaagttcaactggtacgtggatggcgtcgaggtgcataatgccaagaccaagccgcgcgaggaacagtacaactcgacttacagagtggtgtcagtgctgaccgttcttcaccaagactggctgaatggaaaggagtacaagtgcaaggtgtccaacaaggcgctgcctgccccgattgaaaaaaccatctcgaaggccaagggacagccccgggaaccacaagtgtacactctgccaccatcgcgggatgaactgactaagaatcaggtttccctgacttgcctggtcaaaggattctacccgtccgacatcgcagtggagtgggaaagcaacggccagccggagaacaactacaagaccactccaccggttctcgactccgacgggtcgtttttcctgtattcaaagctcaccgtggataagtcgcgctggcagcagggcaatgtgttttcctgttcggtcatgcatgaagccttgcataaccattatacccaaaagtccctctccctttcgccaggc

SEQ ID NO: 15964 - DNA, 1419 bp, Artificial Sequence
  Description of Artificial Sequence: Synthetic coding sequence
atggcagtgatggcccctcgtaccctggtacttctcctgtccggcgctcttgccctgacacagacatgggctgaggtgcaattggtggagagtggcggcgggcttgtgcagcctggcggcagtttacgtctctcttgtgcagccagcgggttcaacataaaagacacatatatccactgggtacggcaggcaccgggcaagggcctagaatgggtcgcccgaatctatccgaccaacgggtacacaaggtatgctgatagtgtcaaggggcgctttactatctctgcagacacctctaagaatactgcatacctgcagatgaattcactccgggccgaggacactgcggtgtattactgctcacggtgggggggcgatggcttttatgccatggattactgggggcagggcacactcgtgaccgtttctagcgctagcacaaagggcccatccgtgtttccgctggccccatcgtcaaaatccacgtctgggggcacggccgcactaggctgtttggtgaaggactactttccggaacctgtcaccgttagttggaattcaggagctttaacaagcggagtgcatactttccctgccgtgctgcaatctagtggcctctattctttatccagcgttgtcaccgtgccttctagtagcctggggacacagacatacatttgtaatgtgaaccacaagccgtctaatactaaggttgataaaaaagtggagcccaagtcctgtgacaaaacccatacgtgccctccctgccccgccccagagctgctagggggcccatccgtatttcttttcccccctaagccaaaggataccttgatgatatcgcgaaccccggaagtgacttgcgttgtggttgacgtgagccacgaggacccggaggttaagtttaactggtatgtggacggagtggaagtgcataacgcaaaaacaaagccgcgagaagagcagtataactccacatatcgcgtggtctcagtgcttacagtcctgcaccaagattggctaaacggtaaagagtacaagtgcaaagtcagtaacaaagctctgccagccccgatcgagaaaacaattagtaaggcaaagggtcagccgagagagcctcaggtgtacactctccctccgagccgagatgaactgactaagaaccaagtctctctcacctgtctggttaaaggtttctacccttctgatatagcagtcgagtgggagtcgaatggccagcccgagaacaattacaaaaccacacctccagtgctggattcagatggcagcttctttttgtactcaaaactgactgtggataaaagcaggtggcaacagggcaatgttttcagctgttccgtgatgcacgaggccctccacaatcactatacccagaagagtctgtccttatccccgggc

SEQ ID NO: 15965 - DNA, 1419 bp, Artificial Sequence
  Description of Artificial Sequence: Synthetic coding sequence
atggcggtcatggcaccacggaccctagtcttgctcctaagtggggccttagcactgacccagacttgggcagaagttcagttagtcgagtcaggcgggggattggttcagccaggcggcagcctgcgcctttcatgcgccgcctccggcttcaatataaaggacacttatatccactgggtccgtcaggcgccgggcaagggtctggagtgggtggctcgaatatacccgacaaacggctatacccgctacgctgactccgtgaaaggccggttcaccatctcagcggacacgagtaagaatactgcgtacctgcagatgaattccctgagggctgaggacacagctgtgtattattgctccagatggggtggggatggcttttatgcgatggactattggggccagggtacgctggtcaccgtttcttctgcttcaacaaaaggaccaagcgttttcccattggcccccagcagtaagagcacgagcggcggcaccgctgctctgggctgcctggtgaaagactacttcccggagcctgttacagtgtcatggaattccggggcactgacatccggagtccacacctttcccgccgttttgcagagcagtgggctgtacagtctgagtagcgtcgtgacagtgccatctagttctttggggacacaaacctatatctgtaacgtgaaccacaaaccctccaatactaaggtggacaagaaggtggagccaaagagctgtgataagacacacacttgccccccatgcccagcccccgaactgctgggaggaccttcagtgttcctgttccccccgaagccgaaagataccctgatgatctctcgcactccggaggtgacgtgcgttgtagtggatgtaagtcacgaagatccagaggtgaaatttaattggtatgtggatggcgtcgaagtccacaatgcaaagacaaaacctagggaagagcaatataactccacctatcgcgtggtatctgtcctaaccgtgctccatcaggattggctgaacgggaaggaatacaaatgtaaggtttccaacaaggcattacctgctccgatagagaagacgatttcgaaggcaaagggacagccaagggagcctcaggtgtacactcttccgccatcacgggatgagctgactaagaaccaggtgagcctgacttgcctggtgaagggcttttatcccagtgatatcgctgtggaatgggagtctaacggccagccagagaataactacaagaccaccccccctgttcttgattccgatggttccttttttctttatagcaagcttacagtggataaaagcaggtggcagcagggcaatgtgttctcttgttctgtcatgcacgaagctctccataatcattacacgcagaagtctctgagtttgtcgcccggc

SEQ ID NO: 15966 - DNA, 1419 bp, Artificial Sequence
  Description of Artificial Sequence: Synthetic coding sequence
atggccgtgatggcgccaagaaccctggtgctgctgctgtcgggggccctggccctgacccagacctgggcagaagtgcaactggtggagagcggaggaggactcgtgcaacccggcggatcactgagattgtcttgtgcagcaagcggattcaacattaaggacacctacatccactgggtcagacaagccccaggcaagggactcgagtgggtggcccggatttacccaactaacggatacactcggtacgccgactcagtgaagggacgcttcaccatctccgccgatacctcaaagaacacggcctacctgcaaatgaactctttgcgggcagaagataccgcggtgtactactgctccaggtggggtggagatggattttacgctatggattactggggacagggtaccttggtcactgtctcgagcgcctcaactaagggcccgtcagtgttccccctcgccccgagctcgaaaagcacctcaggggggactgcagcactgggatgccttgtcaaggactacttccctgaaccggtgactgtgtcgtggaactccggagctctgacctcgggcgtgcatacgttcccggcggtgttgcagagctcggggctttattccttgtccagcgttgtgactgtcccttcctcgagcctcggaacgcagacttacatttgcaacgtgaatcacaagccgagcaataccaaagtggacaagaaggtggagccaaagtcgtgcgataagactcacacctgtcctccgtgcccagccccagagcttctgggaggaccgtccgtgttcctcttcccgcctaagccaaaagacactctgatgatttcgaggactcctgaagtcacttgcgttgttgtggacgtgagccatgaggatccggaagtgaaattcaactggtacgtggatggtgtcgaagtccacaacgccaagactaagccgcgggaggagcagtacaattctacctaccgggtggtgtccgttcttaccgtgctgcatcaagactggttgaacggcaaggaatacaaatgcaaggtgtcaaacaaagccctgccagcacccatcgaaaagaccatctcaaaagcaaaaggacagccacgggagcctcaggtgtataccctcccaccatcacgcgacgagttgactaagaaccaggtgtcgctgacctgcctggtgaagggcttttacccgtcggacatcgcggtggagtgggagagcaacggccagcccgaaaacaattacaagaccactccgcctgtcttggactccgacgggtcgttcttcctgtactcaaaattgacggtcgacaaatcgcggtggcagcaaggaaacgttttttcctgctctgtgatgcatgaggccttgcacaatcactacacccagaaatcgctgtctctctcgcctggt

SEQ ID NO: 15967 - DNA, 1419 bp, Artificial Sequence
  Description of Artificial Sequence: Synthetic coding sequence
atggccgtgatggcccctcgaacactcgttctgttactgtccggggccttggccttgactcagacatgggctgaggtccagcttgtggaatccggcggcggccttgtgcagcctggcgggagtttgcggctgtcctgcgccgcctcaggatttaacattaaggatacgtacatccactgggtacggcaagccccaggcaagggccttgaatgggtggcacgcatctacccaaccaatgggtacactaggtacgctgacagtgtgaaggggcgattcacgatcagcgctgacacgtctaaaaatactgcttatttgcagatgaatagcctcagggctgaagacacggccgtctactactgctcacgatggggaggcgatggtttttacgcaatggactactgggggcaggggactcttgtgacagtttccagcgccagcacaaagggccccagcgtttttcccctcgcaccttcgagtaagagcacctctggaggtacagccgctctcgggtgtctcgttaaggattatttccccgagccagttacagtatcttggaacagcggagccctgactagtggcgtgcacacattcccagcggtgctacagtcgagcggcctgtactcattgtcttccgtggtaacggttcccagcagtagcttgggcacgcagacctatatttgcaacgtgaatcataagccctctaacacaaaagtggataagaaggttgagccaaagtcctgcgataagactcatacatgtcccccttgccccgcacccgaactattgggcgggccctccgtgttcctctttccacctaagcccaaggacactctgatgattagccgcacccccgaagtgacttgcgttgtagttgacgtttcgcacgaagatccagaggtgaaatttaactggtacgtggacggcgtcgaggtgcacaacgccaagacgaagccacgcgaagagcagtataactctacctaccgcgtggtgtccgttctcactgtcctgcaccaggattggctaaacgggaaggaatacaagtgtaaagtgtccaacaaagcactaccagccccgattgaaaagaccatctccaaagctaagggtcaaccaagagagccacaggtctatacacttccgccttccagggatgagctgactaagaaccaggtatccctgacttgtctggtcaaaggcttctatccaagcgatattgctgtggaatgggagagcaacgggcaacctgagaacaactacaaaaccactcctccggttctggacagcgatggatcctttttcctttactcaaagctgacagttgacaaatctcggtggcaacagggaaatgtgttttcctgctctgtgatgcacgaggcattgcacaaccattatactcaaaaatcgctctcgctgagccctgga

SEQ ID NO: 15968 - DNA, 1419 bp, Artificial Sequence
  Description of Artificial Sequence: Synthetic coding sequence
atggccgtcatggctccgagaacactggtgctcttgttgagtggcgccctggccctgacccagacttgggcagaagtgcagctggtggagagtggcggcgggctagtgcagccaggcgggtccctgcgcctaagctgtgccgccagtggatttaacattaaggatacctatattcattgggtgcgccaggcccccggaaaagggctggaatgggttgctagaatctacccaaccaacggctacacacgatacgctgatagcgtgaagggcagatttaccattagtgcagacacttcaaaaaataccgcctacctgcaaatgaactcactgagagcagaggacacagccgtttactattgtagtagatggggtggcgacgggttttacgccatggattactggggccaaggcaccctcgtgacagtgtccagtgcatcaactaagggacctagtgtgttccccctggcccctagttccaagtccacttctggaggaaccgccgccctgggatgtttggtaaaggattatttccccgagccggtcactgtgtcatggaactctggcgctctgaccagcggcgttcacactttccccgccgtgttacagagtagcggcctgtatagtctgagctcagtggtgaccgtccctagcagctccctcggaacacaaacttacatttgcaacgtgaatcataaacccagcaacaccaaggtagacaaaaaagtggagcccaagtcatgtgataaaacccacacatgtccaccttgcccggcacccgagctgctgggcggtccctccgtgttcctgttcccccccaagcctaaagatactttaatgatttcgcgcacaccagaagtgacgtgcgtcgttgtggatgtgagccatgaggacccggaagtcaagttcaattggtacgtcgacggggtggaggtgcataacgcaaaaactaaacctagggaagagcaatataacagtacgtaccgtgttgtcagtgtcctgacggttctgcaccaggactggcttaacgggaaagaatataagtgcaaagtcagtaacaaggccctgccggcgcctatcgagaagaccatcagcaaagccaaggggcaacctagggagcctcaagtttacacacttccaccttcccgtgatgaactgactaaaaaccaggtaagcctaacatgcctggttaagggcttctaccccagtgacattgccgttgaatgggagtcgaacggtcaaccagagaacaattataagacaacaccaccggtactcgactcagatggtagttttttcctgtatagcaagcttacggtcgataagagtcgctggcaacaggggaatgtttttagttgtagcgttatgcatgaggccctacataatcattacacccaaaaaagcttgtccttatcccccggg

SEQ ID NO: 15969 - DNA, 1419 bp, Artificial Sequence
  Description of Artificial Sequence: Synthetic coding sequence
atggccgtcatggctcctcgtacccttgtattgcttctgtccggcgctctggccttgactcaaacatgggcagaagtgcagcttgtggagtctggaggaggtctcgttcaacccggcggctcacttcgtctcagttgcgctgcctctggattcaacattaaggacacatacatccactgggtcagacaagctcctggaaagggactcgaatgggtggctagaatttatccaacaaacggatacactcgttacgccgatagcgtcaagggtaggttcactatcagtgctgacacatctaagaatactgcctacttgcaaatgaacagtctccgtgccgaggacaccgctgtgtactattgcagcagatggggaggagacggattctacgctatggattactggggacagggtaccctggttaccgtgagttcagcctctacaaagggcccctccgtgtttccactggctccaagctcaaagtccacctctggaggcaccgccgctctgggctgcctggtcaaggattactttccagaacctgtgacagtttcctggaattctggagctctcacttcaggcgtgcatacattccctgctgtgttgcaatcctccggcctgtactctttgagctctgtagtgactgtcccttcctcctctctcggtacccaaacatatatctgcaatgtcaatcacaagccaagtaacactaaagtagacaagaaagtggagccaaagtcctgcgataagacacatacctgtccaccctgcccagctcctgaactcctcggaggtccaagcgtgttcctgtttcctcccaaacccaaagatacactcatgatctctaggacacctgaggtgacttgtgtggtagtcgacgtatcccacgaggacccagaggtgaagtttaactggtatgtcgacggcgtcgaggtgcataatgcaaaaacaaagcctcgcgaggagcagtataactccacctacagggtggtgagcgtgctgacagtcttgcatcaagattggctgaacggtaaggaatataagtgcaaggtctcaaacaaggcactgcccgcccccatcgagaagaccatttccaaggccaagggccagccaagagaaccacaagtctacaccctcccaccatctagggacgagctgaccaagaatcaggtttctctgacatgtttggtcaagggtttctacccttctgatatagctgtcgagtgggagtctaacggacaacccgaaaacaactacaaaaccactccacccgtcctcgactccgatggctcattctttctgtactctaaattgaccgtcgataaaagcaggtggcaacagggcaatgtattttcttgtagtgtgatgcacgaggccttgcataaccactacacccaaaaaagtctgagtcttagcccaggt

SEQ ID NO: 15970 - DNA, 1419 bp, Artificial Sequence
  Description of Artificial Sequence: Synthetic coding sequence
atggcagtcatggctccaaggaccctagtgttgcttctgtcaggagcattggctctgacccaaacctgggctgaggtgcagctggtggagagtggcggcggtcttgttcagcccggcggaagcctccgtcttagctgcgccgcttctggcttcaacattaaagacacgtatatccattgggttcgccaggcccctggcaagggcctcgaatgggttgcacgaatctatccgactaatgggtataccaggtacgcagattctgtcaaaggcaggttcaccattagcgccgatactagcaaaaacacagcctatttgcaaatgaattccttgagggccgaagacactgccgtttactactgtagcagatggggaggcgatggattttatgcgatggactattgggggcaggggacccttgttaccgtgtcttctgcttcaacaaagggccccagcgttttcccactagccccaagctctaagtctacatctgggggtactgccgccctgggctgtttggtgaaggattactttccagaaccggtaaccgtgtcttggaacagcggcgcgcttacatccggagtacatacttttcccgcagtgttgcagagctccggcctctattctttgtcctctgtggtgactgttccatcatcatccttgggcactcagacctacatatgtaacgtgaatcataagcctagcaacaccaaggtcgacaaaaaagtggagccaaagagctgtgacaagactcatacctgcccaccctgtcctgcacctgagctgctaggagggccgagcgtctttctgttccctcccaaacctaaagatacactgatgatctcacggaccccagaggtgacttgtgtcgtggtggatgtctcccatgaggatccagaagtaaagtttaactggtacgtggatggggtggaagttcataatgccaaaaccaaaccccgggaagagcagtacaatagcacttacagagtggtctccgtgctcaccgtgctccatcaggactggctgaacgggaaagagtataagtgcaaagtatcgaacaaggctctgcccgcccccatagagaaaactattagcaaagcgaaaggacagccacgagagccccaggtgtacacacttcccccctccagagatgaactcacaaagaaccaggtgtctctcacgtgtctagtcaaagggttttatccctccgatatagccgtggagtgggagagtaatgggcaaccagagaacaactacaagacgactccacctgtgttggactcagacggttctttttttttatatagcaagctgacagttgataagtctcggtggcagcagggcaacgtgttcagttgttcagtgatgcatgaagctctccacaatcactacactcagaagagcctatccctgagccccggc

SEQ ID NO: 15971 - DNA, 1419 bp, Artificial Sequence
  Description of Artificial Sequence: Synthetic coding sequence
atggccgtcatggccccgcgcactctggtcctcctgctgagcggtgccctggctctgacacagacttgggccgaggtgcagctggtggagtccgggggcgggctcgtccagcctggcggctccctgaggctgtcctgtgctgcctcagggtttaacattaaagacacctatatacattgggtgaggcaggcacctggaaagggcctcgaatgggtcgccaggatctatccaactaatgggtacaccagatacgctgatagcgtgaagggtcggtttactatttctgccgacactagcaagaacaccgcttacttacagatgaactctttgcgggccgaggacactgccgtgtactactgttctagatggggaggggacggcttttacgctatggattactggggccaagggacattagttactgtgtctagcgcttccaccaagggtccttctgtgttcccactggccccctcctcaaagagtacctctggaggcacagccgctctgggatgtctagtgaaagactattttccagaacccgttaccgtctcttggaactccggcgccctgacctccggcgttcacacttttcccgctgtgctgcagtcatccggactctacagcctgtcatccgtagtgactgtacctagcagcagcctggggactcagacctatatttgcaatgtgaatcataaaccatccaacaccaaggtggataaaaaagtggagccaaaatcttgcgacaagacccacacatgccccccatgtcctgctcctgaactgctggggggccctagcgtctttctatttcctcctaaacctaaggacactttgatgattagcagaacaccagaggtgacttgtgtggttgtggacgtatcccacgaggatcctgaagtgaagtttaactggtacgttgatggcgttgaagttcataacgcaaagactaagccaagggaggaacagtataacagcacctaccgggtggtgtcagtcctgacagtgctgcatcaggattggctcaatggaaaggagtacaagtgcaaagtttcaaacaaggccctgccagctcccatagaaaagactatttctaaggctaaagggcagccacgggagccccaggtctatacattacctccttctagggacgaactgaccaagaaccaggtgagcctaacttgcctggtgaaaggcttttatccatctgacatcgctgtggaatgggaatcaaatggtcaacctgagaataattacaaaaccaccccccccgtgctggattctgatggatccttctttctatacagtaagctgactgtcgataagagtaggtggcagcaaggcaacgtgttttcctgctccgtgatgcacgaagccttacacaaccactacacacagaaaagcctgagcctgtcacccggg

SEQ ID NO: 15972 - DNA, 1419 bp, Artificial Sequence
  Description of Artificial Sequence: Synthetic coding sequence
atggccgtgatggcccctagaactttggtgttgctgctgtccggagctctggcgttgacccagacatgggcagaggtacagttggtggagagcgggggaggtctggtgcagcctggcggttccctgagactgagctgcgccgccagcggcttcaatatcaaggacacatacatacactgggtgagacaagcgccggggaaggggcttgagtgggtggcaaggatctaccccaccaacgggtataccagatacgccgacagtgtaaaaggcagatttacgataagcgctgatacctcaaaaaatacagcttatctgcagatgaattcactcagagcggaagacacagccgtctactattgctcccgctgggggggggatggattttacgcaatggactattggggacagggaactttggtgaccgtgagctccgccagtaccaagggtccaagtgtttttccactggccccctccagtaaaagcaccagcggtgggacagcagcgctcgggtgtctggtaaaggactactttcccgagcccgtgaccgtgtcttggaattcaggcgccctcacaagcggggtccataccttcccggccgtcctgcaaagcagtgggctgtattctctgagtagtgtcgtgacagtgccctcttcctccctcggcacccaaacttatatatgtaatgttaatcataagccgtccaacaccaaggtcgataaaaaagttgaacctaaatcctgcgataagacacacacatgccccccttgccctgctccggaactgctgggcggcccgtccgtgttcttgttcccccccaagccaaaggacaccctgatgatctcccgcacacccgaagtcacatgcgtggtggtggatgtgagtcatgaggaccctgaagtcaaattcaactggtatgttgacggagtggaggtacacaatgcgaagactaagcctagggaggagcagtataactctacttatcgcgtggttagcgtccttacagttcttcatcaggactggcttaatggcaaagagtacaagtgtaaggtatctaacaaagcgcttcccgctcccatcgagaaaaccatcagcaaagccaagggtcagccacgggagccccaggtgtatacactgcctccaagcagggatgagctcacaaagaatcaggtttcacttacatgtttggtcaaaggcttctatccctctgacatagcagttgagtgggagtctaacgggcagccggaaaataattacaagaccacacctcccgtgttggactctgatgggtcattcttcctttattctaaactcactgtggacaagtccagatggcagcaaggcaacgtgttttcatgtagcgtgatgcacgaggcactgcacaatcactatactcagaagtccctttccctgtctccgggc

SEQ ID NO: 15973 - DNA, 1419 bp, Artificial Sequence
  Description of Artificial Sequence: Synthetic coding sequence
atggccgtgatggcaccacgcaccctggtcctgctcctttcgggggcgcttgcacttacccaaacctgggctgaggtccagcttgtcgaatcgggaggcgggcttgtgcaacccgggggatcactgcgtctctcctgtgcagcgagcggtttcaacatcaaggacacctatatacattgggtccgacaagcaccaggcaagggattggagtgggttgcacgtatttaccctactaacggttacactcggtacgcagattcggtgaagggtcgttttacgatctcggcagatacctccaagaataccgcctaccttcaaatgaactcactccgtgcagaagatactgcagtgtactactgctctaggtggggaggagacggattttacgcaatggactactggggacagggaactctggttactgtgtcatcagcctcgaccaaagggccatccgtctttccacttgctccttcgtcaaaatccacctcaggaggcactgcagcactcgggtgcctggtgaaagactattttcctgaacccgtgacggtgtcatggaattcgggtgcactgacctccggtgtgcataccttcccagcagtgctgcaatcgtcaggactctactcactttcctcggtggtgactgtgccgtcatcctcgcttggtactcagacctacatctgtaacgtcaaccataaacccagcaacaccaaagtggataagaaggtcgaacctaagtcgtgtgataagacgcacacctgccccccatgcccagcaccagaactgcttggcggcccctcggtgttcctgtttcctccaaagcctaaagatacccttatgatcagcaggactccagaggtcacttgcgtcgttgtggatgtctcccatgaggatccggaagtgaagtttaactggtacgtcgatggtgtggaagtgcataatgccaaaaccaagccaagagaagagcaatacaactccacctaccgcgtcgtctcggtccttaccgtcctgcatcaggactggcttaatggaaaggagtacaagtgtaaggtgtcaaacaaggctctccctgctcctatagaaaagactatatccaaggcaaagggtcagccaagggagccgcaggtatatactcttccaccctcgagagacgaactgaccaagaaccaagtgtctttgacttgcttggtgaaaggtttctacccgtccgatatcgctgtggagtgggaaagcaatggccagcctgaaaacaactacaaaaccacgccacccgtccttgatagcgacggatcctttttcctttacagtaagctgactgtggataagtcgcgctggcaacagggtaacgtgtttagctgttccgtgatgcatgaggcactgcataaccactacacccaaaaatcgctttcattgtcccctgga

SEQ ID NO: 15974 - DNA, 1419 bp, Artificial Sequence
  Description of Artificial Sequence: Synthetic coding sequence
atggcggtcatggcaccgagaaccttggtcctgctgctctcaggagcattggcattgacgcagacttgggcggaggtgcagctcgtggagtctggcggaggcctggttcagccaggcggtagtctgaggctgtcctgcgcagcctccggtttcaacatcaaggacacctacatccattgggtccgccaggccccaggaaagggcctcgagtgggttgcccgcatctaccctactaacggctacacacgctacgccgattccgttaagggcagatttaccatctcagccgacactagcaagaacacggcctacctgcagatgaactcattgagggcggaggacaccgctgtgtactattgttctcgctggggcggcgacggtttctacgcaatggactactggggccaaggcactcttgtgactgtatcttcagcatctaccaaaggccccagtgtgttcccacttgccccctcttccaagtcaacatccggaggcactgctgctttgggatgtctggtgaaggattatttccccgagcctgttactgtatcatggaatagtggcgccctcaccagtggtgttcataccttccctgccgtacttcagtcatccggtctttattccctgtcctcagtggtgaccgttcccagtagtagcctgggtacccagacctacatctgtaatgtaaatcataaacccagcaacaccaaggtggataagaaagtggagccgaaaagttgcgataagacgcatacctgtccgccctgcccagcacccgaactgcttggaggccccagcgtctttttgttcccgccaaagccaaaagatactcttatgatatctagaacccctgaagtgacatgcgttgtcgtcgacgtgtcacacgaggatccagaagttaagtttaactggtacgtggatggtgtggaagttcacaatgctaagacgaagcccagagaagaacaatacaattccacatacagggtggtgtctgtcctgactgtgcttcatcaggactggctgaacggtaaagaatataagtgtaaggtctccaacaaggcgttgcccgcgccaatcgagaaaacgatttccaaggctaagggacagccccgcgaaccacaagtgtacactctgccgcctagcagagacgagctgacgaagaaccaggtgtccctcacttgcctggtcaagggtttttacccgagtgacatcgctgtcgagtgggagagcaacggccaaccagagaataactataaaacaacacccccagtgctcgactcagacggttcctttttcctctatagtaagttgactgtggataagtctaggtggcagcaaggtaatgtcttctcctgctccgtcatgcacgaagctctgcataatcactacacacagaagtcactgtccttgtcaccaggc

SEQ ID NO: 15975 - DNA, 1419 bp, Artificial Sequence
  Description of Artificial Sequence: Synthetic coding sequence
atggcggtgatggccccgcggaccctggtgctgctgctttcaggagccttggcgctgacccagacctgggctgaagtgcaacttgtcgagtcgggaggcggactggtgcagcccggtggctcgctgcgcctctcctgtgccgcatcgggattcaatatcaaggacacttacatccattgggtccggcaggctccaggaaaaggtctggagtgggtggctcgcatctacccaactaacggttacaccagatacgcggatagcgtgaagggaagattcaccatctcagccgacacttccaagaatactgcctatcttcaaatgaattcacttagagccgaggacaccgccgtgtactactgctcccgctggggcggagatggtttctacgctatggattactggggccagggcaccctcgtgactgtcagctcagcctcgaccaagggtccgagcgtgttcccactcgcaccgtcgtctaagagcacttccggaggcaccgcagctctgggatgcctcgtcaaggattactttccggaaccagtcactgtgtcctggaactcaggggcccttacttccggagtgcacactttcccggcagtcctccagtcaagcggcctttattccctttcgtctgtcgttaccgtcccatcctcatccttgggcacccagacttacatctgtaatgtcaaccataagccgtcaaacactaaggtggataagaaggtcgagcccaagtcatgtgataagacccatacctgcccaccatgtcccgccccggaactcctgggcggtcccagcgtctttttgttcccaccgaaaccaaaagataccctcatgatcagcagaaccccggaggtcacgtgcgtcgtggtggacgtgagccacgaagatccggaagtgaagtttaactggtacgtggatggagtggaggtgcacaacgccaagacgaaaccgcgcgaagagcagtacaactccacctacagggtcgtgtcggtgctcaccgtcctgcaccaggactggttgaacggcaaggaatacaagtgcaaagtctctaacaaggcgctccctgcaccgatcgagaaaacgatctcgaaagcaaagggacaacctcgggagccacaggtgtacactctcccgcctagccgcgacgagctgaccaaaaaccaagtctcgttgacttgtttggtcaagggattctacccatcggacatcgcggtggagtgggaatcgaatggccagcctgagaataactacaaaactaccccacccgtgcttgacagcgacggctcattcttcctgtactctaagctcaccgtggacaagagccgctggcaacagggaaacgtgttttcgtgttccgttatgcacgaagcactgcacaaccattacacccagaaatccctgtcactgtccccaggc

SEQ ID NO: 15976 - DNA, 1419 bp, Artificial Sequence
  Description of Artificial Sequence: Synthetic coding sequence
atggccgtcatggcaccccggaccttggtgctcctgctctcgggcgcactggccctcactcagacttgggctgaggtgcagctcgtggagtcgggcggaggactggtgcaacccggaggaagcctgcgcctgtcgtgtgcggcctccggcttcaacatcaaggacacttacatccattgggtgcggcaggcaccgggtaagggtctggagtgggtggcccgcatctacccgaccaacggctacacgagatatgccgactcagtgaagggccgcttcactatttccgcggacacctccaagaatactgcatatcttcagatgaactcactccgcgcagaggacaccgcggtctattactgcagccgctggggaggtgacggcttctacgcaatggactactggggacaaggcactctcgttactgtgtcgtcggcctcaaccaagggtccttcagtgtttccattggcaccgtcaagcaagtctacctcaggcggaaccgccgccctcggctgtctggtgaaggattacttccctgagcccgtgaccgtcagctggaattcgggagccctcacctcaggggtgcatacttttccggccgtcctgcagtcctccgggctgtactccctgtcatcagtggtgaccgtcccttcctcgagcctcggaactcagacttacatttgcaacgtgaatcacaagcccagcaatactaaggtggacaaaaaggtcgaaccgaagtcctgcgataagacccatacgtgcccgccgtgcccagccccggagctgctcggtggccctagcgtgttcctgttcccacccaagccgaaggacaccctcatgatctcgcggaccccggaggtgacttgcgtggttgtggatgtcagccacgaggacccggaggtgaaattcaactggtatgtcgatggcgtggaagttcacaacgcaaagacgaagcctcgcgaagaacaatacaacagcacctaccgggtcgtgtcggtcttgactgtcctgcaccaagactggctgaacggaaaggaatacaaatgcaaagtctccaacaaggccctgccagccccgatcgaaaagacgatctcaaaggcgaaaggccaacccagagaaccccaggtgtacactctgccaccgtcgcgggacgagctcacgaagaatcaggtgtctctgacctgcttggtcaagggtttctacccgtccgacatcgccgtggaatgggaatcaaacggacagcccgaaaacaactacaagacgaccccgcctgtgctcgacagcgacggctccttctttttgtacagcaaactgaccgtggataaaagcaggtggcaacaggggaatgtgttctcctgctccgtcatgcatgaagctctgcacaaccattacactcagaagtcgctgtccctgtcgccggga

SEQ ID NO: 15977 - DNA, 1419 bp, Artificial Sequence
  Description of Artificial Sequence: Synthetic coding sequence
atggcagtaatggccccgcgcacactcgtgttgctgctctcgggcgctctggccctcacacagacctgggccgaggtgcagctggtggagtccggcggaggtttggttcagcctggcggctctttgcggctttcctgcgccgcctcaggtttcaacattaaagacacgtatatccattgggtgcggcaggctcccggcaaggggctggagtgggtggccaggatctacccaactaatggctatacgcgatatgccgactccgtgaaggggcgcttcactattagcgcagatacatcaaagaatacagcctaccttcagatgaacagcctcagggctgaggacactgcagtgtactactgttccaggtgggggggcgacggattctacgcaatggactactggggacagggcacactggttacggtgagctctgcctctactaaaggaccatcagtatttccgctcgccccctcttccaagtctacctccggcggtaccgctgctctgggatgcctggtcaaagactattttccagaaccagttactgtgagttggaactctggggccctgacatccggggtgcacacttttcctgctgtgcttcagtcttctggactttatagcttgagtagtgtcgtcactgtgccttcctctagtctgggcacccaaacatatatttgtaacgtcaatcacaagccaagtaacactaaagtggacaagaaggtggaacctaaatcttgtgacaaaactcatacatgtcctccctgcccggcgcctgaacttttgggaggcccatcagtatttttgttccccccgaaacctaaagataccctgatgatctcccgcacacctgaggtgacatgcgttgtggttgacgtgagccacgaggatcctgaggtgaagtttaactggtatgtagacggcgtggaggtccacaatgccaaaactaaaccccgcgaagagcagtacaatagcacgtatcgcgttgtgtcagtactgactgttttgcaccaggattggctgaacggaaaggagtacaagtgcaaggttagcaataaggcactgccggctccaatagaaaaaacaatttcaaaagcaaagggccaaccaagagagccccaagtttacacccttccacccagccgcgatgagcttaccaaaaaccaagtcagcctcacttgtctggtgaagggattttacccaagcgacatcgcagtggagtgggaatctaatggccagcccgagaataattataagactacacccccggtactggactccgatgggtcctttttcctttatagcaagttgacagtggataagtcccgctggcagcagggcaatgttttctcctgtagcgtgatgcatgaggctctgcacaatcactatacacagaagagtctctctctgtcaccgggg

SEQ ID NO: 15978 - DNA, 1419 bp, Artificial Sequence; identical to SEQ ID NO: 15960
  Description of Artificial Sequence: Synthetic coding sequence

SEQ ID NO: 15979 - DNA, 1419 bp, Artificial Sequence
  Description of Artificial Sequence: Synthetic coding sequence
atggccgtaatggccccgcgcactctggtcctgctcctctcgggagcgttggcgttgactcaaacctgggcagaagttcagttggtggaatccggcggtggtttggtgcaacctgggggtagcctgagactcagctgtgcagcttccgggttcaacattaaagatacctacattcattgggtgaggcaagcaccgggaaagggtcttgaatgggtggcaagaatctacccaaccaatgggtacacccgctacgccgactccgtgaaaggaagatttactatctcagccgatacctcgaagaatactgcataccttcagatgaacagcttgagagctgaagatactgctgtgtactactgttcacggtggggaggcgacgggttttatgccatggactactggggacaaggtacccttgtgacggtttctagcgcctcaaccaaaggcccttccgtgtttccccttgcaccctcgtcgaagagcacttccggaggtaccgctgccctggggtgccttgtcaaagattactttcctgaaccagtcaccgtgtcgtggaatagcggagcacttacgtcgggagttcatacttttccggcggtcttgcaatccagtgggctgtactctctgtcctcagtcgtgactgtcccgagcagttcgcttggcactcaaacctacatttgtaacgtgaaccataagcctagcaacacgaaggtcgacaagaaagtggaaccaaaatcatgtgataagacccatacctgccccccttgtcctgcgcctgagctgctgggcggcccgtccgtgttcctctttccccccaagccaaaagatacccttatgataagcaggacccctgaggtgacctgtgtggtggtggatgtgtctcacgaagatcctgaagtcaaattcaattggtacgtggacggtgttgaggtccacaatgcaaagaccaagcctcgggaagagcagtataacagcacttacagagtcgtgtcggttcttactgtgctccatcaggactggctgaacggaaaggaatacaaatgcaaggtatcgaacaaggcacttccagccccaatcgaaaaaaccatttcaaaggcaaaaggacagcctcgtgagccacaggtgtacactctgcccccatcacgagatgaactcaccaagaatcaagtctcactgacgtgtcttgttaagggcttttacccatccgatatcgctgtggagtgggagtccaatggccagcccgagaacaactataagactacgcctcccgttcttgattccgatggatcgtttttcctgtacagtaagctcactgtggacaagagccgttggcaacagggtaacgttttctcgtgctccgtgatgcatgaagcacttcacaaccactacactcaaaagagtctctccctgtccccagga

SEQ ID NO: 15980 - DNA, 1419 bp, Artificial Sequence
  Description of Artificial Sequence: Synthetic coding sequence
atggcagtgatggcaccaagaactttggtccttctcctttccggagcactcgcgctgactcaaacttgggcagaggtgcagttggtggaatccggaggtggtctggtgcaacccggaggctcactgcgcctgtcctgtgccgcctcgggctttaacataaaggacacctatattcattgggtgcgtcaagcgcctggcaagggtcttgaatgggtcgcccggatctacccaaccaatggatacactcgatacgcagattcggttaagggccggtttactatcagcgcagatacttccaagaatactgcctatctgcaaatgaactcactgcgcgcggaggataccgccgtctactactgttctaggtggggtggtgatggcttctacgccatggactactgggggcaaggaaccttggtgaccgtgtcctcggccagcactaaagggccttcagtgtttcccttggccccttcctccaaaagcacctccggtggaactgcggccctggggtgtcttgtgaaggattactttcctgaaccagtgaccgtctcttggaattctggggccctgacctcgggcgtccatacttttcctgcggtgcttcaatcgtcgggactctactcacttagcagcgtggtgactgtcccatcgtcgtcccttggaactcagacctacatttgtaacgtcaaccataagccctctaacaccaaagtggacaaaaaggttgaaccgaagtcatgcgataagactcatacctgtccaccgtgccctgcacctgaactccttgggggacccagcgtgtttctgttccctcctaaacctaaggatactctgatgatcagccggacgcctgaagtgacttgcgtcgtggtcgatgtgtcccacgaagatccggaagtgaaattcaactggtacgtcgatggagtggaggtccataatgcgaaaaccaagcctagggaagagcaatacaacagtacttacagagtggtgtcagtgcttaccgtcctgcatcaagactggcttaacgggaaggaatacaaatgtaaagtgtcgaataaggcccttccggcgcctatcgaaaagactatttcgaaggctaagggccaacctagagaaccacaagtgtacacccttccaccatctagggatgaactgaccaagaatcaagtgtctctgacgtgtctcgtgaaggggttctacccaagcgacatcgcagtggaatgggagtccaatggacagccggagaataactacaagactactcccccggtactggattccgacggttcattctttctgtactcaaagttgactgtcgacaaatcgcgctggcagcagggaaacgtgtttagctgctcagtgatgcatgaagcactgcacaatcattacactcagaagagcctgtcgctgtcgccaggt

SEQ ID NO: 15981 - DNA, 1419 bp, Artificial Sequence
  Description of Artificial Sequence: Synthetic coding sequence
atggcggtgatggcaccgagaacgcttgtgttgctgctgtccggagcactcgcgttgactcagacctgggcagaggtgcagctggtggagtcggggggaggcttggtgcaaccggggggctccctgaggctctcctgtgcggccagcggattcaacataaaggatacgtacatccactgggttagacaggcacccggaaagggactggaatgggtggcacggatctacccgaccaatggttacacgagatacgcggacagcgtgaagggccggttcacgatcagcgcggacactagcaagaacaccgcgtacctccaaatgaattcgctgcgcgcggaagataccgccgtgtactactgcagccgctggggtggggacggcttctacgccatggactactggggacagggtactctggtgaccgtgtcctccgcttccaccaagggaccgtccgtgtttcctctggctccttcgagcaagtccacctcgggaggcaccgccgctctcggatgcttggtcaaagactacttcccggagccggtgaccgtcagctggaactctggagcgctgacttcgggagtgcacacttttcccgccgtcctgcagtcgagcggtctgtactcactgtcgtccgtcgtgactgtgccctcatcctcgcttggtacccaaacctacatctgcaacgtgaatcacaaaccgtcaaatactaaggtggacaaaaaggttgagccgaagtcgtgcgacaagacccatacctgcccgccgtgcccagccccggaactgctgggcggaccaagcgttttcctcttcccgccgaaaccgaaggatactctgatgattagccggacgccggaagttacctgcgtggtggtggatgtgagccacgaggatccagaagtgaagttcaactggtacgtcgacggcgtcgaagtccataacgccaagactaaaccacgggaagaacagtacaattccacctatcgggtggtgtccgtccttactgtgctgcaccaagattggttgaacggtaaggaatacaagtgcaaagtctcaaacaaggcactgccagccccgattgaaaaaacgatttccaaggcgaagggccagccccgcgagccgcaggtttacaccctgccaccgtcgagggacgagcttactaagaaccaggtatcactcacgtgtctggtcaaaggattttacccttccgacatcgcggtggagtgggaatctaacgggcagccggagaataactacaagactacccctcctgtccttgactcggatggatccttctttctgtactcgaagctgacggtggacaagtccaggtggcaacagggaaacgttttcagctgcagcgtcatgcatgaagctctgcacaatcactatacgcaaaaaagcctctccctgagccctggt

SEQ ID NO: 15982 - DNA, 1419 bp, Artificial Sequence
  Description of Artificial Sequence: Synthetic coding sequence
atggccgtgatggcgcctaggactctcgttttgctgttaagcggggctctggcactgactcaaacctgggcagaggtacagcttgtggagagtggaggtggtctcgtacagcccggcggctcccttaggctgtcttgcgcagccagtggcttcaatatcaaggatacatatatccactgggtcaggcaagcacccggcaaaggcctggaatgggtagctcgcatttaccccacaaatgggtacacccggtacgccgacagcgtcaaggggaggttcactatcagcgctgacactagcaagaacacggcctatcttcaaatgaattctctgagggctgaagacacagccgtgtactattgcagtcgctggggaggtgacggtttttacgcgatggactactgggggcagggaaccctcgtgacagtatcctcagcttcaaccaagggcccttcggtgtttccactagcaccctcaagcaagtctacctccggtggcaccgcggctctaggctgcctcgttaaagattatttccccgagcctgtgactgtttcttggaacagcggcgctttgacaagcggcgttcacaccttccccgcagtgctccagtcatctggcctgtattccttgagttctgtggtaactgtccccagctcctcactgggtacgcagacatatatttgcaacgtgaaccacaaaccctcaaacacaaaggtggacaaaaaagtggagccgaaaagctgtgataagacacacacatgccctccatgtcctgcaccagaacttcttggaggtccgtccgtgttcctattcccaccaaagcccaaagacacccttatgattagccggacgcctgaagttacttgtgttgttgttgatgtgagccacgaagacccggaggtgaaattcaattggtacgtggacggcgttgaagtgcataatgctaagaccaagcccagagaggagcagtataactctacttatcgggtcgtttctgttctgaccgtgctccaccaggattggcttaatggtaaagagtacaagtgcaaagtgtccaacaaggcactacccgccccaatcgaaaaaacaatttcaaaagccaaggggcaaccacgagaacctcaggtgtacacacttcccccatctcgggacgaactgacaaaaaaccaggttagcttgacatgcctagtcaaggggttctacccgagcgacatagctgtggagtgggagagtaacggccagcccgagaataattacaagacaactccaccagttctggattccgatggtagttttttcctctactcaaaactcacagtcgacaagtcgagatggcagcagggtaatgttttcagctgcagcgtgatgcacgaggccctacacaaccactatacacagaagtccctgtcattgtcccctggc

SEQ ID NO: 15983 - DNA, 1419 bp, Artificial Sequence
  Description of Artificial Sequence: Synthetic coding sequence
atggcagtcatggcacctaggaccctggtgctccttctatccggggcacttgccctgacccagacttgggcagaggtgcagttggttgaaagcggtggcgggctagtacagccgggcggctctttacgactaagctgcgcagcaagcgggtttaacatcaaagatacgtacatccactgggtgaggcaggctcccggtaagggtcttgagtgggtcgcaagaatatacccgactaacgggtataccagatatgccgactctgtgaaggggcgttttaccattagtgccgacacctctaaaaataccgcttacttgcagatgaacagcctgagagcagaagacacagccgtgtattactgttctcggtggggcggcgatggattctatgccatggattattggggccaggggactcttgttacagtctcctccgcctccacaaaaggaccatccgttttcccgctggcacctagtagtaaatccacgagcggggggaccgccgccctcggctgtttggtaaaagattattttcctgagcccgtcacagtatcctggaactcaggagctctaacctccggcgtgcataccttcccagctgtccttcagtcttctggcctctacagcctttcatccgtggtcaccgtccctagtagtagcttgggaactcagacctacatatgcaacgtcaatcacaaaccgagtaatacaaaggtggacaagaaggtagagcctaagtcttgcgataagacccacacatgcccgccctgtcctgctccggagctcttagggggcccatccgtatttttgttcccgcctaaacccaaagataccctcatgatctccagaactcctgaggtcacctgcgttgttgtcgacgtgtcacatgaagatccagaagtgaagttcaactggtatgttgacggggtggaggtacacaatgcaaaaaccaagccacgggaagagcagtataactctacttaccgcgtggtgtccgtcttgaccgttctgcaccaggattggttaaatggcaaagaatataaatgcaaggtgtcaaataaggcactacccgcacctattgaaaaaacgatcagcaaagcgaagggccagccaagggagcctcaggtttatacactaccaccttctcgggacgaactaaccaagaaccaggtgtcgttgacatgtctagtgaaagggttttatccgtctgatatcgccgtcgagtgggagagcaacggccagccagagaataactacaagacaaccccccccgtgctcgactctgacggctctttttttttgtactctaaactaacagtggataaatcccgttggcaacaggggaatgttttcagctgcagcgtcatgcacgaggcactccacaatcactatacgcagaagtctctctctctttctcccggc

SEQ ID NO: 15984 - DNA, 1419 bp, Artificial Sequence
  Description of Artificial Sequence: Synthetic coding sequence
atggcggtgatggcaccgagaaccctggtgttgctgctctcaggcgctctcgccctgactcaaacctgggctgaagtgcaactggtcgaatccggaggaggactggtgcagccaggtgggtcactgcggctgagctgtgctgcatcgggcttcaatatcaaggacacttacattcactgggtgagacaagcacctggaaagggactggagtgggtggctcggatctacccgacgaatggttacacccggtacgcagattcggtgaaaggacgcttcaccatcagcgcggacacttcgaagaacacggcttaccttcagatgaattcgctcagggccgaagatactgccgtgtactactgttcgcggtggggtggcgatgggttctacgcgatggactactggggacaggggactctcgtgaccgtgtcctccgcctcgaccaaggggccttcagtgttcccgcttgccccatcctcaaagtccacctcgggaggaacggccgctctgggatgcttggtgaaagactactttccggaacctgtcactgtgtcgtggaactcaggagccctgacgagcggggtccacactttcccggccgtgctgcagtcgagcggtctgtactccctgtccagcgtcgtgactgtgccgtcatcctcactcggaactcagacctacatttgtaacgtgaaccacaaaccgagcaatacgaaggtggataagaaagtcgaaccgaagtcatgcgacaagacccacacctgcccgccttgcccggccccggagctcctgggtggaccatctgtgttcctcttccccccgaagcctaaggacactctgatgatctcgcgcactccggaagtgacctgcgttgtggtggatgtgagccatgaggatcctgaggtgaagtttaactggtacgtggatggagtggaggtgcacaatgcgaaaaccaaaccacgggaagaacagtacaatagcacttacagagtagtctcggtgctcacggtgctgcaccaagattggctcaatggcaaagagtacaagtgcaaagtgtccaataaggcactgccggcaccaatcgaaaagaccatctcgaaagccaaaggacaacctagagagccgcaggtttacacgctccctcctagcagagacgaactcactaagaaccaggtgagcctcacctgcctggtcaagggattctacccgagcgacatcgctgtggagtgggagtcaaacggtcaaccggaaaacaactacaaaactacgccgcctgtcctcgactcggacggatcgttctttctgtattcaaagctgaccgtggacaaatcccgctggcagcaaggaaatgtgttcagctgttcagtgatgcacgaagctctgcacaaccactacacccagaagtccctttccttgtcccccgga

SEQ ID NO: 15985 - DNA, 1419 bp, Artificial Sequence
  Description of Artificial Sequence: Synthetic coding sequence
atggccgtgatggcacctcggaccctggtactgctgctgtccggcgctctggccctgacgcagacctgggccgaagtgcagcttgtggaatcgggtgggggtttggtacagcctggaggctcactgagactgtcgtgcgccgcttctggattcaacatcaaagacacctacattcactgggtcagacaagcccctggtaagggactggagtgggtggcaagaatctaccctactaacggctatacgcggtacgcggactcggtgaagggacgctttactatcagcgcggatacctccaaaaacactgcataccttcagatgaatagtctcagagctgaagatactgcggtctactactgctcgcggtggggaggagacggattctatgcgatggattactggggacagggaaccctggtcacggtgtcaagcgctagtactaagggaccctccgtgtttccgctggccccgtcgtctaaatcgaccagcgggggaactgctgccttgggctgtctggtgaaggactatttcccggagccggtgactgtctcatggaattcgggcgccctgacttcgggggtgcacacgtttccggctgtgctccaaagctcgggtttgtactccctcagcagcgtggtgaccgtgccttcctcatccctcggaactcaaacttacatttgcaacgtgaaccataaaccgtcaaatactaaggtcgacaaaaaggtggagccaaaatcgtgcgacaagactcatacctgtccaccatgcccggcacctgagctgctcggaggaccatccgttttcttgttcccgcctaagccaaaggacaccctgatgatcagtcggaccccggaagtgacctgcgtcgtggtggatgtgtcacatgaagatccagaagtgaagttcaattggtacgtggacggcgtggaagtccacaatgccaaaacgaaaccgagagaagagcagtacaattccacttacagggtggtttcggtgctcaccgtgctgcatcaggactggctcaacggcaaggagtacaagtgtaaggttagcaataaagccctgccggcaccgatagaaaagaccatctcaaaggccaaggggcaacccagggaacctcaagtatacactctgcctccgtcaagggatgagctcacgaagaaccaggtgtccctgacctgcctggtcaaaggattctacccctccgatatcgcagttgagtgggaatcgaacggccaaccagagaacaactacaagactaccccaccagttctggactccgacggcagcttcttcctgtacagcaaactcaccgtcgacaagtcacggtggcagcagggtaacgtcttttcctgctcggtcatgcacgaagcactccacaaccactacacgcagaagtcgctgtcgctctcaccggga

SEQ ID NO: 15986 - DNA, 1419 bp, Artificial Sequence
  Description of Artificial Sequence: Synthetic coding sequence
atggccgtcatggcgccacgcaccctggtgctgctgctgtccggagccttagcattaacccagacttgggccgaggtgcagcttgtagaatctggaggcgggctcgttcagcccggtggtagcctgcggctgtcctgcgcagcttccgggtttaacattaaggacacttatatccactgggtgcgccaggcacccggtaagggactagaatgggtggctaggatctatccaaccaatggatacacaagatacgccgactcagtgaagggaagattcaccatcagtgccgacaccagcaagaatacagcgtatttacagatgaactccctccgtgccgaagataccgccgtgtactactgctcaagatggggcggcgacggcttttatgccatggactactggggacaggggacgctcgtgacagtaagctctgcgtctacgaaaggaccttcagtcttccccctggcgccttctagtaaatctacgtccgggggcacagccgccctgggttgtctggtgaaggattacttcccggagcctgtgactgtgtcttggaatagcggcgcgttaacctctggcgtgcatacttttcccgcagtgctacagagcagcgggctctatagcctctctagtgtggtgacggtgccatcttcctcacttggaactcagacatacatatgtaatgtgaaccacaaacccagcaacactaaagtggacaaaaaggtggagcctaagtcctgcgacaaaactcacacatgcccgccctgcccagctccagagctgttggggggcccttccgtatttctgtttccccccaaaccgaaggataccctgatgatctctcgtactccagaagtcacttgtgttgtcgttgatgtgtcacacgaggacccagaggtgaagtttaattggtatgtcgacggagtcgaggtacataatgccaaaaccaaacctagggaggagcagtataactcgacatatcgagtggtgtcagttctgacggttctccatcaggactggctcaatggcaaagagtacaagtgtaaagtgagcaataaagcattgcctgcccccatcgagaaaactattagcaaggccaaagggcagccaagggagccacaagtttacaccctccccccgtcccgagatgagctaacaaaaaaccaggtgagtttaacttgtctggtgaaagggttctatccgtccgatatcgctgtggaatgggagagcaacgggcaacccgaaaataactataagaccacgccgccggtgctggactcagacggcagctttttcctttactcaaagcttacagtcgacaagagcaggtggcagcaaggcaatgtttttagctgcagtgtcatgcatgaagcactgcacaatcactatactcaaaagtccctttctctgagccccggc

SEQ ID NO: 15987 - DNA, 1419 bp, Artificial Sequence
  Description of Artificial Sequence: Synthetic coding sequence
atggcagtcatggcaccgagaacacttgtactgcttttatctggggctctagcactcacccagacatgggctgaagttcagctggtggagagcggcggcggccttgttcaaccaggaggttctttacgccttagttgtgccgcatccggctttaatattaaagacacctatattcattgggtacgccaagcaccgggcaaaggccttgaatgggttgcgcgaatctaccctaccaatggctatacaagatatgcagatagtgtcaaaggacgctttacgattagcgccgatacatctaaaaatacagcttatttacaaatgaactcattgcgtgctgaagatacagccgtatattattgcagcagatgggggggtgatgggttctatgcaatggattattggggccaaggaacattagttacggtcagctctgcgtccacgaagggaccttccgtctttcctcttgctccttcttctaaaagtacatcgggcggtacggccgctcttggatgcttagttaaagactattttcctgaaccggtgacggtatcttggaatagcggtgcactgacctcaggcgtccatacgtttcctgctgtccttcaatcatccggtctttattctttgtcctccgtggtaacagttccgtcaagttccttaggaactcagacgtatatttgtaacgtgaaccataaaccatctaatacaaaggttgataagaaggtagaaccgaaatcatgtgacaagacacatacatgtcctccctgccctgcacctgaattgttaggcgggccatcagtgtttcttttccctccgaaacctaaggatacgttgatgattagcagaacacccgaggtcacatgcgtcgtagtagatgtaagccacgaagaccccgaggttaaattcaattggtatgtagatggtgtggaagtgcataacgctaaaactaaacctcgggaggaacagtataatagcacatatagagttgtgtctgtattaacggtcctgcatcaggactggctgaatggtaaggagtacaaatgtaaagtgtctaataaagctctgccggctccaattgagaaaacaatctcaaaagcgaaaggacagccgcgtgaacctcaagtctatacgttacccccgtcccgtgacgaactgaccaaaaatcaagtctcattaacatgtcttgtcaaggggttttacccgtcagatattgccgttgagtgggagtcaaacggacaacctgagaataactataaaacgacgcctccggtattagatagcgatggatctttctttttatattccaagttgactgtggacaagagccgctggcagcagggcaatgtatttagctgctcagtgatgcatgaagcgttacacaatcattatacgcagaaatctttatctctttctcctggc

SEQ ID NO: 15988 - DNA, 1419 bp, Artificial Sequence
  Description of Artificial Sequence: Synthetic coding sequence
atggcggtgatggccccgagaactcttgttctgcttctctcaggagcgctcgcgcttacccagacttgggcagaggttcagctggtcgagtctggcggaggcttagtccagccaggcgggagcctgcggctcagctgcgccgcttccggctttaacatcaaggatacttatattcactgggtccggcaggcgccggggaagggactcgagtgggttgcccgtatataccccaccaacggctacactcggtatgcggattctgtgaagggtaggttcacaataagtgctgacacgagtaagaataccgcttacctgcagatgaactccttgcgggccgaagataccgctgtttactattgctctcggtgggggggagacggcttttatgcaatggactattggggtcagggcaccctggtcacggtatctagtgcttcaacgaaaggaccatccgtctttcctctggcgcccagttctaaaagtacatcagggggcactgctgcattggggtgcttggttaaagactactttcccgagccagtgactgtttcatggaatagcggcgccttgacatctggagtgcatactttcccagctgttttgcagagtagtggcttatatagtttgagcagcgttgtgaccgtgccttcatcttcactgggcactcaaacctacatctgtaatgtgaaccacaagccgagtaacactaaggtggataagaaggttgaacccaagtcctgcgacaagacgcacacttgccccccgtgtccggctccagaacttctggggggcccctccgtgttcctgtttccgcccaaaccgaaagacacactcatgatcagtcgcacacctgaggtaacatgtgttgtggtcgatgtgtcccatgaagaccctgaggtcaaattcaactggtacgtggacggcgtggaagtgcacaatgccaagacaaaacctcgtgaggagcagtacaacagtacatacagagtggtatccgtcctcactgtgctgcaccaggattggctaaatggaaaggagtacaaatgtaaggtgagcaataaggctctgcccgcgccgatcgaaaagaccatctccaaagccaagggacagccaagagaaccacaggtctacaccctgcctccctcccgcgacgagcttacgaaaaaccaggtgtctctcacttgcctggttaaaggtttttatccgtcggacattgctgtcgaatgggagtccaacggccagccagagaataactataaaactactccccccgtgttggattcagacggctcctttttcttgtacagcaagctgacagtcgataaatctagatggcagcaaggcaacgtcttttcttgtagtgtgatgcatgaggcgctgcacaatcattatactcagaaatctctgtcactgtcacccggc

SEQ ID NO: 15989 - DNA, 1419 bp, Artificial Sequence
  Description of Artificial Sequence: Synthetic coding sequence
atggcagtgatggcacctcgtactcttgtgctgctgctgtccggtgccctggcactgactcaaacctgggcagaagtccaactggtagagtccggaggggggctcgtgcaacctggagggagcctcagactctcgtgcgccgcatcaggctttaacattaaagacacttacatccactgggtgagacaagctccgggcaagggactcgagtgggtggcgaggatttaccctacgaatggatacacccgctacgccgacagcgttaagggtagatttaccattagcgcagatacctccaagaacaccgcatatctgcagatgaactcgctccgggcagaagatactgcagtgtactactgtagccggtggggaggagacggtttctacgcgatggactactggggtcagggtactctggttaccgtgtcgtcggcgagcactaagggaccctcggtgtttcctcttgcacctagctccaagtccacttcgggtggcactgctgctctgggctgtctcgtgaaagattacttccctgaacctgtgaccgtgtcttggaattctggagcacttacttcgggagtgcatacgtttcctgccgtgcttcaatcgtcgggcctttactctttgtcatcagtggtcaccgtgccctcatcgtcgctgggtactcaaacctacatttgcaacgtcaaccacaagccctcaaacactaaggtggacaagaaggtcgaacctaagagctgtgacaaaactcatacgtgtcccccatgtcctgcaccggaactcctgggaggtccgtcggtgttcctttttcctcctaaacccaaggatactctgatgatctcccggactccagaggtgacctgtgtcgtggtggacgtttcgcatgaagatccggaagtgaagttcaactggtacgttgacggagtggaggtgcacaacgctaagaccaaaccacgagaagaacagtacaattcaacctatagagtcgtcagcgtgcttaccgtgctgcatcaagactggcttaatggtaaggagtacaagtgtaaagtgtccaacaaggcacttccagcaccgattgaaaaaacgatctcgaaagccaaggggcagccaagagagccacaagtgtacaccctgccaccctccagagatgaacttactaagaaccaggtcagcttgacctgtctggttaagggattctacccctccgatatcgcagtggaatgggaatcgaacggacagccagaaaacaactacaaaactactcctccagtgctggactccgacggatcatttttcctgtactcaaaacttactgtggacaaatcgagatggcagcaagggaacgtgtttagctgtagcgtgatgcatgaggcacttcataatcattacacccagaagagccttagcctgagcccagga

SEQ ID NO: 15990 - DNA, 1419 bp, Artificial Sequence
  Description of Artificial Sequence: Synthetic coding sequence
atggcagtgatggccccccgcacgcttgtgcttctgcttagcggtgccctggccctgacccagacctgggcagaggtgcaactcgtcgaatcaggtggtggactggtgcagccaggaggctcgctgcggctgagctgtgcagcatcgggattcaacattaaggacacctacatccattgggtcagacaagcaccaggaaagggtttggagtgggttgcccgtatttaccccactaatgggtacaccaggtatgcagatagcgtgaaaggccggtttaccatttcggcagacacttcgaagaatactgcttacttgcagatgaattcgcttagagcagaagatactgccgtgtactactgcagcagatggggaggagacggtttttacgcaatggattattggggtcaaggaacgcttgtgaccgtctcctcagcttccaccaaagggcccagcgtgtttccgctggctccttcgtccaagtcaaccagcgggggtactgccgcacttggatgtctggttaaggactattttcctgaacctgtgactgtgtcatggaactcgggagcacttacttccggggtgcatactttcccagcagtgctgcagtcatccgggctttactctcttagctcggtcgtgactgtgccatcctcctcactcggaacccagacttacatttgcaacgtgaaccataaacctagcaataccaaggtggacaagaaggtcgaacctaagtcgtgtgataaaacccatacctgtccgccttgtccggctccggagctgcttggaggtccttctgtgtttctttttccaccaaaacccaaagatacccttatgatatcccgtactcctgaagtgacttgcgtggtcgtcgatgtgtcgcatgaagatcctgaagtcaagtttaactggtacgtcgatggagttgaagtgcataatgcaaagactaaacctagagaggaacaatacaattcgacctaccgagtggtcagcgtcctcactgtcctgcaccaagattggctcaacggcaaagaatacaagtgtaaggtttcaaacaaggctctgccagcaccaattgaaaagactatctcgaaggccaagggtcaacctcgtgaaccacaagtctacactctgccaccaagcagggatgaactgactaaaaaccaagtgtcccttacctgcctcgtcaagggcttttacccaagcgatatcgccgtcgagtgggagtcaaacggtcagcctgaaaacaattacaagaccacgccccctgtcctggattcggacggttcatttttcctgtactcgaaacttaccgtggacaaatccagatggcaacagggaaacgtgttcagctgtagcgtgatgcatgaagcactgcataatcattacactcaaaagtcgctctcgctgtcgcctggt

SEQ ID NO: 15991 - DNA, 1419 bp, Artificial Sequence
  Description of Artificial Sequence: Synthetic coding sequence
atggcagtcatggcacctcgcactctggttctgctgctgtcgggtgctctcgctctgactcagacgtgggcagaagtccagctcgttgaaagcggcggcgggctcgtgcagccaggtggcagcctgcgtctgagttgtgcagcgtccggttttaatattaaggacacttacatccactgggtccgtcaagcccctggcaagggtttagaatgggtggcacgaatttacccgaccaatggttacactcgctatgcggatagcgtcaagggccgattcactatcagcgcggacaccagtaagaatacggcttaccttcagatgaacagcctgcgcgcggaagatactgcagtttattattgttcacgctggggtggagacggcttctacgccatggattactggggccaaggcaccctggttactgtctctagcgctagcactaaaggtccgtcggtattccccctcgcgccgtcctctaagagcaccagcggcggcaccgccgcgctaggctgtcttgtcaaggattacttcccagagcctgtcaccgtgtcttggaattctggcgcgcttacgagcggagtccatacctttcccgccgtgctgcaaagcagcggtctttactcattgagctcggtggttaccgtacctagtagcagtttgggtacccagacctacatctgcaacgtaaaccataaacctagtaacaccaaggttgacaagaaagtggaacctaagtcgtgtgataaaacacatacttgcccgccgtgtcccgcccctgagctgctgggcggccccagcgtgtttctgtttccacctaagccaaaagacacgctgatgatcagccgcaccccggaagttacctgtgttgtggttgacgtgagccacgaggatccagaagtgaaattcaactggtacgttgatggtgtagaagtgcacaacgctaaaactaaaccgcgcgaagagcagtacaactctacgtaccgggtggttagtgttttgactgtcttgcaccaggactggctcaacggtaaggaatataaatgcaaagtgagcaacaaagcgctgcctgccccaattgaaaaaaccatctctaaagcaaagggtcagccacgcgagccacaggtatacactctgccgccttcccgcgacgagctcactaaaaatcaagtcagcctcacctgtttggtcaagggcttctatccctccgacatcgctgtggaatgggagagcaacggtcagcccgaaaataattacaagactacgccacctgtgctcgacagcgatggtagcttctttctgtatagcaaactgacagtggacaaaagccgctggcaacagggtaacgtgttcagctgttctgttatgcacgaggcattgcacaatcactacacacaaaaaagcctgagcctgtctccaggg

SEQ ID NO: 15992 - DNA, 1419 bp, Artificial Sequence
  Description of Artificial Sequence: Synthetic coding sequence
atggccgtaatggcgcctagaaccctggtccttctcctgtccggagcacttgcacttactcagacctgggcagaggtgcagcttgtggaatcgggcgggggactggtgcagcctgggggttcgcttcggctcagctgtgcagcgtcgggtttcaacatcaaggatacttacattcattgggtgagacaagctcccggtaaaggacttgaatgggtggcgcgcatttaccccaccaacggttacactagatacgccgactcggtgaagggccgattcactatttcagccgacacttccaaaaacactgcatacctgcagatgaacagcctgcgagcggaagataccgctgtttactactgcagcagatggggcggcgatggattttacgccatggattattggggacagggaaccctcgtgaccgtgtcctcggcgagcaccaagggaccaagcgtgtttccactcgcaccctcgtcgaagtcgaccagcggaggaaccgcagcactgggatgtctcgtgaaggactactttccagagccagtgacggtgtcttggaattcgggagcacttacttcgggtgtgcatactttccccgcagtgcttcagtccagcggtttgtactccctcagctcggtggtgactgttccttcgtctagcctgggaacccagacgtacatttgtaacgtaaaccacaagccgtcgaataccaaagtggataagaaggtcgaaccaaagtcgtgtgataagactcatacgtgtccaccatgtcctgcccctgaactgctggggggaccgtcggtgttcctgtttcctcccaagccgaaagatacccttatgatctcacggacgccggaagtgacctgcgtggtggtggatgtgtctcatgaggacccagaagtcaagtttaactggtatgtggatggtgtcgaagtgcataatgccaagaccaaacctagagaggagcagtataactcaacttaccgtgtggtgtcagtgcttactgtgctgcatcaagactggctgaacggtaaggagtacaagtgtaaagtcagtaacaaggcacttcccgcacctattgaaaaaactatttcaaaggcaaagggtcaaccccgggaaccgcaagtgtacactcttcctccatcgagagatgaactgaccaaaaaccaagtctcccttacctgccttgtcaagggcttttacccatctgacattgcagtcgagtgggaatcgaacggccaacctgagaacaattacaaaactactcctcctgtgctggattcggatggttcctttttcctttactcgaagttgacggtggataagtccaggtggcaacagggtaatgtcttttcgtgtagtgtgatgcatgaagcgctccataaccactacacccagaagtccctgtcgctctcgccaggg

SEQ ID NO: 15993 - DNA, 1419 bp, Artificial Sequence
  Description of Artificial Sequence: Synthetic coding sequence
atggctgtcatggctcctcggacgctggtactgctgctcagcggggcccttgctcttacacagacctgggcggaagtgcagcttgtggaatcaggagggggattagtccaacctggtgggagtctccgcctgtcctgtgcggctagtggattcaatatcaaggacacctatatacattgggtacgacaggcacctggaaagggactagagtgggtcgcccgaatatatcctaccaacggctacactagatacgctgatagcgtgaagggtagatttacaataagtgctgataccagcaaaaatacagcttatctccaaatgaactccctccgcgccgaagacaccgccgtgtactattgttcaaggtgggggggagatggcttttacgctatggactactgggggcagggtactctggttaccgtatcctccgcctctactaaaggcccaagtgtctttcctctggcgcctagctctaaaagcacctcgggcgggacagcagctctcgggtgcttagtaaaagactattttcccgaacctgtgactgtgagttggaactcaggagctctgacttccggggtgcacacatttcctgctgtactgcagtcctcaggattgtatagtttgtctagcgtggtcaccgtgccaagtagctctctaggaacacagacttacatttgtaacgtgaaccacaagcctagtaacacgaaggtagacaagaaggtggaacccaagtcatgcgacaaaacccatacatgccctccgtgccctgcgcctgagcttctgggtgggccttcagtatttctgttccctccaaaacccaaggataccctgatgatttctcggacacctgaggttacctgcgtggtcgtggacgtgagccacgaggaccctgaagttaagtttaactggtatgtggacggagtagaggtccataatgctaagactaagccacgggaggaacagtacaactccacttatcgagtggttagtgtcctcactgtcctgcaccaggactggctgaatggcaaggaatacaagtgcaaggtctctaacaaggcactccctgctcctattgaaaaaactattagcaaggcgaaaggccaaccaagggaacctcaggtttatacattgccaccgtcccgggatgaacttacaaagaaccaggtctctcttacgtgccttgtgaaaggcttctacccatccgatatcgcagtggagtgggagtctaacgggcagcccgaaaacaattacaagaccacgcctcccgtgttggacagtgacgggagtttttttctgtacagtaaactgacagtggacaaatcacgatggcaacaagggaacgttttctcttgcagcgtgatgcacgaagccctgcacaaccattatacccagaaaagcctgtctctgagtcctggc

SEQ ID NO: 15994 - DNA, 1419 bp, Artificial Sequence
  Description of Artificial Sequence: Synthetic coding sequence
atggcggtgatggcacctaggactttggtgctcctgcttagcggcgcgctcgccctcacccagacttgggccgaggttcaacttgtggagagcggcggagggctcgtccagccaggcggaagtctgagactttcgtgtgccgcatcaggctttaacatcaaagatacctacattcattgggtgcgccaagctccgggaaagggattggaatgggtggctcgtatctacccgaccaacggttacacccgttatgcagacagcgtgaagggccggtttacgattagcgcagatacttcgaagaatactgcatacttgcaaatgaattcgcttcgggcggaggatactgctgtgtactactgttcgcgctggggtggagacggattttacgcaatggactactgggggcaaggcacccttgtgacggtgagcagtgccagcaccaaaggaccatcagtgtttccgcttgcccctagctccaagtcgacctccggtggcaccgcagcgcttgggtgcctcgtgaaggattacttccctgaacctgtgactgtgtcatggaattcgggagcacttaccagcggggtccatacctttcccgccgtcctccaatccagcggactgtactcgctcagctctgtggtcactgtcccttccagctccctgggaacccaaacctacatctgtaatgtcaaccataaaccttcgaacactaaagtggataagaaagtggaacctaaatcgtgtgataagacccacacctgtcctccttgtccagcacccgaactgcttggaggaccatccgtgtttctttttcctcctaaaccgaaggacaccttgatgataagccggactccagaggtgacttgtgtcgttgtggacgtgtcccacgaagatccggaggtgaagttcaactggtacgtcgacggagtcgaagtgcacaacgccaagactaagcctagagaagaacaatacaattctacctatcgggtcgtgtcggtgctgacggtgctccaccaggactggcttaacggcaaagagtacaaatgcaaggtgtcgaataaggccctccctgcaccaatcgaaaagactatttccaaggccaaaggtcaaccacgtgaaccacaggtgtacactcttccaccaagccgggatgagcttactaagaatcaggtttcgcttacgtgcctggtcaaaggcttttatccttcggacattgcagtggaatgggagagcaacggtcagcctgaaaacaattacaaaactactccacctgtgctggatagcgacggcagcttcttcctttactccaagttgaccgtggacaagtcgcgatggcaacaggggaacgtcttttcgtgctccgtgatgcatgaagcacttcataaccattacacgcagaagagcctttcgctttcgccagga

SEQ ID NO: 15995 - DNA, 1419 bp, Artificial Sequence
  Description of Artificial Sequence: Synthetic coding sequence
atggcagtcatggccccccgtactctggtgcttttgcttagcggtgcattggccctgacgcagacctgggcagaagtccaactcgtggaaagcggagggggtcttgtccaacctgggggatcgcttcgactttcgtgtgcagccagcggtttcaacattaaagatacctatattcattgggtccgacaggcgccaggtaagggacttgagtgggtggcacgaatttaccctactaatggctacactcggtacgcagacagcgtgaaagggcgctttaccatttcagcagacacgtccaaaaacactgcctacctccagatgaacagcctccgggcagaagataccgctgtctattactgttcgagatggggaggggatggattctatgcaatggattactggggtcagggaactctggtcactgtctcaagcgcaagcactaagggacccagcgtctttccactggccccctcctccaagtctacttccgggggcacggcagcgctcggatgtcttgtgaaggattactttccagagccagtcaccgtctcatggaattcgggggcacttacctcgggtgtgcatacttttcctgcagtgttgcaatcaagcggtctgtacagccttagcagcgtggtcaccgtcccaagctcctctctgggtactcagacctacatctgtaacgtgaatcataagcccagcaacaccaaggtggataagaaggtggagcctaaatcgtgcgacaaaactcatacttgtccaccctgtccagctcccgagcttttgggtggaccgagcgtgtttttgtttccgcctaaacctaaggacacgcttatgatctcgagaactcctgaggtcacttgtgtggtggtcgatgtgtcgcatgaagatccagaagtgaagttcaattggtacgtggatggagtggaggtccacaacgccaagactaaacctagagaagaacaatacaactcaacttacagagtggtgagcgtcctcactgtgctgcaccaagattggctcaacggtaaagaatacaaatgcaaagtgtccaacaaagcactgccggccccaattgaaaagaccatttccaaggccaagggccaacctcgcgaacctcaagtctataccctccctccttcccgcgatgaactcaccaagaatcaagtctcccttacctgtctcgtgaagggcttttacccttccgatatcgcagtggaatgggagtcaaacggacaaccagagaataactacaagaccacccctcccgtcctggattcggatggttccttcttcctctactcaaaactgaccgtggataagtcgcggtggcagcagggcaatgtgttttcctgcagcgtgatgcatgaggcacttcataatcattacactcaaaagtccctttcgctgtcgccgggc

SEQ ID NO: 15996 - DNA, 1419 bp, Artificial Sequence
  Description of Artificial Sequence: Synthetic coding sequence
atggcagtcatggcccctcggactctggtgcttctgctgtccggggctctggctctcactcagacctgggctgaagtgcagttggtggagagcggaggcggcctcgtgcagccaggggggagcttgaggctcagctgtgccgcatctgggtttaatatcaaggacacctacatccactgggtccgacaagctcccggcaaagggctggagtgggtcgctcgcatctacccaactaatggttataccaggtacgcggactctgtgaagggacgattcactataagtgccgacacgagtaaaaatacagcctacctccagatgaacagcttgcgagccgaagacacggctgtctactattgctcacggtggggtggtgacgggttttatgccatggactattggggccagggaactctggtgaccgtcagttccgccagcacaaaggggccttccgtgttccctctggctccctcctccaagagtacatctggcggcaccgccgctttgggttgcttggtgaaagattattttccagaacctgttaccgtgtcttggaactcaggtgcccttacctcaggtgtgcatacatttcctgccgtgctgcagtctagcggcctgtactctctcagcagcgtcgtgaccgtgccgagcagtagtctcggaacacagacctatatatgcaacgtgaatcacaagcccagcaacactaaagtagataagaaggtggagcccaaatcatgtgataaaacacacacctgtcccccctgtcctgctccagagctgctcgggggacccagcgttttcctgtttcctcccaagccaaaagacacactgatgatctccaggacacccgaggtaacatgcgtggtggttgatgtatctcacgaggacccagaagtcaaattcaactggtatgtcgatggagttgaggtccacaacgctaagaccaaaccaagagaagagcaatataattccacatacagggtggtgtccgtattgacggtgctgcatcaggattggctgaatggaaaggagtacaagtgtaaagtgtctaacaaagccctgcccgcccctattgaaaagaccataagtaaggccaaaggccagccccgggagcctcaggtctacactctgccaccttctcgggacgaattgactaagaaccaggtctccctgacatgccttgtgaaaggattttacccctcagatatcgccgtggagtgggagtctaatggccagcctgaaaacaattataagactactcctcccgtgcttgatagcgatggcagctttttcctgtactctaagctgactgtggacaagagccggtggcagcaaggcaatgtattcagctgttctgtcatgcatgaggcccttcataaccactatactcaaaagtcactctccctgtcaccaggg

SEQ ID NO: 15997 - DNA, 1419 bp, Artificial Sequence
  Description of Artificial Sequence: Synthetic coding sequence
atggccgtgatggctcctcgcacactcgttctcttgctcagcggagctttagccctgacccagacctgggcggaagtccagctagttgagtcaggcggagggctggttcagcccggcggttccttgcgtctgtcctgtgctgcgagcggattcaacataaaagacacctatattcactgggttaggcaagcccctggcaaaggcctcgagtgggtggcgcgcatatacccaacaaatggctatacccggtacgcagactcggtcaagggtcgattcactatctctgccgataccagtaagaataccgcctatctgcagatgaatagccttagagccgaggacaccgccgtctattactgtagtcggtggggaggggacggcttctacgctatggactattggggacagggcacactggtgacagtgtcctcagctagcactaaaggaccgagcgtgtttcccctggcaccctcttccaaatccacgagcggcggcacagctgcgctcggatgcttggtcaaggactatttccccgagcctgttacagtgagttggaactcaggagccctcacttcgggggttcatacatttccagcagtgttgcagtcgtcagggctttatagcctgtcaagtgtagtgaccgttccgtcctcttcactgggaacgcagacatatatctgcaacgtaaaccacaagccatctaacaccaaagtggacaagaaagtggagcctaagtcttgtgataaaacccacacatgccctccgtgtcccgcgcccgaattgctgggcggcccgtccgtgtttctcttcccacctaagcccaaagataccctgatgatatccagaacgccagaggttacctgcgtcgtcgtagatgtgtctcatgaagatcccgaagttaagttcaattggtatgtggatggagtggaagtgcacaacgccaagaccaagcctcgcgaggagcaatataatagcacttatcgggtggtgtctgtgctgaccgttctgcaccaggactggctgaatgggaaggagtataagtgtaaggtgtcaaataaggcgttgccggcaccaatcgagaaaacaatctccaaggctaagggccagccccgggaaccacaggtctacactcttccgccatccagggacgagctgaccaagaaccaggtctcactgacttgtctggtcaaaggcttctacccttcagacatagcagtcgagtgggaatccaacgggcaaccggaaaacaactataagaccacacccccagtgctcgacagcgatggatccttctttctgtatagtaagctgaccgtggacaagagcaggtggcagcaggggaatgtgttcagttgctccgtgatgcacgaggcgctgcataatcactatacccagaaatctttgagcctttcgccgggc

SEQ ID NO: 15998 - DNA, 1419 bp, Artificial Sequence
  Description of Artificial Sequence: Synthetic coding sequence
atggccgtgatggcacctaggacactcgtcctgctccttagtggagcattagcactgacccaaacctgggccgaagtgcagcttgtggaaagcggcggcgggcttgtgcagcccgggggaagcctcagactgtcttgtgctgcttctggatttaacattaaggacacctacatccactgggtgaggcaggcaccaggcaaaggcctcgagtgggtggcaaggatctacccgactaatggatacaccaggtatgcggactctgtcaagggaaggtttaccatctccgctgatacatcaaaaaatactgcctacctgcagatgaactctcttagagcagaggatacagcagtttactactgtagccgctggggaggagacggattctacgcaatggactattggggccagggaactctcgtcaccgtttcctcagcctcgactaaaggaccaagcgtgtttccgctagcaccctcctctaaaagcaccagcggcgggacagcggctcttggctgcctggtcaaagattatttcccagagccggtcacagtcagttggaattctggcgcgttgactagtggagtgcacacgttcccagctgtcctgcagtcttctggactatattctcttagttcggtcgtaaccgtgccaagtagcagcttgggaactcagacatatatttgtaacgttaatcacaaaccctcaaataccaaagttgataaaaaagtcgagccgaagtcctgcgataagactcacacttgccccccatgtccggcaccggagttacttggagggccttctgtcttcttgtttccaccaaaaccaaaagatacacttatgataagcagaactcccgaggtcacttgcgtcgtcgtggatgtgtctcacgaggaccctgaggttaaatttaactggtacgtggatggagtggaagtccacaacgccaaaactaagcctcgggaagaacaatacaactcaacctatcgggtggtctcagtacttacggtgctacaccaggactggctgaacggaaaagaatataagtgcaaagtgagcaacaaggctctccccgcacctatcgaaaaaacaatctctaaagcaaaaggccagcctcgcgagccacaggtctatacattgccccctagcagggacgagctgaccaagaatcaggtcagtctcacctgtctggtcaaaggattttacccatccgacatcgcggtggaatgggaaagcaacggccagccggagaacaattacaagacaacccctccagtgctcgattcagacggctctttctttctgtacagtaagcttacagtcgataagtctagatggcagcaagggaatgtgttcagctgttctgtcatgcatgaggcgcttcacaaccactacacccagaagtcactctcattgagccctgga

SEQ ID NO: 15999 - DNA, 1419 bp, Artificial Sequence
  Description of Artificial Sequence: Synthetic coding sequence
atggccgtaatggctccccgtactttggtgcttttgctttcaggcgccctggctcttacacagacctgggctgaggttcaacttgtagaatctggagggggtcttgtgcagcctggggggagcctgagactcagttgtgctgcaagcgggtttaacattaaggatacatatatccattgggttcggcaggctcctggtaagggtctggaatgggttgccaggatataccctacaaatgggtataccagatacgccgactctgttaagggtcgattcacgattagtgccgacacttcgaagaacactgcgtacttgcaaatgaactcattgcgtgcagaggatacagcagtttattattgttcgcgatggggtggggacggtttttacgctatggactattggggccaaggtacgcttgtgactgtcagcagtgcatctactaaaggaccctcggtctttccacttgctccgtcatctaagagtacgtccggaggtactgccgctttgggttgtctcgtcaaggattacttccccgagcctgttaccgtttcctggaattccggggctttgacttccggtgtgcacacttttccagctgttctccaaagttctggattgtacagcctttcttctgttgtgaccgtcccgtcaagttctcttgggactcagacctacatatgtaacgttaaccacaaaccctcgaataccaaagtagacaagaaggtcgaaccaaagtcttgcgacaagactcatacttgcccgccatgtcccgccccagagctattgggagggccttccgttttcttgttcccccctaagccaaaagacactcttatgatatcaagaacacctgaggttacatgtgtcgtcgttgacgtgagtcatgaagatccagaagtgaaatttaactggtacgttgatggtgttgaggttcacaatgccaagactaaaccgagagaagaacaatataattccacttacagggtagtttcggttttgaccgtactccaccaagactggttgaacggtaaggaatacaaatgtaaagtgagcaacaaagctctcccagctccgattgaaaaaacgatcagtaaggcgaaggggcagcctcgtgaacctcaggtttatactcttccaccttctcgtgatgagctcactaagaaccaagtgagtcttacttgcttggtaaaaggtttctatccatcagatatagccgttgagtgggagagtaatggtcagccagagaataattataagacgactccacctgttcttgattcagacgggtcctttttcctttactcaaaactgacagtggataagagtcgatggcagcaaggtaatgttttcagctgtagcgtgatgcatgaggcactccacaaccactatacacaaaaatctctatctctatcccctgga

SEQ ID NO: 16000 - DNA, 1419 bp, Artificial Sequence
  Description of Artificial Sequence: Synthetic coding sequence
atggctgtcatggctcctcgcacattggtacttctactcagtggtgccctcgccctgacccagacgtgggctgaggtacagcttgttgagagcggagggggcctggtgcagcccgggggcagcttaagattatcatgtgctgcaagtggcttcaatatcaaggacacatatatccactgggtgcgacaggcccccggcaagggattggagtgggtggcgcgcatttatccaaccaatggttacactcgatatgcagattccgtgaaaggccggttcaccatctcagcggatacatctaaaaataccgcctatctgcagatgaatagcctgagagcggaggacacagccgtgtactactgctcacggtgggggggggacgggttctacgccatggactactggggacagggcaccctggtgacagtgagttcagccagtacgaagggcccgtctgtatttcccctagctccatcgagcaaaagcacatctggaggtactgccgccctgggatgcctcgtcaaggattacttcccggagcctgttacagtttcatggaactcaggggccttaacatctggcgtccatacatttcctgctgtgttgcaatcatctgggctgtattcactcagtagtgtggtgactgttccgtcatcttccctgggtactcaaacatatatttgtaatgtgaaccacaagccgtctaacacaaaggtggacaagaaggtcgagcccaagtcttgtgacaaaacacatacctgtcctccctgtccggcacctgagttactgggcggaccctcagtgtttctttttcctcccaaacccaaggatacactgatgatctcacggacccccgaggttacttgtgtggttgtcgatgtctctcacgaagaccccgaagtgaaattcaactggtacgtggacggtgttgaggtgcacaacgccaaaactaagcccagagaagaacagtacaacagcacttaccgtgtcgtcagcgtgctgacagtgctgcatcaggattggctgaatggcaaggaatataagtgtaaggtctccaacaaggctctgcccgcacccattgagaaaaccatttccaaggcaaagggacagccaagggagccccaggtttacacacttcccccaagtcgcgatgagctgaccaaaaaccaggtatcactgacttgcctggtgaaaggcttttatccaagcgacatcgcagtggaatgggagtccaacggtcagccagagaataattacaagacaacacccccggtgctggattcagatggatctttttttctctacagcaagctgacagtagacaagtctagatggcagcaagggaacgttttctcctgttcggtgatgcatgaggcgctccacaatcactatacccagaagagcctttcactttctcccggt

SEQ ID NO: 16001 - DNA, 1425 bp, Artificial Sequence
  Description of Artificial Sequence: Synthetic coding sequence
atggccgtgatggcgccgcgcaccctcgtgctgctgctctctggagccctggcgctgactcagacctgggctcaggtgcagctgcagcaaccgggagcagagctggtgaaaccgggagcttccgtgaaaatgtcgtgtaaggcaagcggatacaccttcacgtcatacaatatgcattgggtgaagcagacgccaggccgcgggctggaatggatcggcgccatatatccaggcaacggggatacctcctataaccagaagtttaaaggcaaggccactctgaccgcggacaagtcctcctcgactgcgtacatgcaactgtcgtcgctgaccagcgaagatagcgcggtctactactgcgctcggtctacttactacggcggcgactggtacttcaacgtgtggggggccggaactaccgtcactgtgtccgcggccagcaccaagggaccgagcgtgtttccgttggcgccttcgtcgaaatcgacctcgggcggaaccgccgccctgggatgccttgtcaaggactacttccccgaaccggtgactgtctcgtggaattctggcgcactgacttcgggcgtgcacacgtttcctgccgtgctccaatcgagcggcctctattccttgagctccgtcgtgactgtgccgtccagcagcctcggaacccagacctacatctgtaacgtcaaccataaaccgtccaacactaaagttgataagaaggtggaaccaaagtcatgtgataagactcacacctgcccgccgtgcccagcaccggaattgctcggaggtccgtcggtgtttctctttccacccaagccgaaagatactctgatgatctccagaactcctgaggtgacttgtgtggtggtcgacgtgtcacacgaagatccggaggtgaagttcaactggtacgtggatggtgtcgaggttcacaatgcaaagactaagcctcgcgaggaacagtacaactcaacttacagagttgtgtccgtgctcaccgtgctccaccaagattggttgaacggtaaggaatacaagtgtaaagtctccaataaggctctccccgcgccgatcgagaaaaccatctctaaagccaagggacaaccgcgcgagcctcaggtctacactctgccgccttcccgggacgaactcactaagaaccaagtgtcgctcacctgcctggtgaagggcttctacccttcagacatcgcagtcgaatgggagtccaatggtcagccggagaataactacaagaccacccctccggtcctcgactcagatggatccttcttcctgtactcgaaactcacggtggacaaatcacgatggcagcaaggaaacgtgttctcctgctcggtcatgcatgaagcgctgcataaccattacacccagaagagcctgtcactgtccccaggcaag

SEQ ID NO: 16002 - DNA, 1425 bp, Artificial Sequence
  Description of Artificial Sequence: Synthetic coding sequence
atggcagtcatggcccctcgcacactggtgttgctactgtcgggagccttggccctcactcaaacatgggctcaggtgcaactacagcagcctggggcagagctggtaaagccaggagcttccgttaagatgagttgcaaggcgtcaggatatacttttacaagttataatatgcattgggtcaagcagacccctgggaggggactagagtggatcggagctatctatccaggcaatggagatacatcctacaaccaaaagttcaagggcaaagcaaccctgacagccgacaagtcctcttccactgcttacatgcagctgtcatcccttacctcggaagattcggccgtgtactactgtgcccgcagtacatactatggaggcgactggtatttcaacgtgtggggagccgggacgaccgtgaccgtcagcgccgcatccacaaagggaccgagcgtcttccctttggcccctagctccaagtctaccagtggggggacggccgctctgggatgtctggttaaggactattttcccgaacccgtgaccgtctcttggaactccggggcactcactagtggagtgcacactttcccggccgtcttgcagtcaagcggactctactctctgtcttctgtcgtgacggttcccagctctagcctggggacccagacttacatctgtaatgtgaatcataagcccagcaatactaaggtggacaagaaggtggagccgaaatcttgcgacaagacacatacctgcccgccgtgtccagcccctgagctgctgggcggtcccagcgtgtttctctttcccccaaagcctaaggatacacttatgattagccgaactcctgaagttacctgcgtcgtcgtggacgtgagtcatgaagaccctgaagtgaaattcaactggtacgtggatggggtggaggtccataacgccaagacaaaaccacgtgaagaacagtacaactccacttatcgggttgtgagcgtcctgaccgtgctgcaccaggactggctgaatggtaaggaatacaagtgcaaggtttctaacaaagctctccctgccccaatagagaagaccatctctaaggccaagggccaacctcgagagccccaggtgtacacattgccccccagtagggatgagctgaccaagaaccaggtttcgcttacttgcttggtgaagggattctatccttctgacatcgccgtggaatgggagtcgaacggccaacctgagaataactacaagacaacaccgcccgtattggattccgatgggtcattctttctttatagtaagctgacagtagataagtcccgatggcagcaaggcaatgtcttctcctgttctgtcatgcatgaggcacttcacaatcactatacacagaaatcattgagcctgtctcccggtaaa

SEQ ID NO: 16003 - DNA, 1425 bp, Artificial Sequence
  Description of Artificial Sequence: Synthetic coding sequence
atggccgtcatggccccgcggacccttgtgcttctcctttccggggcgcttgccctgactcaaacctgggcgcaggtgcagctgcagcagccgggtgcagaactggtgaaacctggagcctcggtaaagatgtcgtgtaaggccagcgggtacacttttacctcgtacaatatgcactgggtgaaacaaacccccggacgcggtctggagtggatcggcgcaatctacccgggaaatggagacacgtcgtacaaccagaaattcaagggaaaggctactctgaccgcggacaaatccagctcgaccgcttacatgcaactgtcctctcttactagcgaagatagcgcagtgtactactgtgcacgatcgacctactacgggggagactggtactttaacgtgtggggagcaggcactacggtcaccgtgagcgccgccagcaccaaaggaccctcggtgttcccactggccccgtcgagcaagtccacgtcagggggaaccgcagctctcgggtgcctggtgaaggactacttcccagagccggtcaccgtgtcatggaactccggtgccctgacttcgggggttcacacttttccagctgtcctccagtcgtccggcctgtactcgctgtcgtcagtggtcaccgtgcccagctccagcttgggaactcaaacttacatctgtaatgtcaaccataagccatcgaacaccaaagtcgacaaaaaggtggagcctaagtcctgcgataaaacccatacctgccctccatgcccggcaccggaactgctgggcgggccgtcggtctttctctttccgccaaaaccaaaggatacgttgatgatctcccgcacccctgaggtgacttgtgtggtcgtggatgtgtcgcatgaggacccggaggtcaagttcaattggtacgtggatggtgtggaggtccataatgccaagactaagcctcgcgaagaacagtacaactccacctaccgggttgtctcggtcttgaccgtgctgcaccaagactggttgaacggaaaggaatacaagtgtaaggtcagcaataaggctctgcctgcgcccatcgaaaagactatcagcaaagccaagggacagcctagggagccgcaagtctacaccctccccccatcgagggatgaactgactaagaaccaggtgtccctgacctgtctggtgaagggattctacccctcggacatcgccgtggagtgggagtcaaacggtcaaccggagaacaactacaagaccacccctccggtcctggactccgatgggtcattcttcctgtatagtaaactcactgtcgacaagtctcgctggcagcaggggaacgtcttttcgtgctcggtgatgcatgaagccctgcacaatcactacactcagaagtccctgtcgttgagcccgggaaag

SEQ ID NO: 16004 - DNA, 1425 bp, Artificial Sequence
  Description of Artificial Sequence: Synthetic coding sequence
atggccgtgatggccccaaggactcttgttctactcctgtctggggctctcgccctcacacagacatgggcccaggtgcagctccagcagcccggggctgaacttgttaaacctggggcctccgtcaaaatgagttgtaaagcttcggggtatactttcactagttataatatgcattgggtcaaacagacacccggaagagggctggaatggattggagcaatctatccagggaacggggatacttcttataatcagaaatttaaaggaaaagcaactcttactgctgataaatcttcctcaactgcttacatgcagctctcttccctgacatcagaagattctgctgtctactattgcgcccggtctacttattatgggggggattggtatttcaatgtgtggggggccgggacaactgtcacagtgtcggctgctagtacaaaagggccatctgtattcccactagcccccagttcaaaatctacttcaggaggaactgccgctctagggtgcctggtgaaagattactttccagaacccgtaacagtctcctggaattctggggccctgacatccggagtacacacttttcccgcagtgctgcagagtagtggactatacagtctttcatctgtggtcactgtgccctcatcatccctcggaactcagacatatatctgcaacgtaaatcataaaccaagtaacacaaaagtagataaaaaggtggagccaaaatcttgcgataaaactcacacatgccccccttgccccgcacctgaactcctcgggggaccctccgtctttctatttcctccaaaacccaaagatacactcatgatatcccgaacgccagaagtgacatgcgttgtggtcgatgtgtcccacgaagatcctgaagtgaaattcaactggtatgtggatggagtggaagtccacaacgcaaagactaaaccccgcgaggagcagtataacagtacttatcgagttgtgtcagtattgactgtgcttcatcaggattggttaaatgggaaagaatacaaatgcaaagtgtctaacaaagctttacccgcccctatcgaaaaaacaatatcaaaagcaaaaggacagccgagagagccccaggtatatactttacccccatcacgcgatgaactgactaaaaatcaagtgagtctcacttgcctcgtgaaaggattttatcccagtgatatagctgtggaatgggaatctaacgggcagccagaaaacaactacaaaactacacctcctgtgctggactccgatggatcattcttcctttactccaagctcacagtcgataaaagtcggtggcagcagggaaacgtattctcttgttccgtaatgcacgaagccttacacaatcattatacacagaaatcactgtcacttagtcctggaaaa

SEQ ID NO: 16005 - DNA, 1425 bp, Artificial Sequence
  Description of Artificial Sequence: Synthetic coding sequence
atggcggttatggctccgcgcactctcgttctgcttctgagcggagcacttgctctcacccagacctgggcacaggttcagctgcagcaacctggcgccgaactcgtgaaacctggcgcgtcggtgaagatgtcgtgcaaagcgtcgggatatactttcacttcgtacaatatgcactgggtcaaacaaactccgggcagagggctcgaatggattggtgcgatctacccgggaaatggagatacgagctacaatcaaaagtttaaaggaaaagcaaccctgacggccgacaaatcctcctccaccgcctacatgcagctctcgagcctcactagcgaggatagcgccgtctactactgcgccaggagcacttactacggaggagactggtacttcaacgtttggggtgccgggactactgtgaccgtgtcggccgcctcaaccaaaggaccaagcgtctttccccttgctccatcatcaaagtcaacctcggggggaaccgctgctctgggctgtctggtcaaggactacttcccggagccagtgactgtgagctggaacagcggtgctctgactagcggagtgcacactttcccggctgtgctgcaatcttcgggcctgtactcactgtcatccgtggtgaccgtcccatcatcgtcgctgggaacccagacgtacatttgcaacgtgaatcacaagccatccaataccaaggtcgacaaaaaggtggagccaaagtcctgtgacaaaacgcatacctgccctccttgtcctgctcctgaacttctgggaggcccgtcggttttcctgttcccgccgaaaccgaaggacacgctgatgatctccagaaccccagaagtgacttgcgttgtggttgacgtgagccacgaggacccggaggtgaaattcaactggtatgtggatggagtggaggtccataatgccaagactaagccccgggaggaacagtacaactcgacttatcgggtggtgagcgtgctgactgtcctgcatcaagactggctcaacggcaaagaatacaagtgcaaggtgagcaacaaggcactgcctgccccgatcgagaaaaccatctccaaggcaaagggccaaccacgcgagccgcaggtgtacacccttccaccttcacgggatgagcttacgaagaaccaggtgtcgctcacttgcttggtcaagggattctacccaagcgatatcgcggtggaatgggaatcgaacggacaacccgaaaacaactacaaaaccactccgcctgtcctggatagcgacggttcgtttttcctctactcgaagctgaccgttgataagagcagatggcagcagggtaatgtcttttcatgcagcgtgatgcacgaagctctgcacaatcattacacccagaagtctctctccttgagccccggcaag

SEQ ID NO: 16006 - DNA, 1425 bp, Artificial Sequence
  Description of Artificial Sequence: Synthetic coding sequence
atggcagtgatggccccgcgcaccttagtgttgctgctgtcaggcgctctggctctaacccagacttgggctcaggtgcagctgcagcagcccggggcggagttggtcaagcctggtgcatcggtcaagatgagctgtaaggcgagtggatacacgttcacatcatacaatatgcattgggttaagcagaccccggggcgcgggctcgagtggattggcgccatctacccagggaatggtgacacatcctacaaccaaaaattcaagggcaaggccacactgaccgccgataagtcctcaagcaccgcatatatgcagctgtcatcgttgacctcagaggactcagcggtatattattgcgcgagatctacctattatggcggcgattggtatttcaacgtgtggggtgccgggactactgtaaccgtatccgccgcctcgacaaaagggccaagcgtgttccccctggctccctctagcaagagtacctccggtggaaccgcagcccttggatgtctggttaaagactacttcccagagcccgttactgtcagctggaacagcggtgctctaaccagcggggtccatactttcccagctgtcttacaatcatcaggtctgtacagcctgagtagcgtagtgactgtgccatcaagctccctcggcacgcagacatatatctgcaatgtgaaccataaaccatccaatacgaaagtggataaaaaggtggagcctaagagttgtgacaaaacacacacctgcccgccctgtccggcccctgaactcttagggggtcctagtgtttttctttttccaccaaaacccaaagatacgctaatgatttcacggacacccgaagtgacgtgtgtcgtggtagacgtatcccacgaggatccggaggtgaagtttaactggtatgtcgatggcgtggaggtccataacgccaagactaaaccccgcgaggagcaatataatagcacataccgagtagtctcggtgctgacagtgttgcaccaggactggctgaacggcaaggagtataaatgcaaagtgtcgaataaggccctccctgccccaattgaaaagactatctccaaggcgaagggacagccacgggagcctcaggtatacacactgccgccgagcagggacgagctcacgaaaaatcaggttagcctaacctgcctggtgaaggggttctatccatccgacattgccgttgaatgggagtctaacgggcagccagagaacaactacaagactacgccccccgttctggactccgacggcagtttcttcctgtattcaaagctgactgtcgacaagagtcggtggcagcagggaaacgtcttctcctgctccgtaatgcatgaggctctgcacaaccattacacccagaagtcgttgtcactgagtccgggcaag

SEQ ID NO: 16007 - DNA, 1425 bp, Artificial Sequence
  Description of Artificial Sequence: Synthetic coding sequence
atggcggtgatggcaccaagaaccctggtgttgcttctgtccggagcactggcacttacgcagacctgggcacaggttcaattgcaacagcctggggcagagttggtgaagccaggcgcttccgtcaagatgtcatgtaaagcctcaggttatacgtttactagctacaatatgcattgggttaagcaaacccctggtcggggtctggaatggattggtgcaatctaccctggtaacggagacacctcgtataatcaaaagttcaagggaaaagcaacccttaccgctgataagtccagctctacggcctacatgcagcttagctcccttacgtcggaagatagcgcagtctactactgcgcccgtagcacttactatggtggagactggtactttaacgtttggggagcagggaccactgtgactgtgtcagcagcctccactaaaggcccatcagtgtttccactggccccttccagcaagtcgacttcaggaggaaccgcagcccttggttgtcttgtaaaggattactttccagaaccggtcaccgtctcctggaactccggcgcactgacctcgggtgtgcatacttttcctgccgtgttgcagtcctcggggctgtacagcttgtccagcgtcgtgactgtccccagctcgtcgctgggaactcagacgtacatttgcaacgtaaaccataagccgagcaacaccaaggtggataagaaggtggagcctaagagctgtgataaaactcacacttgtcctccctgtccagcaccggaactgctcggaggtcctagcgtgtttctctttccacctaaaccgaaggatactttgatgatatcccggacccctgaagtcacctgcgttgtcgtggacgtcagccatgaagatccagaggtgaagttcaattggtacgtggatggggtggaagtgcataacgccaaaaccaagccacgcgaagaacaatacaatagcacctacagagtcgtgtccgtgcttacggtccttcatcaggattggttgaacggaaaagaatacaagtgtaaagtgagcaacaaggcacttcccgcgcctatcgaaaagaccatttctaaagcgaaagggcaacctcgagaacctcaagtgtacactcttcctccgtcgcgcgatgaacttaccaagaaccaggtcagtctgacttgtctggtgaaggggttttacccaagcgacatcgcagtggagtgggaatccaatggtcagcctgagaataactataagactaccccacccgtgctggattcagatgggtcatttttcctgtactccaaactgaccgtggataaatccagatggcaacagggaaacgtcttttcgtgctccgtgatgcatgaagcactccataaccattacacccaaaagagcctctcgctttcgcctggtaaa

SEQ ID NO: 16008 - DNA, 1425 bp, Artificial Sequence
  Description of Artificial Sequence: Synthetic coding sequence
atggcagtgatggcaccacgcaccctcgtcctcctcctcagtggtgctcttgcattgacccagacctgggcacaggtacaactccagcaacccggtgccgagctggtgaagccaggcgccagcgtgaagatgtcatgcaaggcttctggttacaccttcacttcttacaacatgcactgggtgaaacagacacctggtcgcggtctcgagtggatcggcgccatttatcctggcaatggcgacacctcatacaatcagaagttcaagggcaaagctacactcacagccgacaaaagcagctctactgcttacatgcaactctcctctctgacttctgaggactcagctgtgtattactgcgctagatccacttactatggcggtgactggtatttcaacgtatggggagctggtaccactgtgaccgtatccgccgcttctactaaaggtcctagcgtgttccctttggccccatccagcaagtctacctctggcggcactgccgccctgggatgcctggtaaaggattacttcccagaaccagtcaccgtgagctggaattcaggagccctcacatctggagttcacaccttccctgctgtgctgcaatccagtggactgtatagcctctctagcgtcgtcactgtgcctagctcttccctcggtacacagacatatatctgcaatgtgaaccataagccttccaacactaaggtcgataagaaggtcgaacctaaatcttgtgacaaaactcacacctgcccaccttgccccgcccctgaactgctgggcggtccctccgtgttcttgtttcctcctaaacctaaggacacactgatgatttctagaacccctgaagtgacctgcgtcgttgtcgatgtctctcacgaggaccccgaggttaagtttaactggtacgttgacggcgttgaagtgcataatgcaaagacaaaacccagggaagagcagtacaactctacatatcgcgttgtgtctgtgcttacagtcctccatcaggactggctgaacggtaaggagtataagtgcaaagtgagcaacaaagcacttccagcccccattgaaaagacaattagcaaagctaagggccaacctagggaaccccaggtctatacactgcccccaagtcgcgacgaactcacaaagaaccaggtgtcactcacctgtttggtgaagggtttctacccttctgacatcgctgtggaatgggaaagcaatggtcaacctgaaaacaactacaagacaacccccccagtgctggatagtgacggaagtttctttctctacagcaagctcacagtcgataaatctaggtggcaacagggtaacgtgtttagctgctctgtgatgcacgaagctctgcataatcactacacccagaagtcactcagtctgtctccaggcaag

SEQ ID NO: 16009 - DNA, 1425 bp, Artificial Sequence
  Description of Artificial Sequence: Synthetic coding sequence
atggccgtcatggccccaagaacactggttctccttctctcgggcgccctggccctaacccaaacttgggcccaggttcagctccagcagccgggagcagagctcgtcaagcccggcgcaagcgttaagatgagctgcaaggcatcaggctacacttttacctcctacaacatgcattgggtgaagcagacgccaggccgtggcttagagtggataggggccatctaccctggcaacggcgacacctcctacaaccagaagttcaagggcaaggcaacactgactgccgacaaaagtagctctaccgcctatatgcagttaagctcccttacaagtgaagactccgctgtgtattattgtgcacggtctacttactacggtggcgactggtacttcaacgtgtggggcgcaggcacaacagtcactgtgtctgccgctagcactaagggcccctctgtcttcccgctggcacccagtagcaagtctacaagtggcggtacggctgccctgggctgccttgtgaaggattacttccctgagcccgttaccgtgagctggaacagcggagcattgactagtggagtccatactttccctgccgtgctgcaatccagcggcctctatagcctatccagcgtggttactgttccctcctcctctttaggcacacagacctacatctgcaacgtaaatcacaaaccgtctaacaccaaagtagataaaaaagtggaaccaaagtcgtgtgacaagacgcacacatgtcctccttgcccggcacccgagctcctgggagggcccagcgtttttttgtttccccctaaacctaaagatacattgatgatcagtaggactcccgaggtgacttgtgttgtggtggacgtgtcccatgaggaccccgaagttaagttcaattggtacgttgatggagtggaggtccacaacgccaagacaaaacctagggaggaacagtataactcaacttaccgcgtagtttccgtgctgaccgtgttgcaccaagactggctgaatggtaaggagtataagtgcaaggtgtccaacaaagcactgcctgcccctattgagaagactatcagtaaggctaaggggcagccccgcgaaccccaggtttatactttgccaccctccagagatgagctgacaaagaatcaggtcagcctaacctgtctagtgaagggcttttacccgtcagacatagccgtggagtgggaatcaaacggacaacccgagaacaattacaagaccacaccacccgtgcttgatagcgacggatcattcttcctttactctaagctcacggtggacaaatctagatggcagcaggggaatgtatttagttgctcggtcatgcatgaagcactccataaccattacacccaaaagtctctatcccttagccccggcaaa

SEQ ID NO: 16010 - DNA, 1425 bp, Artificial Sequence
  Description of Artificial Sequence: Synthetic coding sequence
atggcagtgatggcccctcgtacccttgttcttctactaagcggagcactggctcttactcaaacgtgggctcaagttcagttacaacagccaggtgctgagctggtgaaaccaggtgcttctgttaaaatgtcgtgcaaagcaagcggttatacattcacaagttacaatatgcactgggttaaacagacccctggacgtggtttagagtggattggagcaatctacccaggtaacggagatacttcttataaccagaagttcaaaggcaaagccacattgactgccgataaatccagttcgactgcttatatgcagctgtcctcccttacttcggaagattcagccgtttactactgcgctcgtagtacctattacggtggtgattggtatttcaatgtttggggagcagggacaacagtgactgtcagcgctgctagtacgaagggcccaagcgtctttccactcgctccttcaagcaagagtacgtccggtggtactgcagcccttggttgtttggtaaaggattattttcctgaacctgtcacagtgagttggaatagcggagccctgactagtggtgttcataccttccctgccgtgctacaatcttctgggctgtactccctttcatctgttgttactgtcccatcgagctccttgggtacccaaacctacatctgtaatgtaaaccacaagccatctaataccaaggttgacaaaaaggttgagcctaaaagttgcgacaaaacacacacttgtccaccttgccctgcccctgagcttctgggaggtccatctgtgttcttattcccgcctaagcctaaggatactttgatgattagcagaacgccagaagtgacatgcgtggtcgtggatgttagccatgaagatcctgaggtgaaatttaactggtacgtagatggtgtcgaagttcataacgcaaaaactaagcctcgagaagaacagtacaattcaacgtatcgtgttgtatccgttctcactgtactccaccaggattggctcaacggtaaggaatataagtgcaaggtatcaaataaggcgcttccagctccaatcgagaagaccatttccaaagccaaaggtcaacctagggagcctcaggtttatactttgcctccttctcgtgatgagctgacgaaaaatcaggttagtctcacgtgcctcgttaaagggttctacccaagcgacattgccgttgagtgggaaagtaatggacaacctgaaaacaattacaagacaactcctccggttcttgattcagatggtagctttttcttgtactctaaacttacagtcgacaagtccaggtggcaacagggtaatgtttttagttgcagcgtgatgcatgaagctttgcacaaccattacacccagaagtctctgtccctgtccccaggtaag

SEQ ID NO: 16011 - DNA, 1425 bp, Artificial Sequence
  Description of Artificial Sequence: Synthetic coding sequence
atggctgtgatggcccctcgaaccctggtgctcctgctttcgggtgctctggcactgactcagacatgggctcaggtgcagttgcaacagcctggggctgagctggtcaagcctggcgccagcgtcaaaatgtcatgtaaggccagtggatacaccttcactagctacaatatgcactgggtgaagcagacgcctggtagaggactagagtggataggtgccatctatcccgggaatggtgatacaagttataaccagaaattcaaaggcaaggcgacactgacggccgataagtctagctcaaccgcttacatgcaacttagttcccttacctctgaagacagcgccgtgtactattgcgcaagatccacttactatgggggagattggtacttcaacgtttggggggctggcactaccgtcaccgtgagcgccgcatctaccaagggcccaagcgtgttccctttggcaccaagttccaaaagtacaagcgggggcacagccgcacttggctgcttggtaaaagattactttccagagcctgttacggttagctggaactctggagcactcacaagcggggtgcacaccttcccagcagtgttgcagtcttcgggactttactctctgtctagcgtggtgacagtgcctagttcttctttgggcacacagacctacatatgcaatgtcaaccacaagccctccaatacaaaggtagacaagaaggttgaacccaaatcctgcgacaagacgcatacttgcccaccatgccctgcacccgaactgttgggggggccttcagtcttcctctttccgcctaagccaaaagacactctaatgataagtagaacaccagaggtcacctgcgtggtggtcgatgtgtcccacgaggatcctgaagtcaagtttaactggtacgtcgatggtgtggaggtacacaacgctaaaaccaaacccagagaagagcagtacaatagtacttatagagttgttagcgttctgactgtcctgcaccaagactggctgaatgggaaagaatataagtgcaaagtctcaaataaggccctgccagcccctattgagaagacgatctctaaggcaaaaggccagcctcgagagccacaggtgtacacactgcccccatcaagagacgagttaacgaaaaatcaggtctctttgacatgtctggtgaaaggattctacccctctgatatcgcagtggaatgggagtcgaacggacaaccggagaacaattataaaaccacaccacccgtcctcgacagtgacgggtcgttcttcctgtatagcaagctgacagtcgacaaatcaaggtggcagcagggtaatgtctttagctgcagcgttatgcacgaagccctccacaaccactatactcaaaagtccctgagcttgagccctggcaaa

SEQ ID NO: 16012 - DNA, 1425 bp, Artificial Sequence
  Description of Artificial Sequence: Synthetic coding sequence
atggcagtgatggcgccccgaactttggtgctccttctgtccggagcactggctcttactcaaacctgggcacaggttcagctgcagcagccgggagcggagctcgtcaaaccgggagcatcagtgaagatgtcgtgtaaggcatcagggtatacgttcacttcgtacaatatgcattgggtaaagcaaacccctggccgcggattggaatggataggtgcgatctaccctggaaatggagatacctcatacaaccaaaagtttaaagggaaggccacccttactgcggataaatcaagttccactgcgtacatgcagctttcctcgctgacctccgaggattcggcagtgtactattgtgccagaagcacgtactacggaggagactggtactttaacgtgtggggcgccggcaccaccgtgaccgtgtcggctgcaagcaccaagggacctagcgtctttccccttgccccttcctcaaagtccacgagcggaggaaccgcagcactggggtgccttgtgaaagattactttcccgagcccgtgactgtgtcgtggaactccggtgcgttgacttcaggcgtgcacacctttcctgcagtgcttcagtcgagcggcctctactcgctttcatccgtggtgactgtgccatcgagcagtttgggtacgcagacctacatctgtaacgtgaatcataagccgagcaacactaaggtggataagaaagttgaacctaagagctgcgacaaaactcatacgtgccctccgtgtccagcaccggaactgcttggcggaccttcggtgtttttgtttccgcctaaacctaaggacaccctcatgatttcacgtaccccagaagtcacctgcgtggttgtcgatgtgtcccatgaagatccggaagtgaagttcaattggtacgtggacggcgtggaagtccacaacgccaagacgaaacctcgggaagagcaatacaattcaacttatagagtggtttcggttctgacggttcttcaccaggattggctcaacggtaaggaatacaagtgcaaggtgtctaataaggccctgcctgccccaattgaaaaaaccatctcaaaagcaaagggacaacctagagagcctcaagtgtacacccttcccccttcacgcgatgagctgaccaagaaccaagtgagcctgacctgtctcgtgaaaggattctacccttccgacatagctgtggagtgggaatcgaacggacaacctgaaaacaattacaagacgactccacccgtgcttgattccgatggcagctttttcctttacagcaagctgaccgtcgataagtcccggtggcaacaaggcaacgtgttctcctgttcggtgatgcacgaagcacttcataaccattacactcagaagtcgctttcactctcccccggaaag

SEQ ID NO: 16013 - DNA, 1425 bp, Artificial Sequence
  Description of Artificial Sequence: Synthetic coding sequence
atggcggtgatggctccccgaacattagtgcttttgctgtccggagcactggcacttacccagacatgggcacaggtgcagcttcagcagcctggtgcagagcttgtgaaaccaggggcgtccgttaagatgtcatgcaaggctagcggatacacttttacaagctataacatgcattgggtcaaacagacaccagggagagggctggagtggataggagccatttacccaggcaatggcgatacatcgtacaatcagaagttcaaggggaaggcgactctgaccgccgacaagtcctcttccacagcttacatgcagctgagttctctgacatccgaggacagcgcggtgtactactgcgcgcggtccacctactatggaggtgattggtattttaacgtgtggggtgccggaacaaccgtcactgtatctgccgcatccacaaagggacctagtgttttccctcttgccccgtcatcgaagtccaccagcgggggtaccgcagcactggggtgtctggtgaaagactattttccggaaccagtgacagtgtcatggaattctggagcacttacgagcggagtgcatacattcccagctgtgctccagtcatctggcctgtattcactcagttctgtagtcaccgttccttcaagcagtctgggcactcagacatatatttgcaacgtgaatcacaagccttcaaacacaaaggtggacaaaaaggttgaacctaaaagctgcgataaaacacatacatgtcctccctgtcccgcacccgagctcttaggaggtccatccgtgtttctctttcccccaaaacctaaggacacactgatgatatctcgcacgcccgaagtgacctgcgtggtggttgacgtgagtcacgaagaccctgaagtgaagtttaactggtacgtagacggcgtcgaggtgcataatgcaaagaccaagccacgagaagagcaatataattctacgtatcgggttgtttccgttctgaccgtcctgcaccaagactggctgaacggaaaagagtacaagtgcaaagtgtccaacaaagctttgcctgctccaattgagaaaacgattagcaaagcgaaaggacagcctcgcgagcctcaggtctatactctccctccgagccgggacgagttaacaaagaatcaggtttccctgacttgcctggtcaaaggtttctacccttccgatatcgcagtcgagtgggagtctaacgggcagccagagaacaattacaagacgacacccccggtcctggacagcgacggcagtttctttctgtacagcaagctcacagtcgataagtctagatggcagcagggaaatgtgttctcctgttccgtaatgcacgaggccctccataaccattatacccagaagtctctgtcgctcagtcctggtaaa

SEQ ID NO: 16014 - DNA, 1425 bp, Artificial Sequence
  Description of Artificial Sequence: Synthetic coding sequence
atggcggtaatggcgccgcgtacgctggttctgctgctgtctggggccctagccctgacccaaacatgggcacaagtacagctgcagcaacctggtgctgaactggtcaagccaggcgcgagtgtcaaaatgagctgcaaagcgtccgggtatactttcacttcatataacatgcactgggttaagcagaccccgggtcgtggcctggagtggatcggcgcaatttaccctggcaatggcgacacgagctacaatcagaagttcaaaggcaaggccaccctgactgcagataagagcagcagtacagcttacatgcagctctctagcctgacaagcgaggacagcgcggtgtattactgtgcgcgcagcacctattatggcggagactggtatttcaacgtttggggcgcaggtaccacggttactgtgagcgcagcaagcactaagggccccagcgtttttccgctggcaccgtcgtctaagtccaccagcggaggtacggcagccctggggtgtctggtcaaagactattttccagaaccagtgacagtttcctggaattcgggcgcgcttacgagtggtgtacataccttcccagccgtactgcagagcagcggtctgtactcactgagctcggtcgtcaccgtgccgtctagctccctgggcacccaaacttatatttgtaatgttaatcataagccaagcaacaccaaagtggataaaaaggttgaaccaaagagctgcgacaagacgcacacctgtccgccatgtccggcacctgagctgctgggaggccccagcgtcttcctttttcctcccaagccgaaggatacgctgatgatttctcgcacccctgaggttacctgcgtcgtggtcgacgtcagccatgaagatccggaggttaagtttaactggtacgtggatggagttgaggtgcataacgccaaaaccaaaccacgcgaggagcagtacaacagcacttatcgcgttgtttccgtcctgacggtgctccaccaggattggctgaatggcaaggaatataaatgcaaagtatccaataaggccctgccagcacctatcgagaaaactatatctaaagccaaaggtcaacctcgtgaaccgcaggtttacacactgccaccgtcccgtgatgagttaacgaaaaaccaggtcagtctgacttgcctggtcaagggtttttatccaagcgatatcgcagtcgagtgggagagcaacgggcaaccggagaacaactacaagacaaccccccccgttttggatagcgacggaagcttttttttgtactcaaaactcaccgttgataaaagccgctggcagcaaggcaacgtgttcagctgcagcgttatgcatgaagcgctgcacaatcactacacgcagaagtcactcagcctctccccgggtaag

SEQ ID NO: 16015 - DNA, 1425 bp, Artificial Sequence
  Description of Artificial Sequence: Synthetic coding sequence
atggcagtgatggcacccagaaccttggtgcttctgctgtctggagcgctggcactgacccagacctgggcacaggttcagctgcagcagccaggtgcagaacttgtcaagcccggagctagcgtgaaaatgagctgtaaggcatccggatatacttttacttcatacaacatgcattgggtgaagcaaactccaggacgggggcttgaatggatcggggcgatttaccctggtaacggcgacaccagttacaatcagaagtttaagggaaaggcgaccctgactgcagacaagtccagctcgactgcatacatgcagcttagctcgctcacttccgaggattccgccgtgtactactgtgcaagatcgacttactacggtggagattggtatttcaacgtctggggcgcgggaaccactgtgaccgtgtccgcggcatcaactaagggcccgtcggtgtttcctcttgctccttccagcaaatcaacctctgggggaaccgcggctttgggatgcctggtgaaagattacttccctgagccggtgactgtcagctggaactcgggtgcactcacgtccggagtgcacaccttccccgcagtcctccaatcttcaggtctttactcccttagctccgtcgtcactgtgccatcaagttcgcttgggacgcagacttacatttgtaatgtgaatcacaaaccttctaacacgaaggtggataagaaggtcgaaccgaaatcctgcgataaaacgcacacctgtcctccctgccctgctccggaactccttggagggccatccgtgttcctgtttcctccgaaacctaaggataccctgatgatatcgcggactcctgaagtcacttgtgtcgtggttgacgtgtcgcatgaagatccggaagtgaagttcaattggtacgtggatggcgtggaagtgcataacgccaagactaagccaagagaggaacaatacaatagcacctaccgcgtggtgtcggtgctgacggtccttcatcaggactggctgaacggaaaagaatacaagtgtaaggtgtccaataaagcacttccggcccccattgagaaaaccatttcgaaggcaaagggccaaccccgggagccccaagtctacacgctgcctccgtcgcgagatgagctgacgaaaaaccaggtgagcctcacctgccttgtgaagggtttctacccatcagacatagcagtcgagtgggaatcgaacggccaacctgagaacaattacaagactacgccacctgtgcttgactccgatggatcctttttcctgtactcaaagctgaccgtggataagtcaagatggcaacaaggcaatgtgttttcgtgttcggtgatgcatgaagcactgcataaccactacactcaaaagagcctttcgctgagtcctggcaaa

SEQ ID NO: 16016 - DNA, 1425 bp, Artificial Sequence
  Description of Artificial Sequence: Synthetic coding sequence
atggccgtcatggcccctcgcacgctcgtgctgctgcttagcggagcactggccctgactcagacctgggcccaagttcagctccagcagccaggagcagaactggtgaagccaggggcctcggtgaagatgagctgcaaagcgagcggatacaccttcacttcatacaacatgcactgggtgaaacagactccaggaagagggttggagtggatcggggcgatttacccaggcaacggcgatacgtcatacaaccagaagttcaagggaaaagcgaccctgaccgccgacaagtcctccagtactgcgtacatgcagctctcctccttgacctcggaggactcggcagtgtactactgcgcccgctccacctattacgggggcgactggtatttcaacgtatggggggccggcaccaccgtaactgtgagtgccgctagcaccaagggcccatccgtatttcctctggcaccgtcatcgaagtcgacctctggagggactgccgcactggggtgtctggtcaaggactacttcccagagccggtcaccgtgagctggaactcgggtgcgctgacctcgggagtgcatacgtttcctgcggtccttcaatcctccggactgtactcgctctcctcggtcgtgacggtcccgtcatcgtcactcggcactcagacctatatctgcaacgtgaaccacaaaccttcgaacaccaaagtcgacaagaaggttgaacctaaatcgtgtgacaaaactcacacttgcccgccgtgcccagctcctgaactgctcggaggaccgagcgtgttcctgttcccgcccaaacccaaggataccctgatgatctcgcgaaccccggaggtgacttgcgtggttgtggacgtttcgcatgaagatcccgaggtgaagttcaattggtacgtcgatggtgtggaggtgcacaatgccaagactaaaccgcgagaggagcagtacaattcaacctacagggtggtgagcgtgctgaccgtcctccatcaagattggctgaatggaaaggagtacaaatgcaaggtgagcaacaaggctctgccggcgccgatcgaaaaaacgatctccaaggccaaggggcagccaagagaacctcaagtgtacaccttgcctccctcgcgggacgaacttaccaagaaccaagtttccctgacttgcttggtcaagggattctacccgtcggatattgcggtcgaatgggaatcgaatggacaaccagaaaacaattacaaaactactccaccagtgctcgattccgacggtagctttttcctgtactcaaagctcactgtggacaagtcgcgttggcagcaaggcaacgtcttttcctgtagcgtgatgcacgaagcacttcacaatcactacactcagaagagcctctcgctgtcaccgggaaag

SEQ ID NO: 16017 - DNA, 1425 bp, Artificial Sequence
  Description of Artificial Sequence: Synthetic coding sequence
atggcagtcatggcacccagaacgctcgtgttgttgttgtccggcgctctggcgctcacacagacatgggcacaagttcagctgcagcaacctggcgctgagctggtcaaacccggcgcctctgtgaagatgtcatgtaaagcctccggctatacattcacaagttataatatgcactgggtaaagcagactccgggcaggggactcgagtggattggggccatttaccctggtaacggtgatacgagctacaatcagaagtttaagggaaaagctacgcttactgcagataaaagcagctcaaccgcatatatgcagctctcatccctgacctcagaagacagcgctgtctattattgtgcacggtccacctattacggaggtgactggtactttaatgtgtggggggccggtaccactgttaccgtctcagcggcctccaccaagggaccttccgttttccctcttgctccttcaagtaaaagcacaagtggaggtaccgccgccctcggttgtctggtgaaggattactttcctgaaccagtcacggtgtcatggaacagtggagccctgacgtccggagttcacacttttcctgcggttctgcagtccagcggactgtattcactgagcagcgtcgtaacagtcccatccagctccctcggcactcagacatacatttgtaacgtgaaccacaaaccatctaacaccaaggtcgacaagaaagtggaaccaaagtcctgtgataagacccacacctgtccgccatgccccgctcccgaactgctggggggacccagtgtgttcctcttcccccccaaacccaaagatactctgatgatcagcagaaccccggaggtcacctgcgtggtcgtggatgtttcccatgaggaccccgaggtgaagttcaattggtacgttgacggagtcgaagtccataatgctaagacaaaacctagagaagaacagtacaattcaacttaccgcgtggtgtctgtgttgacagtgttgcaccaggactggctcaacgggaaggagtacaaatgcaaggtcagcaataaggccctccctgcacccattgaaaaaaccattagcaaagctaagggccaaccccgagagcctcaggtgtacactctgcctccaagcagggacgagttgacaaagaatcaggtaagcctcacctgtctggtgaagggtttttacccatccgatatcgctgtggaatgggaatccaacggccagcccgagaataactacaaaactaccccgcccgttctggatagcgacggttccttcttcttgtactctaaactcaccgtcgataaatctagatggcagcaggggaacgttttttcctgctctgtcatgcacgaagcactgcataaccactacactcagaagtctctgtcattgtcaccaggaaaa

SEQ ID NO: 16018 - DNA, 1425 bp, Artificial Sequence
  Description of Artificial Sequence: Synthetic coding sequence
atggcggtcatggctcctagaacactggtgctgctgctgtcgggagccttggccctgacacaaacctgggcacaggtgcagttacagcagcccggcgcggaactggttaagcctggcgcctctgtgaaaatgtcatgtaaggccagtggatatacattcacgtcatacaacatgcactgggttaagcagacaccgggacggggtcttgaatggatcggcgcgatttacccgggcaacggggacacatcttataatcagaagttcaagggcaaggccacgcttacggcggataagtcttccagcaccgcatatatgcagctgagttccctgaccagtgaggattccgctgtgtattactgcgctcgcagcacatattacgggggggactggtacttcaacgtttggggagccgggacaacagttactgtgagtgccgcctcaaccaaaggaccttctgtcttccctcttgcacccagcagcaaaagcacgtccggcggtaccgccgccctgggttgcctggtgaaggattacttcccggaaccagtcacggttagttggaactctggcgccttgacatctggagtacacacatttccagctgtgctgcagagtagcgggttatactccctgagcagtgtggtcacggtgccgagctcctcactaggaactcaaacatacatctgtaatgtgaatcacaaaccatctaatacgaaggtagacaaaaaggtggagccaaaaagttgcgacaagacccatacttgccccccctgccccgcgccagagctgctgggtgggccttcggtctttcttttcccccctaaacctaaggatactcttatgatctcacgtacgcctgaagtgacatgcgtagtggtcgacgtatctcacgaggacccagaggtgaagttcaactggtatgtcgacggagttgaagtccacaacgccaaaaccaaacctagggaagaacagtacaacagtacatacagggtagtgagcgttttgactgttcttcaccaagactggcttaatggaaaagaatacaagtgcaaggtctcgaacaaggcattgccagcccctattgagaagaccatctcgaaagccaaaggacagcccagggaaccacaggtctatacgctgcctccttccagagatgaactgacaaagaatcaggtcagcttgacatgcctggttaaaggcttctatccctcagatatcgcagtggagtgggaatcgaacgggcagcccgagaataattacaaaaccacccctccagttctggatagtgacggctccttctttctttactccaaactaacggtggataagtcaaggtggcagcagggcaatgtgtttagttgtagtgtgatgcacgaggctctccacaaccattatacgcagaagtccctgagcctgtcccccggaaag

SEQ ID NO: 16019 - DNA, 1425 bp, Artificial Sequence
  Description of Artificial Sequence: Synthetic coding sequence
atggccgtgatggcgcctcgcacactcgtcctgctgctgtccggagcgctggccttaacacagacatgggcccaagtacagctgcaacagccaggcgcagagctagtaaagccaggggcctccgtgaaaatgagctgtaaggcttccggctatacattcacttcttacaacatgcactgggtgaaacagactcccggacggggcttggagtggattggtgcgatatatccaggaaatggcgacacctcttataaccagaaatttaaagggaaagccacgcttactgcggacaaaagcagttcaacagcttacatgcagctaagttctcttacatccgaagactcagctgtgtattactgtgctcgaagcacatactatgggggtgattggtattttaacgtttggggcgcaggtactacagtcacagtatcagcagcaagcacgaaagggccaagtgttttcccccttgccccatcatccaaatccacctcagggggcactgccgccctgggatgtctggtgaaagactattttccggagcctgtcactgtttcttggaattccggcgcactgacctcaggcgttcacactttcccggctgtgttgcagagctctggcctttattcattgtccagcgttgtgactgtgcctagtagttccctgggcacacagacctacatttgcaatgtaaatcacaaacctagcaacaccaaggttgataagaaagtggagcccaaaagctgcgacaaaactcacacgtgtcccccctgcccagctcctgagcttctaggcggcccctctgtgttcctgtttccaccaaaacccaaggataccctgatgatttcgcggacgccagaggtcacatgcgtggtcgtcgatgtgtcccatgaggaccccgaagtgaaatttaattggtatgtagatggagtggaggtacacaatgcaaaaaccaaaccgagagaggaacaatacaactcaacatacagagtcgtaagcgtacttacagtactgcaccaagattggctcaatggaaaagaatacaaatgtaaggtctctaacaaggctctgcctgcaccaattgagaagaccatctctaaagctaaaggccaaccacgcgagcctcaagtctacacactgcccccgtcacgtgatgaactaacaaagaatcaggtctctttaacttgtctagtgaagggattctatccctccgatatagctgtcgaatgggaatccaatggccagccagaaaacaactacaagactactcctcctgtcctggactcggacggatcgttcttcctgtactctaaattgactgtagacaagagtaggtggcagcagggcaacgtctttagttgctcagtcatgcatgaagcgcttcacaatcactacacccagaagagtctcagtctgagcccgggtaaa

SEQ ID NO: 16020 - DNA, 1425 bp, Artificial Sequence
  Description of Artificial Sequence: Synthetic coding sequence
atggctgtgatggcaccccgaaccctcgtccttctgcttagtggagccctggcgttgacccagacctgggcacaagtgcaactgcagcaacctggtgctgagctcgtgaagccaggcgcttccgtgaagatgagctgtaaggcctccggctatacttttacctcttacaatatgcattgggtcaagcaaactcctggacggggtctggagtggataggtgcaatctaccccggcaacggtgatacctcatataatcagaagtttaaaggaaaggctactctgacggcggataaatcatccagcaccgcatacatgcaactgtcttctctgacaagcgaagacagcgctgtgtattactgtgctcggagcacatactatgggggcgattggtacttcaatgtctggggggcgggcacaacggtcactgtctcagctgcttcaacaaagggcccctcagtgttcccattggctcccagttccaagagcacaagcggcggcactgcagctcttggctgcttggtgaaggactatttccccgagcctgtgaccgtcagctggaatagcggagccctgacaagtggagtacataccttcccagctgtgctccaatccagcggattgtatagcctgtcctctgtagtgacggtgccgtctagctccttgggcacacagacatacatctgcaatgtgaatcacaagcccagcaacaccaaagtggataagaaggtggaacctaagtcttgcgataaaactcacacctgcccgccctgtcccgcacctgaattgctcggtgggccatcagtcttcttgttcccacccaagcccaaggataccctgatgatttcccggactcctgaggtgacctgcgtggttgttgacgtgagtcacgaagatcctgaggtaaagtttaattggtatgtggatggggtagaggtacataatgccaagaccaagcctagagaggagcagtacaactcaacctaccgggttgtgtccgtcctgacggtattgcatcaagattggcttaatggcaaggagtataaatgcaaggtgtctaataaagcactcccagctccaattgaaaagacaatctccaaggctaagggacagcctcgagagccccaagtgtatacgctgccgccatctagagatgagctcacaaagaatcaggttagtctgacttgccttgtaaagggcttctatccctctgatattgcagtggaatgggagtctaatggccagccggaaaacaattacaaaacgaccccgccagtgctggattcagatgggtcctttttcctgtattccaagcttaccgttgataagagtagatggcagcagggcaacgtgttctcctgctccgtcatgcacgaggccctgcacaatcactacacacagaagtctctgtccctcagtcccgggaag

SEQ ID NO: 16021 - DNA, 1425 bp, Artificial Sequence
  Description of Artificial Sequence: Synthetic coding sequence
atggccgtgatggccccccgcaccctggtactcttactctccggagctctcgccctgacacaaacatgggcacaggttcagctgcagcagcccggagcagagctggtgaagcccggggccagtgtgaaaatgtcttgcaaagcaagtgggtatacattcacctcttataacatgcactgggtgaagcagaccccaggccgcggcttagaatggataggcgccatctacccgggcaacggtgacacctcctataaccagaaattcaaagggaaggcaacattaaccgccgataagagttcttctaccgcctatatgcagctgagcagcctgacaagcgaagactctgctgtctattactgcgcccgttccacatactacggcggggattggtattttaacgtgtggggtgctggcactactgtaactgttagtgctgcaagcactaaaggtccatctgtattcccccttgccccttcatccaagtctacatccggcggtaccgctgcattgggctgtttggtcaaggactacttcccggagcccgtgaccgtgtcttggaatagtggcgccctaactagcggagttcacaccttccccgctgtgttacagagctcaggactgtatagcctgtcctctgttgtaacagtacctagctccagcctgggcacacagacctatatctgtaacgtgaaccacaaaccctctaacaccaaggtggacaaaaaggtggaacctaagagctgtgataaaacccatacatgccctccttgcccagcacccgaactcctgggcggaccaagcgtgttcctgttccctcccaagcccaaggatactctgatgattagtcggacccctgaggttacttgcgttgtggtggacgttagtcatgaggatccagaggtgaagtttaactggtacgtggatggagtggaagtgcacaatgccaaaaccaaacctagggaagagcaatacaacagtacttatcgtgtggtgtccgttctcaccgttctgcatcaagattggcttaatggcaaagagtacaagtgtaaggttagtaacaaagctctccctgcacccatcgagaaaaccattagtaaggcaaagggacaaccacgggaaccccaggtatatactttgccaccctccagggacgagctaacaaaaaaccaggtgagcctaacttgcttggtgaaaggtttctatcccagcgacattgccgtcgaatgggaatctaacggtcagcctgagaacaattacaagaccactccacctgtactcgactccgacggctcctttttcctctatagcaagctcactgtcgataagagtcggtggcagcaggggaatgtctttagctgctctgtgatgcatgaggccctccacaatcattatacacagaagtctttgagtctctctccagggaag

SEQ ID NO: 16022 - DNA, 1425 bp, Artificial Sequence
  Description of Artificial Sequence: Synthetic coding sequence
atggctgtgatggcgccaaggaccctagtactgttacttagtggtgcgctggcattaacccagacctgggcccaggtgcagcttcagcagccgggggccgaactggtaaaaccaggagcctctgttaaaatgagttgtaaagcttctggatataccttcacctcttataacatgcactgggtgaaacagacgccaggaaggggactggagtggatcggcgccatctatcccggaaacggagataccagttataaccaaaagttcaagggaaaagccacattgacagccgataagtcttcatctacagcttatatgcagctctcctccctgacaagtgaggactctgccgtatattactgtgctagaagcacctattacggaggagactggtattttaatgtgtggggagcaggcacaactgtgaccgttagtgctgccagcacaaaaggaccaagtgtcttccctctggccccctcttctaaaagcactagtgggggcaccgctgcccttggctgcctcgtcaaggactactttcctgagccggtcaccgtgagttggaatagcggagccctgacttccggcgtgcacactttcccagctgttttgcagtccagcgggctgtattccctgtctagtgtggtcaccgtgccttcatccagcctgggaacacagacttatatctgcaacgtgaatcataagccctctaatacgaaggtggacaagaaagtggagcctaagagttgcgataaaacccacacttgccctccttgtcccgcgccggaactgctagggggcccctcagttttcttatttccccccaaacctaaagacacactgatgatcagtagaacccccgaagtgacttgtgttgttgtggacgtgtctcacgaggaccctgaggttaaatttaactggtatgtggacggagtagaagtgcacaatgctaagaccaagcctagggaagaacagtataattccacctatagggtggtgtcggtgttgactgtacttcatcaagattggctgaacggtaaagaatataaatgcaaagtttcaaataaggccctgcctgctcctatcgaaaagaccatctccaaagccaagggacagccccgcgaaccacaggtctacactctaccaccgagccgcgacgaactgacaaagaaccaagtgtccttgacttgtctcgttaaagggttctatcccagcgatattgcagtagaatgggagtcgaacgggcagcccgagaataactataagacgactcctccagtgctagactcagacggcagctttttcctttactccaagcttactgtggacaaatcaaggtggcaacaggggaatgtgttttcctgttccgtcatgcacgaagcattacataaccattacactcagaaatccctgtctctctcacccggtaag

SEQ ID NO: 16023 - DNA, 1425 bp, Artificial Sequence
  Description of Artificial Sequence: Synthetic coding sequence
atggcagtgatggcgccgcgcaccttggtgctgctcctgagcggcgcactcgctcttacccagacgtgggcacaggtccaactgcagcagccgggagcggaactggtgaagcctggagcttcagttaagatgtcgtgcaaggccagcggatatacctttacttcatacaacatgcattgggtcaagcaaacgccgggacgcggactggaatggatcggggcaatctaccctggcaatggcgacacttcctacaaccagaagttcaaggggaaggcgacgcttacggcggacaagtcgagctccactgcctatatgcaattgtcatctctcaccagcgaagattccgcagtttactactgcgcgcggtccacttactacggaggtgactggtacttcaatgtgtggggggctggtaccactgtgaccgtgtcggccgcctctaccaagggaccttcggtgttcccgctggctccctcttccaagtctacttcgggaggaactgccgcactgggctgtctggttaaggactacttccccgagccagtcactgtcagctggaacagcggagcactcacttccggcgtccacaccttcccggccgtcctccagagctcaggcctgtactcgctgagctccgtggtgacggttccctcctcgtccttgggaacccagacgtacatctgcaacgttaatcacaagccaagcaacaccaaagttgacaagaaagtcgagccgaaatcgtgcgataagacccatacttgcccgccgtgtcccgccccagaactcttgggcgggccttccgtgttcttgttcccgcccaaaccaaaggatactctcatgatcagccgtactccggaggtgacctgcgtcgtcgtggacgtgtcccacgaggacccagaagtcaagttcaactggtatgtggacggagtggaagtgcacaacgccaaaactaaaccgcgggaggaacaatacaatagcacctaccgcgtcgtgagcgtgctgacggtcctccatcaagattggctgaacggaaaggagtacaagtgcaaggtgtcgaacaaggcgcttccggcgcctattgaaaaaactatctcgaaggccaagggtcagccacgggaaccgcaggtgtacactctgcctccttctagggatgagttgactaagaaccaggtgtcattgacctgtctggtcaaagggttctacccttcggatatcgctgtggaatgggagtccaatggccaacccgagaataactataagaccaccccaccggtgttggactcagacggatccttctttctttactccaaattgaccgtggacaaatcaagatggcagcagggaaatgtcttttcctgcagcgtgatgcatgaagccctgcacaaccactacacccaaaagtcgctgtcactgtccccgggtaaa

SEQ ID NO: 16024 - DNA, 1425 bp, Artificial Sequence
  Description of Artificial Sequence: Synthetic coding sequence
atggccgtgatggcacctcgtacattagtcctgctgttgtccggcgcccttgccctcacacaaacctgggcccaagtccagctccagcagcccggcgcagaactggtcaaaccaggagccagcgtaaagatgtcgtgcaaggcgagtggttatacttttacctcctataatatgcattgggtaaaacagacacctggcagaggcctcgaatggattggggcgatttatcccgggaatggggatacctcctacaatcaaaaattcaaaggcaaggccaccctgacggcggataagagtagctctacggcatacatgcagttaagttcgttgacctcagaggattccgctgtgtattattgtgcaaggtctacatactacggaggggactggtacttcaatgtatggggagctggaactaccgtgaccgtttcggctgcctctactaaaggacccagtgtgttccccctggccccaagcagtaagtcaacatccggaggcacagccgccctgggttgtcttgttaaagattatttccccgagccggtgacagtctcctggaattcaggagctcttacttctggtgtgcacaccttcccggcagtgctgcagtcgagtgggttatacagcctgagctctgtagtcaccgttccatcctcgtctttggggacccagacatatatttgtaatgtgaatcacaaaccctccaacacaaaagtggataagaaagtcgagcctaagtcatgtgataaaacccacacatgtcctccatgcccagccccggagttactgggggggccaagtgtgttcctttttccacccaagcccaaggataccctcatgatttctcgtacacccgaggtcacatgcgtcgtcgttgacgtcagtcacgaggatcccgaagttaaattcaactggtatgtggatggtgtcgaggttcataacgccaaaactaagccaagagaggagcaatacaacagcacatacagggtggtgtcagtgctcactgtgctccaccaagactggctaaatgggaaggaatacaagtgtaaagtctctaataaggcccttcccgcccccattgagaagaccattagtaaggcaaaagggcagcccagggaaccccaagtctacactctccctcccagtagggacgagctgactaagaatcaggtgtcactgacctgtttggtgaaaggtttttatccctctgacattgctgtagagtgggagtctaatggccagccagaaaataactacaaaacgacccctccagttttggacagcgacgggtcgttcttcctgtattccaagcttacagttgacaagagcagatggcagcagggaaacgtattttcctgtagtgtcatgcacgaggccctgcataaccattatacacagaagtccttaagtcttagtcctggaaaa

SEQ ID NO: 16025 - DNA, 1425 bp, Artificial Sequence
  Description of Artificial Sequence: Synthetic coding sequence
atggctgttatggctcctagaactttggtccttttactttcaggagcattagctttaacacaaacatgggctcaagttcaattacaacaaccaggtgctgaattagtaaaaccaggagctagtgtaaaaatgtcttgcaaagcttcaggttatacctttacttcatacaatatgcattgggttaaacaaactccaggaaggggtttagaatggattggagctatttatccaggaaatggagatacatcatacaatcaaaaatttaagggaaaagcaacactaacagctgataaatcatcttctacagcttatatgcaattatcatcattaacatctgaagattctgcagtttattattgtgctagatctacttattatggtggagattggtattttaatgtatggggtgccggtacaactgttacagtatctgcagcaagtaccaagggaccatcagttttcccattagctccatctagtaagagtacttcaggaggaactgctgctttagggtgtttagtaaaagattattttccagagccagttactgttagttggaattcaggagctttaacttcaggtgttcatacatttccagcagttttacaatcaagcggattatattcattatctagtgttgttactgttccatcatcttctttaggtacacaaacatatatttgtaatgttaatcataaaccatctaacacaaaagttgataaaaaggttgaaccaaaatcatgtgacaaaacccatacatgtcctccttgtccagctcctgaattgttaggtggaccttcagtatttctttttccaccaaaacctaaagatactttaatgatttcaagaactccagaagtaacatgtgttgttgttgacgttagtcatgaagatcctgaagttaaatttaattggtacgttgatggtgtggaagttcataacgcaaagacaaaaccaagagaagaacaatataattcaacatacagagtggtgtctgtattaactgttttacatcaagattggttaaacggaaaggaatataaatgcaaagtttctaataaggcacttccagctcctattgaaaagacaatttctaaagcaaaaggtcaacctagagaacctcaagtttatactttgcctccttcaagagatgagcttacaaaaaatcaagtttcgttaacatgtttagtaaaaggattttacccatcagatattgcagttgaatgggaatcaaatggacaaccagaaaataattataaaacaactccaccagtattagatagtgacggatcattttttttatattcaaaattaacagttgacaaatcaagatggcaacaaggaaatgtattttcatgttcagttatgcatgaagctcttcataatcattatacacaaaaatcactttcactttctccaggaaaa

SEQ ID NO: 16026 - DNA, 1425 bp, Artificial Sequence
  Description of Artificial Sequence: Synthetic coding sequence
atggcggttatggcccccaggacgctggtactgctactgagcggagctctcgctctgacccagacctgggcacaggtgcagcttcagcagcctggagccgaactggtgaagccaggtgcaagtgtaaaaatgtcttgcaaggcgtcagggtacaccttcacttcctacaatatgcattgggtgaaacagactcccggaaggggtctggaatggattggcgcaatatatcccggtaatggggatacttcctataatcagaaattcaaaggtaaggcaactctcaccgctgacaaatcctcatctacagcttatatgcagctttcatctttaacctcggaagattcagcagtctattattgtgccagatccacatactacgggggggactggtacttcaatgtctggggcgcaggcacaacggtgacagtttctgccgcgtctacaaaaggaccatccgtatttcctctggcaccaagtagtaagtcgacctccggggggacggccgccctgggttgcctggtgaaagactactttcctgaacccgtgactgtaagctggaactctggcgccctgacaagcggagtgcacactttcccagccgtactccaatcctccggactgtacagtctatctagtgtagtgaccgttcccagtagctctttggggactcagacatatatctgtaatgttaatcacaaaccctcaaacaccaaagtagacaagaaggtggaaccaaagagctgcgacaagacccacacgtgcccgccatgtccggctcccgagttgctaggtggcccgtcggtgttcctgtttccccctaagccaaaggatacactcatgatctcgagaactcctgaggtcacgtgcgtcgtggttgatgtgtcccacgaagacccagaagtgaagttcaactggtacgtcgatggggtcgaggtgcacaatgcaaaaactaaaccccgcgaggagcagtacaactcaacttacagggtcgtgtccgtcctgaccgtcctgcatcaagactggctgaatgggaaagagtataagtgcaaagtgtctaacaaggctcttcccgccccaatcgagaagaccatctccaaggccaagggccagccccgcgagcctcaggtatatactctgccacctagtcgagatgaattgactaagaaccaagttagcttaacctgtctggtgaaagggttttacccttccgatattgccgttgaatgggaatccaacgggcaacccgagaataactataagacaacacccccggtgctggatagcgacgggtccttttttctgtattctaagttgacagtcgacaaatctcgctggcagcagggaaatgtttttagctgtagcgttatgcacgaagcgctgcacaatcactatactcagaaatcactgtccttgagccccggcaaa

SEQ ID NO: 16027 - DNA, 1425 bp, Artificial Sequence
  Description of Artificial Sequence: Synthetic coding sequence
atggccgtcatggcgcccaggaccctcgtactgttactgtctggcgcactcgccctcacacagacttgggcccaggttcagcttcagcagcctggggcggagctggtcaagcccggtgcctcggtgaagatgagttgtaaggcttccggatacacttttacttcgtacaacatgcattgggttaagcagacgcctggtaggggactggaatggatcggcgccatatatcccggtaacggcgacacgagttacaaccaaaagttcaagggaaaggctaccttgactgctgataagtcttcttcgactgcctacatgcagctcagttccctgacttccgaggactctgccgtctactattgtgctagatctacctactatggtggagactggtacttcaacgtgtggggcgcaggaacgactgtgaccgtctctgccgctagcacaaaaggccctagtgtattccctctcgccccatcttctaagtccacgtcaggggggacagccgccctgggatgtctggtgaaagactattttccggagccagtcacagtcagttggaattctggcgcactcacgtcaggcgtccacacttttccggctgttttgcagtcctccgggctatattctctatcttccgttgtgactgtgccgagttcttccttaggaactcaaacctatatctgcaacgtgaatcacaagccatcaaacacaaaggtggataagaaagtcgaaccaaaatcttgtgacaagacccatacctgccctccatgccccgcccccgaactactcggcggaccttctgtattcctattccccccgaagcctaaggacacgctaatgatatctcgcactccggaggtaacatgcgtggtggtggatgtgtcacacgaagatcccgaggtcaaattcaattggtacgtagatggcgtggaggtgcacaacgccaaaacaaagcccagggaggagcagtataactcaacgtacagagtcgtgtccgttctcaccgttctgcatcaggattggctgaatggaaaggagtacaagtgcaaagtttctaacaaagccttgcccgctccaatcgagaaaactatctctaaggccaaaggccagccccgtgagccacaggtatatacactgcccccatctcgcgatgaactaactaaaaaccaggtgagccttacatgtcttgtaaaaggtttctatcccagtgatattgcagtggagtgggagtcaaacggccagcctgagaacaactataagacaaccccccctgttctggatagcgacgggtcattttttctgtattcaaagctcacagtggataaaagccggtggcagcagggcaatgtgttttcttgcagcgtgatgcacgaagctctccacaaccattacactcagaagagtttgtctttaagtccgggaaaa

SEQ ID NO: 16028 - DNA, 1425 bp, Artificial Sequence
  Description of Artificial Sequence: Synthetic coding sequence
atggccgtgatggccccaagaaccctcgtgctgctcctctcgggagccctcgcgctgactcaaacctgggcacaggtccaactccagcaaccgggcgccgaactggttaagcctggagcttccgtgaaaatgtcgtgcaaggcctcgggctacacgttcactagctacaacatgcattgggtgaaacagactccaggccggggactggaatggatcggagctatctaccctggcaatggagacacctcgtacaaccagaagttcaaagggaaagccactttgaccgcggacaagtcgtcgtcaaccgcctacatgcagctgagttcgcttacctccgaggattcagctgtctactactgcgctcggagcacctactacggcggggattggtacttcaacgtctggggagcgggaaccactgtgaccgtgtcggctgcctccaccaaggggccgtcagtctttccgctcgcaccatcatccaagtcgacttccggcggaactgcggcgctgggatgcctcgtgaaagattacttcccggaaccggtcaccgtctcgtggaatagcggagccttgactagcggagtccatacgttcccagcagtgcttcagtcgagtgggttgtactcgttgtcgtccgtggtcacggtgccttcctcatcgctgggaactcagacctacatctgcaatgtgaaccacaagccgtcaaacaccaaagtggacaagaaggtcgaacctaagagctgtgacaagacccacacgtgtccgccgtgccctgccccggaattgctgggcggacctagcgtctttctgttcccgccgaagccaaaggatactctgatgatctcaaggaccccagaggtcacctgcgtggtggtcgatgtcagccacgaggatcctgaggtgaagttcaactggtacgtcgatggcgtggaggtgcacaacgccaagacgaaaccgcgcgaagagcaatacaactcaacctacagagtggtttccgtgctgaccgtgctccatcaggactggctgaatggaaaggagtacaagtgcaaggtcagcaataaggccctgccggccccgatcgaaaagactatttcaaaggcgaagggtcaacccagagagccgcaagtctataccctccctccgagccgggacgaactgaccaagaaccaggtgagcctgacttgtcttgtgaagggattttacccttccgatattgctgtggagtgggaatccaacggacagcctgagaataactataagaccacgccgccggtgctggattcggacggtagcttcttcctctactccaaactcacggtcgacaagtcacggtggcagcagggaaacgtgttctcatgttcggtgatgcacgaagcattgcacaaccattacactcagaagtcactgtcactgtccccgggaaaa

SEQ ID NO: 16029 - DNA, 1425 bp, Artificial Sequence
  Description of Artificial Sequence: Synthetic coding sequence
atggctgtgatggcgcctcgcaccctcgtgctcctgctgtccggagcgctcgccctgacccagacctgggcacaggtccaactccagcagcctggcgccgagctggttaaaccaggcgcgtctgtgaagatgagctgcaaagcatcaggctatacatttacctcctacaatatgcactgggtgaagcagacccccgggagaggccttgaatggataggggcaatctacccagggaacggcgatacttcatataaccagaaattcaagggcaaggccactctgaccgctgacaaatcctcctctactgcctatatgcagctcagctccctgactagcgaggactccgccgtctactattgtgctcggagtacatattatggaggcgactggtattttaacgtctggggcgctggaactacagtgacagtgtcagccgcatccactaagggtcccagcgtgttccccctggcgcccagctctaagagcacctctggaggaaccgccgccctgggctgcttggtgaaggactattttccagagcctgtgaccgtaagttggaactcaggcgccctgacctccggtgtccacacctttccagccgtgcttcagtcctctggactgtacagcttgagctctgttgtgactgtgccatccagctcccttgggacccagacctatatatgcaatgtcaaccataaaccctccaacacaaaggtggacaagaaggttgaaccaaaatcctgtgacaaaacacacacttgccctccttgccctgcccccgaactgctgggtggaccttccgtgttcctctttccccctaagccaaaagatacactgatgatttcccgcacacctgaagttacgtgcgttgtggtagacgtctcacatgaggatcctgaggtcaagtttaattggtacgtagatggcgttgaggtgcacaacgccaaaactaaaccaagggaagaacagtataatagcacctaccgcgtggtgtctgtgctgactgtcttgcatcaggactggctgaatggtaaggagtacaagtgtaaagtatcaaataaggctcttcctgcgcccatcgaaaaaacaatcagcaaggccaaaggacagccaagagagcctcaggtctacacactgccacctagcagagatgagctgactaaaaatcaggtgagcctgacgtgtttggtgaaagggttctatccgtcagatatcgccgtggagtgggagagtaacggtcaaccagaaaacaactacaagaccacacccccagttctcgatagtgacgggagcttctttttgtattctaaactgactgtggacaagtccaggtggcaacaagggaacgtgttctcttgctcagttatgcacgaggcgctccataatcactacactcagaagtccctctccctctccccaggcaag

SEQ ID NO: 16030 - DNA, 1425 bp, Artificial Sequence
  Description of Artificial Sequence: Synthetic coding sequence
atggcggtgatggcccccagaactctcgtgcttttgctctcgggtgccctggcgctgacgcagacttgggcgcaggtgcaacttcagcagcctggagcagaactggtgaagcctggcgcaagcgtcaagatgtcctgcaaagcatcaggatacacctttacttcgtacaacatgcattgggtgaaacaaactccaggcagaggattggaatggattggcgcaatttaccctggtaacggagatacctcctacaatcagaagttcaaggggaaagcgacccttacggcagacaagtcctcttctaccgcatacatgcagcttagctcccttacctccgaagattccgccgtgtactattgtgcacgctccacgtattacggtggagattggtactttaacgtgtggggggcgggtaccactgtaaccgtgtcagcagcctcaaccaagggtccctcagtgtttcccctcgctccgagctcgaaatcaaccagcggaggaaccgcagcgcttggttgtctggtcaaagattacttcccggaacctgtgactgtgtcgtggaactcaggtgcgctcacctccggtgtgcacacgtttccagccgtgttgcaatcgagcggtttgtactcactctcctcggtcgtgaccgtcccttcgagttctctcggaactcaaacctacatctgtaatgttaaccataagccatcgaatactaaagttgataagaaggttgaacccaagtcgtgtgataagacgcatacttgtcctccttgtccagcaccagaactgctcgggggcccttccgtgtttctttttcctccaaaaccaaaggacactctgatgatttccaggactcccgaagtgacctgcgtcgtggtcgacgtctcccatgaggatccagaagtgaagtttaactggtacgtggatggcgtggaagtgcataacgctaagactaagccgagggaggaacagtacaactcaacgtaccgagtggtttccgttctcactgtgctgcaccaagattggctgaatgggaaggaatacaagtgcaaagtctccaataaagccttgccagcacctatagaaaagacgatctccaaggcaaaaggacaacctagggagcctcaggtatatactctcccaccaagtcgggacgaactgactaagaaccaagtttctcttacctgtttggtgaaaggtttctacccatccgacattgcagtggaatgggaatccaacggccagccagagaacaactacaagactactccacctgtccttgattcggatggatcgttcttcctctactcgaaacttaccgtggacaagtcccgctggcaacagggcaatgtgtttagctgttcggtcatgcatgaggcccttcacaatcactacacccagaagtcactttccctgtcccccggaaag

SEQ ID NO: 16031 - DNA, 1425 bp, Artificial Sequence
  Description of Artificial Sequence: Synthetic coding sequence
atggccgtcatggcccctaggacactggtcctcttactgtctggggccctcgcacttacccagacttgggcccaggtgcagctgcagcaacccggggcagagcttgtgaaacccggggcctctgtaaaaatgagctgtaaagccagtggttacacgtttacaagttataatatgcactgggtcaaacagacccccggtcgtgggctggagtggatcggcgccatctatcccggaaacggcgacaccagctacaaccaaaaattcaagggtaaagcaacactaactgcggataagtcatcctctactgcgtatatgcagctgagtagccttacaagcgaggactcagcggtgtactactgtgcgagaagtacctactacggaggggattggtacttcaacgtgtggggtgcggggactacagttactgtgtcagctgcatccacaaagggcccctcagtcttccctctggcccccagtagtaagagtacatctgggggaaccgcagcgctgggatgcctggtcaaagattacttccccgagcctgtcaccgtgtcgtggaactctggtgcacttacaagcggcgttcatacttttccagccgtgctgcagagcagtggtctgtattccctctcttcagtcgttactgtccctagctctagtttgggaacacagacctacatttgtaacgtgaaccataaaccctctaacactaaagtggacaaaaaagttgaacccaaatcgtgtgataaaacccacacttgcccaccctgtcccgcccccgagttgcttgggggaccatccgttttcctatttccacctaaaccaaaggacactctcatgatatcccgtacccccgaagtcacttgcgtcgtagtggacgtcagtcacgaagaccccgaggtgaagttcaactggtatgtggacggtgtggaggtgcacaacgcaaagacaaagccccgggaggaacaatacaacagcacctatcgggtagtttctgtcctgaccgtcttacatcaagattggcttaacggcaaagagtacaagtgcaaagtgtcgaataaggcgctgcctgctcccatagagaaaacaatctctaaagcaaagggacagccccgtgagccacaggtttacaccctgccgccgtcccgggacgaattgacaaagaaccaggtttcactcacctgcctggtgaaaggattctacccttctgacattgccgtcgagtgggaaagcaacggccaacccgaaaataattataaaacgacacctcccgtgctggattccgatgggtctttcttcctctatagtaagctcacggtagataagtcccggtggcagcaaggtaacgtcttttcttgttcagtgatgcatgaagctctgcacaatcactacacgcagaagagcctctctctgtctcctgggaaa

SEQ ID NO: 16032 - DNA, 1425 bp, Artificial Sequence
  Description of Artificial Sequence: Synthetic coding sequence
atggctgtgatggccccgcggaccctggtgctcctgttgagcggagctttggccctgactcaaacctgggcgcaagttcaactgcagcagccaggtgccgaactggtgaagcctggcgcgagcgtgaaaatgtcgtgcaaagcctcgggctatactttcactagctacaacatgcactgggtgaagcagactccgggacgcgggctggaatggatcggcgccatctacccggggaacggagacaccagctataatcaaaagtttaagggtaaggcgacgcttactgccgataagtcctcctccactgcgtacatgcagctgtcaagcctcacctccgaagatagcgcagtgtactactgcgcccgctctacgtactacggaggcgattggtacttcaacgtgtggggcgccggaactacggtgactgtgtcagcggcgtcgactaaaggaccttcggtgttccctctggccccgtcgtcaaagtcaactagcggcggaactgccgcgttgggatgcctcgtgaaagactactttcccgaacctgtgactgtgtcgtggaacagcggagccctgacctccggagtccacaccttcccggcggtgctgcagtcgtcggggctgtattctctctcgtcagtggttaccgtgccctcgtcgtcgctcggaacccagacgtacatctgtaacgtcaaccacaagccatccaacactaaggtcgacaagaaagtcgagccaaaatcgtgtgataagacccacacctgtcccccttgcccggcaccggaactgctcgggggaccgtcggtctttttgttcccgccgaagccgaaggatactctgatgatctcccggactccagaggtcacttgtgtggtggtggatgtgtcgcacgaggatccggaagtgaagttcaactggtacgtggacggcgtcgaagtgcataacgccaagaccaaaccgcgggaagaacagtacaattctacgtatcgggtggtgagcgtgcttaccgtgttgcaccaggactggctcaacggaaaggagtacaagtgcaaggtcagtaataaggcactgcccgccccgatcgaaaaaactatcagcaaggcaaaaggtcagccgcgcgaaccgcaggtctacacccttccaccatcccgcgacgagttgaccaagaaccaggtgagccttacctgcctcgtgaagggattttacccatcagacatcgcagtggagtgggaatcaaatgggcagccagagaacaattacaaaaccactccaccggtcctggattcggatggatcgttcttcctgtacagcaagctcaccgtggataaaagcaggtggcagcagggaaatgtgttttcgtgttcggtcatgcacgaggctctccataatcactacactcaaaaatcgctgagcctgtccccaggcaaa

SEQ ID NO: 16033 - DNA, 1425 bp, Artificial Sequence
  Description of Artificial Sequence: Synthetic coding sequence
atggccgtgatggccccccgcaccctggttttgttgctctccggtgccctggccctgacgcaaacttgggcgcaagtccaactccaacagccgggggctgagttggtgaagccaggggcatcagtgaaaatgtcatgcaaggcaagcggatacacttttacctcgtacaacatgcattgggtgaaacagactcctggacgggggctggaatggataggagcgatctaccccggaaacggtgatacctcctacaaccagaaattcaaggggaaggcgaccctgaccgcagacaaatcttcgtccacggcatacatgcagctctcctcgctcacgtccgaagactccgccgtctactactgcgctcgctccacctactacggaggagactggtactttaacgtgtggggcgccggcactaccgtgacggtgtccgcggcttccactaaaggcccgtcagtctttccgcttgctccgtcaagcaagagcactagcggaggaacggcggctctcggatgcctggtgaaggattacttcccagaaccagtgactgtgtcgtggaactcgggagcgctgacgtcgggcgtccacacgtttccggcagtgctccaatcgtccggtctgtattcgttgtcatcggtggtgactgtgccgagctcctctctgggaacccagacctacatctgcaacgtcaatcataagccgtcaaacaccaaggtggacaagaaagtggaacccaaatcctgcgataagacccacacctgcccgccgtgcccggcccccgaactcctggggggaccgtcagtgtttctgttcccaccgaaaccgaaagacactctcatgatctcccgcactcccgaagtgacctgtgttgtggtggatgtgtcgcacgaggaccctgaggtcaagttcaactggtacgtcgacggagtcgaggtgcataacgctaaaaccaaaccgagagaagagcaatacaattcgacgtaccgcgtggtgtcggtgctgactgtgctgcatcaagattggctgaacggcaaagagtacaagtgcaaggtgtcgaataaagctctcccagccccgatcgaaaagacgatctccaaggcgaagggacagccgcgggaacctcaagtgtacactcttccgccttcacgggacgagcttaccaagaaccaggtgtcgctgacctgcctcgtgaagggtttctacccgtccgatatcgcggtggaatgggaatcgaacggccagcctgagaacaactacaagaccaccccaccagtgcttgacagcgacgggagcttcttcctgtactcaaagctcactgtggacaagtcacgctggcagcaggggaacgtgttcagctgcagcgtgatgcatgaggccctgcacaatcattacacccagaagtcgttgagcctgtcccctggaaaa

SEQ ID NO: 16034 - DNA, 1425 bp, Artificial Sequence
  Description of Artificial Sequence: Synthetic coding sequence
atggccgtgatggcgccccgtacccttgtgttgctgttatcgggggccttggctttaacacagacctgggcccaggtccagctgcaacagccaggggctgaactcgtgaaacccggcgcatccgtgaagatgagctgtaaggcctcggggtatacgtttacctcctacaacatgcattgggtaaagcagaccccaggcagagggttggagtggatcggtgccatatacccaggaaacggagacacgagctataatcagaagttcaagggaaaagccactctgactgcagacaagtccagcagcaccgcctacatgcagcttagctctctgacgtcggaagactctgccgtgtattactgcgcaaggtcgacatactacgggggagattggtatttcaacgtttggggtgcgggaactaccgtgaccgtttctgccgccagtactaagggtccgagtgtgttcccactggcccctagttccaagtccacatccggcggtacagctgccctgggttgcttagtcaaagactactttcctgaacccgtgaccgtgtcgtggaactcaggcgcattgacttcaggggtgcataccttccccgccgtacttcagtccagtggtctttactccctgtcttctgtggtgactgtcccctctagctcacttgggacccagacttatatctgcaacgtcaaccacaaaccctctaacactaaagttgataagaaggtggagcccaaatcctgtgataagactcacacatgtccaccctgccccgctcccgagttattagggggtccctccgtgtttctgtttccccccaaaccaaaagacaccctgatgatctcacgaactcccgaagtgacctgtgttgttgtcgacgtcagtcatgaggaccccgaagtcaaatttaattggtacgtagacggcgtggaggtgcataacgccaagactaagccacgggaggaacagtacaactcgacataccgggtggtgagcgtcctgaccgtattgcaccaggattggctgaatggtaaagagtataagtgtaaagtgagcaacaaggcattgcccgcgccgattgagaagactatctctaaggccaaaggacagcctcgggagccccaggtctacacgctcccgccatcccgggacgaactaaccaaaaaccaggttagccttacatgccttgttaagggcttttatcccagcgatatcgccgtggagtgggagtcaaatggccagcctgagaataattataaaaccacacctcccgtgctggacagtgatggttccttcttcctctactctaagcttacggttgataaaagtagatggcagcagggcaacgtcttctcgtgttccgtcatgcacgaagccctgcacaaccattatacacaaaagtccttgtcccttagtccagggaag

SEQ ID NO: 16035 - DNA, 1425 bp, Artificial Sequence
  Description of Artificial Sequence: Synthetic coding sequence
atggccgtgatggccccaagaacactggtgctcctcctgtcgggcgcactggcactgactcagacttgggcccaagtgcaactgcagcagccgggggctgaactggtcaagccaggagcatcagtcaagatgagttgcaaggctagcgggtacacgttcacttcatacaatatgcactgggtgaaacagacccccggccggggcctcgagtggatcggggccatttatcccggtaatggagacaccagctataatcaaaagtttaaagggaaagccacgctgaccgcagacaaatcaagttcaactgcatatatgcagctctcaagtctcacttcagaagacagcgccgtttattactgtgcccgatcaacatactacggcggggactggtacttcaacgtctggggggctggcacgactgtcacagtgtcagcggcgtctaccaagggtcccagtgtcttcccactggctccctctagtaaaagcaccagcggtgggaccgccgctctgggatgtctggtgaaggattactttcccgaaccagtgactgtctcctggaacagtggtgctctgacctctggcgtccatacgtttccagccgtcctgcaatcaagcggtctttactcgttgtcatcagtcgtcactgtccccagttcttcactgggcacccagacctacatttgcaacgtcaaccacaagccaagcaacaccaaggtggacaagaaggtggagcccaagtcttgcgataagacacatacctgccccccatgcccggcccctgaacttctcggaggcccgagcgtcttcctgtttccacccaagcctaaggacaccctgatgattagccgcacccctgaggttacctgtgttgtcgtggacgtgagccacgaagacccggaggtgaagttcaactggtacgtggatggggtggaggtgcataacgcaaagacgaagcctcgggaggaacagtataacagcacctacagagtcgtttctgtcctgaccgtcttgcaccaggactggctgaatgggaaggaatacaaatgtaaagtttccaataaggcgctgcccgcccctattgagaagactatttcaaaggccaagggtcagccacgcgaaccccaggtctacaccttgcccccatcacgagatgagctcacaaaaaaccaggtttccttaacgtgcttggtgaagggattctatccaagcgatattgccgtcgagtgggaatccaatgggcagccggagaataattataagaccacacctcccgttcttgacagcgatgggtctttcttcctgtacagcaaactgacagtagataaaagcaggtggcagcagggcaacgtcttttcttgcagtgtgatgcacgaagccttacacaaccactacacccagaagagcctgtctttatctcctggcaaa

SEQ ID NO: 16036 - DNA, 1425 bp, Artificial Sequence
  Description of Artificial Sequence: Synthetic coding sequence
atggccgtgatggcaccaaggactctggtgcttctcctgtcgggagccttggctctcactcaaacgtgggctcaggtccagctgcagcaaccaggagccgagcttgtcaagcccggagcctcggtgaagatgtcatgtaaggcaagtggttacacctttacgtcctataacatgcactgggttaaacagacccccggtcggggcctggagtggattggagcgatctacccaggaaatggggatacctcgtataaccaaaagtttaagggaaaagctaccctcaccgcagataagtccagctcgactgcatacatgcaactttcctcactcacgtcggaggatagcgcagtttactactgtgcacgctcaacctactacgggggtgattggtactttaatgtgtggggggccggtaccactgtgactgtgtccgcagcgtcaaccaagggaccatccgttttcccacttgcaccctcgtcgaaatccacctccgggggtactgcggcactcgggtgtctggtgaaagactactttcctgagccggtgaccgtgtcttggaatagcggcgcactgacctccggagtgcatacgtttcctgccgtgcttcaatcctccggattgtactccctgtcaagtgtagtgactgtgccaagcagctccctgggaacccaaacctacatctgtaacgtgaaccataagccttctaatactaaagtcgacaagaaagtggagccaaagtcatgcgataaaactcacacctgtccgccttgcccagcacccgaattgttgggtggtccatcagtctttttgttcccgcccaagcctaaggatacccttatgatctccaggacgcccgaagtgacctgtgtcgtcgtggatgtgagccatgaggaccctgaggtgaagtttaactggtacgtcgacggcgtggaagtgcacaacgcaaaaacgaagcctcgagaagagcagtacaactcgacctaccgagtggtcagcgttcttacggtccttcatcaggactggctcaatggcaaggaatacaaatgtaaggtgagcaataaggctcttcctgcaccaatagaaaaaactattagtaaggcgaagggccaacctagagaacctcaggtctacaccctgcctcctagccgggacgaacttactaagaaccaggtcagcctgacctgcctggtaaagggattttaccctagtgacattgcagtggaatgggaatccaatggtcaaccggaaaacaactacaagactactccgccagtgctggatagcgatgggtccttcttcctgtatagtaagctcaccgtcgataagtcaagatggcagcaaggcaacgtgttctcctgctcagtgatgcacgaagctctgcataaccattacacgcaaaagtcgctttccctctctcccgggaaa

SEQ ID NO: 16037 - DNA, 1425 bp, Artificial Sequence
  Description of Artificial Sequence: Synthetic coding sequence
atggctgtaatggctccaagaacccttgtgttgttgctttcgggtgcgctagctttgacccagacatgggcacaagtgcagctgcaacagccaggggctgaactggtgaagcccggggcaagcgtcaagatgtcgtgcaaggcctccgggtatacattcacaagttacaacatgcattgggtcaagcagaccccggggcgaggcctggaatggattggtgcgatctaccccgggaatggtgatacctcctataatcagaagttcaagggaaaagctactctgacagccgacaagtcctccagcacagcttatatgcaactttcctccctgacatccgaggatagcgcggtttactactgtgcgcgcagcacttactatggaggcgattggtattttaacgtgtggggcgctggcaccaccgtgaccgtgtcagctgcatcgaccaaggggccttctgtgttccccctagccccctcatcgaaaagcacttccggcggaaccgcagcattggggtgtttagtgaaagattatttcccagagccagtcaccgtctcctggaacagtggggctctcacaagcggagtccacacgttccccgccgtgctgcagtcaagcgggttgtactccctgagcagcgtggtcacagttccctcgtcgtcgctcggcacccagacatatatctgtaacgtgaatcacaaaccttccaacaccaaggtagataagaaggtcgagccaaaatcatgcgacaaaacccacacgtgccccccctgtccagctcccgagttgctgggaggtccgtcagtgtttctgttcccacctaagccgaaagacactctcatgatctctcgaactccagaggtgacctgcgtagtggtggacgtctcacatgaagaccctgaggttaagttcaactggtacgtggatggtgtggaagtgcacaacgcgaagaccaagccaagggaggagcaatacaattctacctatcgggtggtctccgtcttgacggtactgcatcaggactggctgaacggcaaagaatacaagtgtaaggtgtccaacaaagccctcccggcccccatagagaagactatctcgaaggctaagggccagccaagagagccacaggtgtatacacttccgccatccagagatgaactgacgaagaatcaggtctccctcacatgcctagtgaaggggttctacccgtccgacatcgccgtagagtgggagagcaatgggcagcctgagaataactataagactactcccccagtgctcgacagcgacgggagctttttcttgtatagcaagctcacggttgataagtccaggtggcaacaggggaacgtcttctcctgttcggttatgcacgaggctctccacaaccattacactcagaaatcattatctctgtcccccggaaag

SEQ ID NO: 16038 - DNA, 1425 bp, Artificial Sequence
  Description of Artificial Sequence: Synthetic coding sequence
atggcagtgatggcacctagaacgctggtgcttcttctgtcgggtgccctcgccctcacccagacctgggcgcaagtgcaactccagcagcctggagcagaactcgtgaagccaggtgcaagcgtgaagatgtcatgtaaggcatccggatacactttcacctcttacaatatgcattgggtcaagcagactcctggaagaggactggaatggattggtgccatttatccaggtaacggagacacctcatacaaccagaagttcaaaggaaaggccactctcaccgcagataagtcctcgtcaaccgcgtacatgcaactttcctccctcactagcgaagattcagcagtctactactgtgctagatcgacctactacggtggcgattggtactttaacgtgtggggtgccggaaccacggtcactgtgtcggcagcatccactaaaggaccttcggtctttcctttggccccatcgtcaaaatcgacgagcggtggaacggcagcactcggatgcctcgtgaaggattacttcccagaacctgtgaccgtctcatggaactccggcgcacttacttccggagtgcacacgttccctgccgtgctgcaatcgagcgggctgtactcgctgagctcagtcgtgaccgtgccaagctcatcgctgggaactcagacctacatatgtaacgttaaccataaaccttcaaacactaaggttgacaaaaaagtggaaccgaagagctgtgataagactcacacttgccccccatgccctgcacccgaactcctcggaggaccctccgtctttttgtttcctccaaagcctaaggacactctgatgatttcaagaactccagaagtgacctgtgtggtggttgacgtctcgcatgaagatccagaagtgaagttcaactggtacgtcgatggggtggaggtccataacgcaaagaccaaaccacgagaggagcagtacaattcaacctacagagtcgtctccgtgctgaccgtgctccaccaggactggcttaacggaaaggaatacaaatgtaaggtcagcaataaggcactgcctgcccccatagagaaaactatctcgaaggctaaaggacagcctcgggaaccccaggtgtacacgctgccgccatcacgggatgaattgactaagaatcaggtgtcgcttacctgtctcgtcaaggggttttacccttccgacattgcagtggagtgggaatcgaatggacagccggaaaacaactacaagactaccccgcctgtgctggactctgatggatcgttttttctgtactccaaacttactgtggataaatcgaggtggcaacagggcaacgtctttagctgttcagtcatgcatgaagcactgcataaccattacacgcagaagagcctcagcctgtccccgggcaaa

SEQ ID NO: 16039 - DNA, 1425 bp, Artificial Sequence
  Description of Artificial Sequence: Synthetic coding sequence
atggcagttatggcccctcgcacgctggttctcctgctgagtggagccctggcactgacacagacgtgggcccaggtccagctgcagcagccaggcgccgaactcgtgaaaccgggtgccagcgtcaagatgtcttgcaaggcctctggatataccttcacgagctataacatgcattgggtcaaacagactcccggccgcggcttggagtggatcggcgcaatctatccgggtaacggagatacctcctacaaccagaagtttaaggggaaggcaacactcactgctgacaagagttcttcgaccgcttacatgcaattgagtagcctcaccagtgaggatagcgccgtttattactgtgcgcgctccacctactatggaggagactggtatttcaacgtttggggtgccggaacgaccgtgacagtcagcgctgcatccaccaagggcccttctgtctttcctttggccccatcctcgaagtccacctctggaggtaccgccgctctgggctgtcttgtcaaggattacttcccagagcctgtcaccgtctcgtggaactccggcgccttgacctcgggcgtccacacctttcctgccgtccttcagtcttccggtctgtattcgctgagttcagtcgtgaccgtcccatctagctctttgggcacccaaacctacatttgcaacgttaatcacaagccctctaacacaaaggtcgataagaaggttgaacccaagtcctgcgacaagacccatacctgccccccgtgcccggctccagaactgctgggtggcccgagcgttttcctgtttcccccaaagcctaaggataccctgatgatttcgcgcacccccgaggtgacctgcgtggtagtggacgtgagccacgaagatcccgaggtgaagttcaactggtacgtcgatggtgtcgaagtccataacgccaaaaccaagccgcgcgaggagcaatacaactctacgtaccgagttgtgagcgtcctaaccgttctccaccaggactggctgaacggcaaggaatacaagtgtaaggtctccaacaaggctcttccagcccctattgagaagaccatctccaaagctaagggtcaacctcgagagccgcaggtgtacactctgcccccgagtcgcgatgagctcacgaagaatcaggtgtcgctcacgtgtctggtcaagggattttacccttccgatatcgccgtggagtgggagtccaacggccagcctgaaaacaactataagaccacaccccccgtcctagattccgatggcagttttttcctgtacagtaaactcactgtggacaagtctcgctggcagcaaggtaacgtcttctcctgcagcgtcatgcacgaagccttgcataatcactacacccagaaatcgttgagcctttctccgggcaag

SEQ ID NO: 16040 - DNA, 1425 bp, Artificial Sequence
  Description of Artificial Sequence: Synthetic coding sequence
atggccgtgatggcacctcgcactcttgtgcttcttcttagtggggcactggcactgacccaaacctgggcgcaggtgcagcttcagcagcccggtgcagaactcgtcaaaccgggagcatcagtgaagatgtcctgtaaggcatcagggtatacctttacgtcatacaacatgcattgggtgaaacaaactcccgggcgaggtcttgagtggatcggggcaatataccctggaaacggagatacctcgtacaaccaaaagtttaagggtaaggcaactcttaccgctgacaagtcatcaagcactgcttatatgcagttgtctagtcttacttccgaggattcggccgtgtattactgtgcacgctccacctactacggcggagattggtacttcaatgtgtggggagctggtaccaccgtcaccgtctccgcagcgtcgactaagggcccaagcgtgtttccactcgccccaagctcgaaatccacctccggcggaaccgccgcacttggctgtctggtcaaggactacttccctgagcctgttactgtgtcgtggaactcgggagcccttacgtccggtgtgcatacctttccggctgtcctccaatcgtccggactttacagcctctcgtcggtcgtgactgtgccatcgtcctcgctgggtactcaaacctacatttgcaatgtgaatcataagccatccaatactaaggtggacaagaaggtggaacccaaatcctgtgataagactcacacttgccctccgtgccctgcgcccgagctcttgggaggcccttcagtgtttctgttccctccaaagccgaaagacactctgatgattagcagaactcctgaagttacttgtgtggtcgttgatgtgagccacgaagatcctgaagtcaagtttaactggtatgtggatggtgtcgaagtgcataacgcaaaaactaagccccgcgaggaacagtacaattcgacttaccgagtcgtgtccgtcctcaccgtcctgcatcaggactggctgaacggaaaggaatacaagtgtaaggtcagcaacaaggctctgccggctcccattgagaaaaccatctcgaaggcgaagggccagcctagggagccacaggtgtacactctgccgccatcccgcgatgaacttaccaagaaccaagtctccctgacctgcctcgtgaagggattttacccatccgatattgcagtggaatgggagagcaacggtcaacctgaaaacaactacaagactactcctcctgttctggattctgatggttcgtttttcctgtactccaagctgactgtggataagtcccggtggcagcaaggcaatgtgttctcctgcagtgtgatgcatgaagcacttcacaatcactacacccaaaagtccctctctctgtcccctggaaag

SEQ ID NO: 16041 - DNA, 1425 bp, Artificial Sequence
  Description of Artificial Sequence: Synthetic coding sequence
atggccgtgatggcaccgcgtaccctggtgctgctcctgtccggagcgctggctctgactcagacatgggcacaggtccagctacagcagccaggggcggaactggtgaagcccggagcttcggtcaagatgtcatgcaaggccagcgggtatacctttacatcttataacatgcattgggtcaagcagacccccggaagagggctagaatggatcggcgctatttatcccgggaacggggatacaagctacaatcagaagtttaaaggcaaggctaccctaactgctgataaatcctcctctaccgcctatatgcagctgagcagtctgacctcagaagatagtgctgtgtattactgtgcaagaagcacttactatggcggggactggtactttaatgtgtggggagcaggtaccaccgttacggtaagtgccgcctctacaaagggcccatccgtgttccccttggctccttcgtccaaaagtacttcaggaggtaccgccgccttgggctgtttggtgaaagactattttccagagcctgtgaccgtttcatggaactccggcgcccttactagtggggtccacactttcccagcagtcctccaatcttctggcctgtactctctgtctagtgtggtcacagtgcctagctcttcactggggacacagacctacatctgcaacgtcaaccacaaacctagtaacaccaaagtggacaagaaagtcgagccaaaaagttgcgacaaaactcacacctgtcccccttgccccgcgcctgaactcctgggcgggccaagcgtgttcctttttcctcctaaacccaaagatactctgatgatctctcggacacccgaggtgacatgcgtggtcgtcgatgtgtctcacgaagaccccgaagtgaagtttaactggtacgttgacggagtcgaggtccacaatgccaagacgaagcctcgcgaagagcagtacaactccacctacagagtggtgtccgtcctgacggtcctgcatcaagactggttgaacggtaaagaatataagtgcaaagtctctaataaggctttgcccgctcccatcgaaaaaacaatctccaaagccaaagggcagccaagggagccacaggtctataccctgccaccatctagggacgaactgacgaagaatcaggtgtccttgacctgcttggtcaaagggttctacccatcagatattgcagtggagtgggaatccaacggtcagccggaaaacaattacaaaaccaccccccccgtcttggacagcgacggatctttctttctgtactcaaagctgaccgtggataaaagccgatggcagcaagggaacgtgttttcatgttcggtcatgcacgaggctctgcacaaccactacacacaaaaaagcctgtctctgtctcccggaaag

SEQ ID NO: 16042 - DNA, 1425 bp, Artificial Sequence
  Description of Artificial Sequence: Synthetic coding sequence
atggcggtaatggcgccgcgaacgctagtactactactatcgggtgcgctagcgttaacgcaaacgtgggcgcaagtacaattacaacaaccgggtgcggaattagtaaaaccgggtgcgtcggttaaaatgtcgtgtaaagcgtcgggttatacgtttacgtcgtataatatgcattgggtaaaacaaacgccgggtcgtggtctagaatggataggtgcgatatatccgggtaatggtgatacgtcgtataatcaaaaatttaaaggtaaagcgacgctaacggcggataaatcgtcgtcgacggcgtatatgcaattatcgtcgttaacgtcggaagattcggcggtttattattgtgcgcgttcgacgtattatggtggtgattggtattttaatgtatggggtgcgggtacgacggtaacggtttcggcggcgtcgacgaaaggtccgtcggtatttccgctagcgccgtcgtcgaaatcgacgtcgggtggtacggcggcgttaggttgtttagtaaaagattattttccggaaccggtaacggtttcgtggaattcgggtgcgctaacgtcgggtgtacatacgtttccggcggtactacaatcgtcgggtttatattcgctatcgtcggtagtaacggtaccgtcgtcgtcgttaggtacgcaaacgtatatatgtaatgtaaatcataaaccgtcgaatacgaaagtagataaaaaagtagaaccgaaatcgtgtgataaaacgcatacgtgtccgccgtgtccggcgccggaactactaggtggtccgtcggtatttctatttccgccgaaaccgaaagatacgttaatgatatcgcgaacgccggaagttacgtgtgtagttgttgatgtttcgcatgaagatccggaagtaaaatttaattggtatgtagatggtgtagaagtacataatgcgaaaacgaaaccgcgtgaagaacaatataattcgacgtatcgtgtagtatcggtactaacggttctacatcaagattggttaaatggtaaagaatataaatgtaaagtttcgaataaagcgttaccggcgccgatagaaaaaacgatatcgaaagcgaaaggtcaaccgcgtgaaccgcaagtttatacgttaccgccgtcgcgtgatgaactaacgaaaaatcaagtatcgttaacgtgtctagtaaaaggtttttatccgtcggatatagcggtagaatgggaatcgaatggtcaaccggaaaataattataaaacgacgccgccggtactagattcggatggttcgttttttttatattcgaaattaacggttgataaatcgcgttggcaacaaggtaatgtattttcgtgttcggtaatgcatgaagcgttacataatcattatacgcaaaaatcgttatcgttatcgccgggtaaa

SEQ ID NO: 16043 - DNA, 1425 bp, Artificial Sequence
  Description of Artificial Sequence: Synthetic coding sequence
atggccgtcatggccccaaggacattggtcctcttgcttagcggcgcactggccttgacccagacgtgggcccaagtacagctccagcagcctggtgctgaattggtgaagccgggtgccagcgttaaaatgtcctgcaaagcgtctggctacacctttacctcctacaatatgcactgggttaagcaaacacccggaaggggacttgaatggatcggcgctatttatccgggcaacggagacacctcatacaatcaaaaatttaaaggcaaagctacactcaccgccgacaaatcctcaagcactgcttacatgcagctgagctccctcacctctgaagattccgccgtgtactactgcgctagatccacgtactacggtggagattggtatttcaatgtatggggtgctggcacaactgtgacggtgtcagctgcaagtacaaagggtccttcagtgttcccactcgctccctcaagcaaaagcacgtctggaggcaccgcagccttgggctgcttggtaaaggattactttcccgaacctgtgaccgtgagctggaactctggagccctgacttcaggtgtgcacacttttccagctgtattgcagtccagcggcctctactcactctccagcgtcgtgacagtcccttcttcctccttgggcactcagacctatatttgcaacgtaaatcacaagccatcaaacaccaaggtggataagaaggttgagcccaagtcatgcgataagacccacacctgcccgccttgtccagctcctgagctccttggaggtccatctgtatttctttttccgccgaaacccaaggatactctgatgatctcccgcactcccgaagtcacttgcgttgtagtcgacgttagccacgaggatccagaggtgaaatttaactggtacgtcgacggcgtggaagtgcacaacgccaagaccaaacccagggaggagcagtacaatagcacatacagggttgtgtccgtcctcactgtgctgcaccaagactggctgaacggcaaggaatataagtgcaaggttagcaacaaggccttgccggcgcctatagagaagacaatttctaaggctaagggacaacccagggaaccccaagtctacacccttccaccttcccgcgacgagctgacaaaaaaccaagtgagcctcacatgtctggtgaaaggattttatccctccgacatcgcagttgagtgggaatcaaatggccaaccagagaataactataaaactactcctccagtcctggactctgacggaagcttttttctgtactcaaagctgacggtggataagagtaggtggcagcagggtaacgtcttcagttgctctgtgatgcatgaggccttgcacaatcattacactcaaaagtccctgtccctgtcacctggcaaa

SEQ ID NO: 16044 - DNA, 1425 bp, Artificial Sequence
  Description of Artificial Sequence: Synthetic coding sequence
atggccgtgatggcgcccagaacgttggtgttactcttgtcaggtgcccttgccttgacacagacttgggcccaggtgcagctgcagcagccaggcgccgaactggtcaaacccggtgcaagcgttaaaatgtcctgtaaagcttcgggttatacgttcacatcctacaacatgcactgggtgaaacagaccccaggccgggggctggaatggattggcgccatctatccaggcaatggtgacacaagctataatcagaagtttaaggggaaggctacactcactgccgacaagagttcttcaacagcctatatgcagctgtctagtctaacctctgaagactccgcagtgtactattgcgcccgatcgacgtactatgggggagattggtacttcaatgtttggggagcagggacgaccgtgaccgtgagtgcagcatctaccaaaggaccatctgtgttcccactggcacctagtagtaaatcaacctccgggggtaccgccgccctggggtgtctcgtcaaggattactttcctgagccggtgactgtctcttggaacagcggagccctcactagcggggtccatacatttcccgccgtcctgcagagcagcggcttgtacagcttgagctccgtggtgacagtcccaagtagttccttgggcacgcagacttacatctgtaatgtcaatcacaagccttccaacaccaaggtggataaaaaagtcgagccaaagtcatgtgacaaaactcatacctgcccaccatgcccggctcccgaactactcggaggaccgagtgtttttttgttccccccaaagcccaaagacacactgatgatcagccggactccagaagtgacgtgtgtggtggtagatgtgtcacatgaggatcctgaggtaaaatttaactggtacgttgatggcgtggaggtgcataatgccaaaactaagccccgagaagagcaatacaattcaacttaccgtgtggtatcagttctgacagtcctacaccaggactggcttaatggaaaggagtataagtgtaaggtatctaacaaggccctgcccgcccctattgagaagactataagcaaagcaaaaggccaacctcgcgaacctcaggtgtacaccctccccccgagcagggatgagcttaccaagaaccaggtgtctctgacatgcctggtgaaaggtttctatccttccgatatcgcagtagaatgggagagcaacggccagcccgagaataattataagactacccccccagtactcgacagtgatgggagtttttttctgtatagtaagctcacggtggacaagagtaggtggcagcagggcaatgtgtttagttgttccgtgatgcatgaagccctgcacaatcattatactcagaaatccttgagcctcagtccaggcaag

SEQ ID NO: 16045 - DNA, 1425 bp, Artificial Sequence
  Description of Artificial Sequence: Synthetic coding sequence
atggcagtgatggcccctagaaccctggttctgctgctgtccggcgcactcgcgcttacccaaacctgggcccaagtgcagctgcagcaacctggagccgagcttgtcaaacccggcgcatccgttaagatgtcatgtaaggcatcaggctacacttttacttcctacaatatgcattgggtgaagcagactcctggtcggggacttgaatggatcggcgctatttaccctggtaatggagatacctcgtacaaccagaaattcaaagggaaggctacccttaccgctgataagtcatcgtccacggcatacatgcaattgtcatcactgacctcggaagattcagcggtgtactactgtgcccgatccacctactacggaggtgactggtactttaatgtgtggggggcgggtaccaccgtgactgtctccgcagcatctactaaaggcccgtcggtctttccccttgcgccgtcgtccaagtcgacgagcggaggtactgcagcactcggttgtctcgtcaaggattactttcccgaaccggtgaccgtctcgtggaactcgggcgcccttacctctggtgtgcatacttttcctgcagtcctccaaagctcgggcctttactcgctttcctcggtggtgaccgtgccctcctcttcactgggcacccaaacttacatctgtaacgtgaaccataagccaagcaacaccaaggtggacaagaaggtcgaaccaaaaagctgcgacaagacccacacgtgtcctccctgtccagctcctgagcttctcggaggaccttccgtctttctcttcccaccaaagcctaaagacactctgatgattagccggactcccgaggtcacctgcgtggtcgttgatgtgtcacatgaggacccagaggtcaaattcaattggtatgtggatggtgttgaggtccataacgcaaagaccaagcccagagaggagcaatacaactcgacttatcgcgtggtgtcggtgctgactgttctgcatcaggattggctgaacggaaaggaatacaagtgtaaagtcagcaacaaggccttgccagcaccaattgaaaaaaccatatcgaaggcaaagggccagcctcgtgaaccccaagtgtacacgctgccaccttcgcgcgacgaactgaccaaaaaccaagtgtcattgacctgtctcgtgaaagggttttatccttcggatatcgccgtggaatgggagtcgaatggtcaacccgagaacaattacaaaaccactccgccagtgctggatagcgatggttcctttttcctttactctaagctgaccgttgacaagtcccgatggcagcaaggaaatgttttttcctgctccgtgatgcacgaggcacttcacaatcactacactcagaagtccttgtccttgtcgcccgggaag

SEQ ID NO: 16046 - DNA, 1425 bp, Artificial Sequence
  Description of Artificial Sequence: Synthetic coding sequence
atggccgtcatggccccaagaactctggtcttgttgctctccggcgccctcgcactgactcagacgtgggcgcaggtgcaactgcagcagccgggagcagaactcgtcaaaccgggggccagcgtgaagatgtcatgcaaggcttccggatacaccttcaccagctacaacatgcactgggtgaagcagaccccagggcggggactcgaatggatcggtgcgatctaccccggcaacggcgatacttcgtacaaccagaagttcaaaggaaaggcaactctgacggctgacaaatcgtcgtcaactgcctacatgcagctctcatcccttactagcgaggattcggcggtttactactgcgcacgcagtacctactacggaggcgattggtactttaatgtctggggcgcaggcaccaccgtgacggtgtccgccgcttcgacgaaggggccgtccgtgttcccgctggcaccgtcaagcaagagcacctcgggagggactgccgcgctggggtgcctggtgaaggactactttccggaacctgtaaccgtctcgtggaactctggagcattgacctcgggagtccatacctttccggctgtgctgcagtccagcggactttactcgctgtcatccgtggtgaccgtgccgagctcgtccctgggaacccagacttacatctgcaacgtcaaccacaagccatcgaacaccaaagtggacaagaaggtggaaccaaagtcatgtgacaagacccatacctgtccaccatgcccggctcctgagctgctgggaggcccatcggtctttctgttcccgccgaaaccgaaggataccttgatgatctccagaacccccgaggtgacttgcgtcgtcgtggacgtcagccacgaggaccctgaggtgaagttcaactggtatgtggatggggtcgaggtgcacaacgcgaaaaccaagccgcgcgaagaacagtacaactccacttacagagtcgtttccgtgctcacggtcctgcatcaagattggctcaacggaaaggagtacaagtgtaaggtttccaacaaggccctgccggccccgatcgaaaagactatctcgaaggcgaagggacaacctcgggaacctcaggtgtacaccctcccgccgtcgagagacgaattgactaagaatcaggtgtcgttgacttgcctggtcaaggggttctacccttcagatatcgccgtcgaatgggaatctaatggacaaccggaaaacaattacaagaccaccccgccggtgctggacagcgacggctcatttttcctttacagcaagctgacggtcgacaagtcacgctggcaacaaggcaatgttttttcatgcagcgtcatgcacgaggcgttgcacaatcactacacccagaagtccctcagtctgtccccaggaaaa

SEQ ID NO: 16047 - DNA, 1425 bp, Artificial Sequence
  Description of Artificial Sequence: Synthetic coding sequence
atggcggtgatggcaccccgcaccctggtcctgctgctgtccggtgcccttgccctgactcagacctgggcgcaagtgcaactgcagcagccaggcgccgaactcgtgaaaccaggtgcatctgtgaagatgtcgtgcaaggcttcggggtacaccttcaccagctacaatatgcactgggtgaagcagaccccggggcggggactggagtggatcggggccatctatccgggtaacggcgacacttcctacaaccagaagttcaagggtaaggcaaccctcaccgctgacaaatcatcaagcaccgcatacatgcaactcagctcgcttacttccgaagattctgccgtgtattactgcgcgcgatccacttactacggaggagattggtactttaacgtgtggggagccggcactacggtgactgtgagcgccgcgtcaacgaagggacccagcgtgttcccgttggcgccatcctccaagtctacttcgggaggcaccgcagcactgggctgtttggtcaaggattactttccagagccggtgactgtcagctggaacagcggagccctcacctcgggagtccatactttccctgcggtgctgcagtcgtcaggcctctactccctttcgtcagtggtcaccgtaccatcatcaagcctgggcacccaaacctacatctgtaatgtgaaccacaaaccgtccaatactaaggtggacaagaaagttgaaccaaagtcctgcgataagactcatacgtgcccaccctgccctgccccggaactgttggggggtccgagcgtgttcctgtttccgcctaagccgaaagacaccttgatgatcagcagaacgccggaggttacctgcgtcgtagttgacgtgtcccatgaggaccccgaggtcaagttcaactggtacgtggacggagttgaggtacacaatgccaagactaaacccagagaagaacagtacaactcgacctaccgcgtggtgtccgtcttgactgtcctgcatcaggactggttgaatggcaaagagtataagtgtaaggtgtccaataaagctctgccggcgccgatcgaaaagaccatctcgaaggcgaaaggacaaccgcgcgagccgcaagtctacaccctgccgccgagcagggatgaactgacgaaaaatcaggtgagcctgacgtgcctcgtgaagggattctaccctagtgatattgcggtcgaatgggagtcgaacgggcagccggaaaacaactataagaccactccaccagtgctcgactcggacgggtcatttttcctgtacagtaagctcactgtggataaaagccggtggcagcaaggcaacgtgttctcctgctcggtcatgcacgaagcccttcacaaccactacacccagaagagtttgagcctcagtccaggaaag

SEQ ID NO: 16048 - DNA, 1425 bp, Artificial Sequence
  Description of Artificial Sequence: Synthetic coding sequence
atggcagtgatggccccgcgcactctcgtccttctcctgtctggtgccctggcgctgactcagacttgggctcaggtccaattgcagcagcccggagccgagctggtcaaacccggagcctcagtcaagatgtcttgcaaggcgagtggatacacattcacaagttataacatgcactgggtcaagcaaacacccgggcgtggtctcgagtggataggtgctatttatccaggtaatggagataccagctacaatcagaagttcaaaggaaaggctaccctaactgcggataaatcttcctccacggcctacatgcagcttagctcgctgacgtccgaagattcagccgtttactactgcgctcgttccacatattacgggggtgattggtacttcaacgtgtggggcgcaggcaccaccgtgaccgtgagcgctgcctccactaaaggtccttccgtctttcccttggccccatccagcaagagcacctctggtggcaccgccgctttaggctgtctggtgaaagactacttccccgagcccgtaaccgttagctggaactccggagcgctaacatctggtgtccatactttcccggctgttctccaaagctccgggctgtattctttgagctctgtcgtcactgtaccatcctcaagccttggcactcaaacgtatatctgtaatgtcaaccacaagccatctaacacaaaagtagataaaaaagtggagcccaagtcttgtgataagacacacacttgtcctccctgccccgcacccgagttgctggggggacccagtgtatttttgttccctcccaaacctaaggatacattgatgatctcccgaactcccgaggtcacctgcgtcgtcgtcgacgtgtcacacgaagaccccgaggtgaaatttaactggtatgtggatggagttgaggtgcataatgcgaagacaaaacccagagaagaacagtataattctacatacagagtggtcagcgtcttgaccgtcctgcaccaggattggcttaacggaaaagaatacaagtgtaaggtatcaaacaaagcccttcccgctcctattgaaaagacaataagtaaagcgaagggacaacccagggagccccaagtctacacactacctcctagccgggatgagctgaccaagaatcaggtctccctcacttgtctcgttaaaggattctatccgtcagacattgcggtggagtgggagtcaaatggtcaacccgaaaacaactataagaccacgcccccagtgctcgattctgatggaagcttcttcctttactcgaagctgaccgttgataagtcccggtggcagcagggcaacgtgttctcctgctctgtaatgcacgaggctctccacaatcactatacgcagaagtcactgtctctgtctccaggaaag

SEQ ID NO: 16049 - DNA, 1425 bp, Artificial Sequence
  Description of Artificial Sequence: Synthetic coding sequence
atggccgttatggcgcccaggacactggtgctgttactgagcggggcactggccttgactcaaacatgggcacaggtgcagcttcaacagccgggcgcagaactggtcaagccaggagcatcagtgaagatgtcttgcaaggcctcgggatataccttcaccagctataatatgcactgggtgaaacagactccgggcagaggcttggagtggatcggagcgatttatcccggcaacggagacacaagttacaaccagaaatttaaaggaaaggctaccctgacagcagacaaaagttcgagtacggcttacatgcagttgagcagtcttaccagcgaggattcagctgtgtattactgcgctagatctacatattacgggggcgattggtattttaacgtgtggggcgcagggaccaccgtgaccgtgagcgcagcatcaacaaaaggaccaagcgtgtttcctctggctcccagtagcaaaagcacgagcggcggtaccgctgccctggggtgtcttgtgaaggactattttccagagcctgtgaccgtgtcctggaatagcggcgcgctgacttctggagtgcatactttcccagctgtcctgcaaagctctggactgtacagcctgtcttctgtcgtcaccgtgcctagttcctccttgggaacacaaacctatatctgtaatgtgaaccataaacctagtaacaccaaggtcgacaaaaaggtcgaacctaaaagctgcgataaaacacatacctgtcccccctgtcccgctcccgaacttctgggcggccccagtgtgtttctgtttccacccaagcctaaggatacactcatgatctcaagaactccggaagtaacatgcgttgtcgtcgacgtctcacatgaggatccagaggtcaagttcaattggtatgtggacggtgttgaagtgcacaatgccaagaccaaaccgagagaagagcagtacaactcaacgtatcgcgtggtgtctgtactgaccgtgcttcaccaggactggctgaacggaaaggagtacaaatgcaaggtgtcaaacaaggctctgcctgctccaatcgagaaaacaattagtaaagctaaaggacaaccccgggagccccaggtctacaccctgcctccctcccgcgatgaattaactaagaatcaagtgagcctgacctgtcttgttaaaggtttctaccccagcgacatagctgtggagtgggaaagcaacgggcagcccgagaacaattacaagaccacacccccagtcttggatagtgatggctctttctttctgtacagcaagctcacagtggataaatcgagatggcagcaaggaaacgtgttttcatgctccgtgatgcacgaagccctacacaaccactacacacagaaatccctttctctgtctccaggtaaa

SEQ ID NO: 16050 - DNA, 1425 bp, Artificial Sequence
  Description of Artificial Sequence: Synthetic coding sequence
atggcagttatggcacctaggacattggtcctgctgcttagcggagctctcgcactgactcagacctgggcgcaggtccagctgcagcagcccggcgcggagctggttaaacctggggcatctgtgaagatgagctgcaaggcgagtgggtacaccttcacaagttataacatgcattgggtcaaacagacacctggccgggggctggagtggattggtgctatttacccaggtaacggggatacatcatacaaccagaagttcaagggaaaggccaccctcaccgccgataaatcttcctctacggcttatatgcagctttctagcttgacctcggaggactctgcggtctactactgtgccaggtccacctattacgggggcgactggtactttaatgtgtggggtgccgggactacggtcacagttagcgccgcttcaactaaaggacccagcgtctttccactggcgccctcctccaaatcgacctcaggaggcaccgcggccctgggttgcctggtcaaagactactttcctgagcccgtaactgtgtcttggaacagcggggcgttgacaagtggcgttcacacgtttcctgccgtcctccagagttctggtttgtacagcctgtcgtctgtcgtgaccgtgccctcctcgtcgcttggcacgcagacgtacatatgcaatgtgaatcacaagccatctaacactaaggtcgacaagaaggtcgaacccaaaagctgtgacaagacgcacacatgtccgccctgtccagctccagaactcctaggagggccctctgtgttcctgttcccgcctaaaccaaaagataccttaatgatttcacgtactccagaggtcacgtgtgtcgttgtcgacgtgtctcatgaagatccggaggtcaagtttaactggtacgtggatggagtcgaggtgcacaatgccaaaaccaagcccagggaagagcagtacaactccacgtaccgcgtcgtgagcgtcctgactgttctgcatcaggactggttgaacggtaaggaatacaagtgcaaggttagtaataaagctctacccgctcctatcgaaaagaccatcagcaaagccaaaggacagccgagggagcctcaagtatacacattacccccaagcagggacgagctgaccaagaaccaggtctcattaacatgtttagtcaaaggattttacccgagcgatatcgcggtggagtgggagtccaacggccaacccgaaaacaactataaaaccacaccaccagtgctagactccgacggctccttttttctatacagcaagctaactgtggataagagccggtggcaacaggggaatgtgttcagctgcagtgtcatgcacgaagcactccacaaccactacactcagaagtcactcagcctgtcaccggggaaa

SEQ ID NO: 16051 - DNA, 1425 bp, Artificial Sequence
  Description of Artificial Sequence: Synthetic coding sequence
atggcagtgatggcccctagaactcttgtccttcttttaagcggtgcgttggcactcacacaaacatgggcgcaggttcaactgcaacaaccgggggctgaattagttaagccaggcgcctcagttaaaatgagttgtaaagcttcgggctatacgttcacaagttataacatgcattgggtcaaacaaacaccgggccgtggattggagtggatcggagcaatctatccggggaatggagatacaagttataaccaaaaatttaagggtaaggcaacgttgactgcggataaatcttcatcaaccgcttatatgcaactgagtagccttacatcagaagattctgctgtttattactgtgcccgttcaacctactacgggggagactggtattttaatgtatggggtgctggcaccacagtaacagtatccgcggcttctaccaaaggcccctcggtatttccgcttgcgccgagttcgaagtcgacaagtggcgggacagccgcactcggatgcctcgtgaaagactactttccggaaccagtgacagtatcgtggaattcaggtgccttgacgtctggagtgcatacgtttcctgctgtgctgcaaagctcgggcttgtatagcttaagtagcgtggttacagtaccatcttcatctttgggtactcaaacctacatctgtaacgtgaatcataagccctccaatacaaaagttgataaaaaagtggaaccaaaatcatgcgataagacacatacatgtcctccgtgccctgcgccggaacttcttggcgggccgagcgtgtttttattcccacctaagccgaaagatacactcatgatttcacgaacaccggaagtcacatgcgttgtcgttgatgtaagccatgaggacccggaagtgaaatttaactggtatgtggacggcgtcgaagtccacaacgccaaaaccaaaccgcgtgaggagcaatacaattcaacttacagagttgtgagcgtcctaacggtgttgcatcaggattggcttaatgggaaggaatataaatgcaaagtcagcaacaaagccctgcctgctccaatagaaaagacgatttctaaagcaaaagggcaaccgcgagagccgcaggtttatacactgccgccctcacgggacgaactgacaaaaaatcaggttagcctgacatgcttggtgaaaggattttatcctagcgacatcgcagttgaatgggaatccaatggacaaccggagaacaattacaagacaacgcctccggttctcgattctgacggctcattttttttgtattccaagctaactgtggataagagccgctggcagcaaggaaacgttttttcatgtagtgttatgcacgaagcattgcacaatcactatacacagaaatccttgtcattgtctccgggtaaa

SEQ ID NO: 16052 - DNA, 1425 bp, Artificial Sequence
  Description of Artificial Sequence: Synthetic coding sequence
atggcagtcatggctcctcgtacattggtgctattgcttagtggagcgttggctctgacccagacctgggcacaagtgcaactccagcagcccggcgcggagttagtgaagcccggggcatctgttaaaatgagctgcaaagcatctggctacacattcacctcatacaatatgcactgggtgaaacagacaccaggacgcgggctagagtggattggcgccatctaccccggtaatggagatacttcttacaatcaaaagttcaagggcaaggcaaccctgacagccgataaaagcagctcaaccgcctacatgcagttgtcctctctgacaagcgaagactccgcagtctactactgtgcaaggtccacctattacgggggtgactggtacttcaatgtgtggggcgcgggaaccacagtgacagtgtctgctgctagtacaaaagggccctcagtgttccccttagctcctagttcaaagtctacttccggcgggactgcggctctggggtgtttggtcaaagactattttcccgaaccagtgactgtctcctggaacagcggagccttgaccagcggagttcatacatttcctgccgtattacagagttcaggactctacagcctgtcaagcgtggtcacagtcccaagctccagcctgggaacgcagacttacatttgtaacgtgaatcataaacctagtaacacaaaagtggataaaaaggtcgaaccaaagtcatgcgacaagactcatacctgccctccgtgccccgcgccggagcttttgggaggaccctccgtctttctgttcccaccgaagcccaaagacactctgatgattagcaggacccccgaagtgacttgtgtggttgttgatgtctcccatgaagatcctgaagtgaagtttaattggtacgtggatggagtggaggtacacaacgccaagactaaaccgagggaagagcaatacaacagtacgtacagagtcgtgagtgttcttaccgtgcttcatcaggattggttgaacggaaaagagtacaagtgcaaagtgtccaataaagctttgcccgcacctatagaaaaaaccataagcaaggctaagggccagcctcgggagccgcaggtgtacacgctgcccccctcaagagatgaactcaccaaaaatcaagtatctctcacttgtctggttaagggtttctatccatcggatatcgccgtcgagtgggaatccaatggccagcccgagaataactacaaaactactccgcccgtgttggattctgatggctccttctttctctattccaagctgacagtagataagagtcgatggcagcagggaaacgtattcagctgcagtgtcatgcacgaagcgttacacaaccactatactcagaagtcacttagtctctccccggggaaa

SEQ ID NO: 16053 - DNA, 1425 bp, Artificial Sequence
  Description of Artificial Sequence: Synthetic coding sequence
atggcagttatggctccgcgcaccctcgttttgctgctgtcgggagcgctcgcacttacccaaacctgggcgcaggtgcaactgcagcagcctggggctgaactggtgaaaccaggtgcttccgtgaagatgagctgcaaggcgagcggatataccttcacctcctacaatatgcactgggtgaagcagacgcccggccgcggcctcgagtggattggggctatctacccgggtaacggagacacgtcatacaaccagaaattcaagggtaaagcgactctgaccgccgataaatcatcctcaactgcgtacatgcaactttcctcgctgacctcggaggattcggccgtgtactactgtgcgcgctcgacctactacggaggggattggtatttcaacgtctggggggccggaaccaccgtcactgtgagtgccgcctcaaccaagggacccagcgtgtttccacttgccccctcatccaagtcgacgtcgggcggcactgcagcgttggggtgccttgtgaaggactacttccccgagcctgtgactgtctcatggaattcgggagccttgacctccggggtgcacacttttcctgcggtcctccagagctcaggactgtattctctgtcgtcggtcgtgactgtgccaagctccagcctcgggacccagacttacatctgcaatgtcaaccacaagccaagtaatacgaaggtggacaagaaggtcgaaccaaaaagttgcgataagacccacacttgcccaccgtgccctgccccggagctgctgggaggaccgtctgtgtttttgttcccgccgaaaccgaaagacactctgatgatcagccgcaccccagaggtcacctgtgttgtcgtggacgtgtcccatgaagatcctgaagtgaagtttaactggtatgtggatggtgtggaagtgcataacgccaaaacgaagccaagagaggaacagtacaacagtacgtacagggtagtgagcgtgcttactgtgctgcaccaggactggcttaacggaaaagagtacaagtgtaaagtgtccaacaaggcactccccgcgcccatcgaaaagactatctcgaaggctaagggacaaccccgggagccccaagtttacaccctgccgccgagccgagatgaactcactaagaatcaggtgtcgctcacttgcttggtgaaaggcttctacccgagcgacattgcagtggagtgggaaagcaatgggcaaccggaaaacaattacaagacgacccctcctgtcctggattccgacgggtccttcttcttgtattccaaactgaccgtggacaagtcccggtggcaacagggaaacgtgttttcatgcagcgtgatgcacgaagcactgcataaccattacactcagaagtccctgtcgctgtcgccgggaaaa

SEQ ID NO: 16054 - DNA, 1425 bp, Artificial Sequence
  Description of Artificial Sequence: Synthetic coding sequence
atggcagtgatggccccaagaaccctcgtcctcctcctcagcggggcacttgcgctgacccaaacctgggcccaagtgcaactgcagcagcccggcgccgaactggtgaagccaggcgcaagcgtgaaaatgtcttgcaaggcctcaggatacacctttacctcatacaacatgcattgggtgaagcagaccccgggaagagggctggagtggatcggtgcgatctaccctggaaacggggatacctcgtacaatcaaaagttcaaaggaaaggccaccctgacggctgacaagtcctcctcgactgcatacatgcagctcagctcgctgacgtcggaggactctgccgtgtactactgtgcgcggtccacctattacggaggagactggtacttcaacgtgtggggcgcaggaactaccgtcactgtgagcgcggcttccacgaaagggccctcggtgttcccgctggccccgtcgtcaaagtcgacctctggcggcaccgcggcgctcggctgcctggtgaaggattacttccctgagccggtgacggtgagctggaactctggagcactgacctccggcgtccacacctttccggccgtgctccaatccagcggcctgtattcactttcatctgttgtgactgtgccgagctcgagcctgggaacccagacctacatttgcaacgtgaaccacaagccatcgaacaccaaggtcgacaagaaggtggaacctaagtcgtgcgacaagactcatacgtgtcctccttgcccggcaccggaactcctgggaggtccgagcgtttttctgtttcctcctaagccaaaggatacgctgatgatctcgcggactccggaagtgacttgcgtggttgtggacgtctcccatgaggatccggaagtcaaattcaattggtacgtggatggggtggaagtccataacgccaagaccaaacctcgcgaagagcagtacaactccacctaccgggtcgtgtccgtgctgactgtgctgcatcaggattggctgaacgggaaagaatacaaatgcaaagtatcgaataaggccctcccagctcctatcgaaaagactatctccaaggcgaaaggacaaccccgcgaaccgcaagtgtataccttgcctccgtcgagagacgaacttactaagaaccaagtttcgctgacgtgtctggtgaagggattttacccatctgatatcgccgtcgagtgggaatccaatggccagccagaaaacaactacaagaccactccgccggtgttggattccgacggaagttttttcctgtactccaagctgactgttgacaaaagccgatggcagcagggcaacgttttctcctgctcggtgatgcacgaagccctgcacaaccactacactcaaaaaagcctgagcctcagcccgggaaaa

SEQ ID NO: 16055 - DNA, 1425 bp, Artificial Sequence
  Description of Artificial Sequence: Synthetic coding sequence
atggcagtgatggcccctagaaccctggtgctcctgttgtcgggtgccctggctcttacccagacttgggcacaggtgcagctgcaacagccaggagccgaacttgtgaagccgggagccagtgtgaagatgtcctgcaaggcctcggggtacacgttcacttcgtacaacatgcactgggttaagcaaactccgggacgcggcctcgaatggatcggcgcaatataccctgggaatggggataccagttacaatcaaaagtttaaaggtaaggctacccttaccgcagacaagtcgtcctcaactgcgtacatgcaactgtcgtcgctgacctcggaggactcggcagtgtattactgtgcaagatctacgtactacggtggagactggtactttaatgtgtggggtgcgggcaccacggtaactgtcagcgctgcctcaactaagggaccaagcgtctttcccctggcaccgtcatcgaaaagcaccagcggaggtaccgcagcgctcggctgtctggttaaagattactttccagagcctgtcactgtgtcatggaactctggggcactcactagcggggtccataccttccctgccgtgctgcaatccagcggtttgtactcattgtcatcagtcgtcactgtgccttcgagctccctcggaacccaaacctacatttgtaacgtgaaccacaagcccagcaacactaaggtagataagaaggtggaacctaagtcgtgcgataaaactcacacgtgtcctccctgtcccgcacccgagcttcttggaggcccttcagtgtttctcttccccccaaagcctaaagatacgcttatgatttcccgtacccccgaagtgacctgtgtcgtggtagatgtgtctcatgaagatccagaagtcaaattcaattggtatgtggatggagtggaggtgcataacgcaaaaaccaaacctcgagaagaacaatacaattccacctaccgcgtggtgtcagtcctgactgttcttcaccaggactggctcaacggcaaggagtataagtgcaaagtcagtaataaggcccttccggcacctatcgaaaagactatttctaaggcaaaggggcaaccccgggaacctcaagtgtacaccctgccaccatcgagggatgagcttactaagaaccaggtgagccttacgtgtctcgtcaaaggattttacccatcggacatcgcggtggagtgggagtccaatggtcagccagaaaacaactacaagactactcccccagtgttggactctgacggatccttcttcctgtactccaagctgaccgtcgataaatcccgctggcagcaaggtaacgtgttttcctgcagtgtgatgcatgaagcgctccataaccattacactcagaagtcgcttagcctttcgccaggaaag

SEQ ID NO: 16056 - DNA, 1425 bp, Artificial Sequence
  Description of Artificial Sequence: Synthetic coding sequence
atggccgttatggccccccgtactcttgtgctcctcctgtccggcgccctggccctgacgcagacctgggcccaggtgcaattacaacagccgggtgcggagctggtcaaacccggagccagcgttaagatgtcgtgcaaagcttccggctatacatttacatcatacaacatgcattgggtgaagcaaactccagggcgggggctagaatggattggcgccatttatcctggaaacggggacacgtcctacaaccaaaaatttaagggtaaagccaccctgaccgccgacaagtcatcctccactgcttacatgcagttgagttctctgacaagtgaggactctgcagtctattactgtgccaggagcacatattacggaggcgattggtatttcaacgtgtggggagcggggaccacagtgactgtgagtgcagcgtctaccaagggccccagtgtgtttcctctagcccccagctcaaaaagcaccagtggcggaacagccgcgctggggtgcctcgttaaggattactttccagagcccgtgaccgtcagttggaactccggcgctctgacctccggtgttcacacttttcctgccgtgctgcaaagctccggactctacagtctatcatctgttgttacagtgccctccagttccctgggcacccaaacctatatttgtaatgttaaccacaaacctagcaacaccaaagtagataaaaaagtggagccaaaatcctgtgacaagacacatacgtgtcccccttgcccagctcccgagttactcggtggtccgagcgtctttctgttcccaccaaagcccaaggatactttaatgatctcacgtacacctgaagtgacttgcgtagttgtagacgtgagccacgaggatcctgaggtgaaattcaactggtatgtggacggggtggaagttcacaacgccaagactaagcctcgggaagaacaatacaactctacctaccgcgtggtatctgtgctgacagtgttgcaccaagattggttgaacggcaaagagtacaagtgcaaagttagcaacaaagcattacctgcccctatcgagaaaaccatttccaaagcaaaaggacagcctcgcgaacctcaggtttacaccctccctcccagcagagatgagttaacaaaaaatcaagttagcttgacctgtcttgtgaagggattttatccctccgacattgcagtagaatgggaatcaaacggccaaccagaaaacaattacaagactacaccaccagtgttagacagtgacggctctttctttctctactctaaactgacggtggataaatcccgttggcagcagggtaatgtgtttagctgctccgtgatgcacgaagccttgcacaatcactacacccagaagtccctcagcctctccccagggaaa

SEQ ID NO: 16057 - DNA, 1425 bp, Artificial Sequence
  Description of Artificial Sequence: Synthetic coding sequence
atggctgtgatggccccgcgcactctggtcctgctcctgtcgggagccctcgccctcactcagacctgggcgcaggtgcagctgcagcaaccaggagcggagctggtgaaaccgggtgcgtccgtgaagatgtcctgtaaagcctcaggctataccttcacttcgtacaacatgcactgggttaagcagaccccagggaggggattggagtggattggagctatctaccctgggaatggggatacctcatacaaccaaaagttcaagggaaaggcgactctgacggccgataagagctcgtcgaccgcatacatgcaactgtcctccctgacttcggaggactcagctgtgtactactgcgcccgttcgacttactatggcggtgattggtactttaatgtgtggggagcgggaactactgtcaccgtgtcggctgcgtccaccaagggaccatcggtctttccgctcgccccaagctcaaagagcacttcgggcggaactgccgccctcggatgtctcgtgaaggactactttccggaacctgtcactgtgtcctggaactcgggagcactcacctcgggggtgcacacctttccggcagttctccaatcctcaggcctgtactcgctgtcgtcagtggttacggtcccctcatcctccctggggactcagacttacatctgtaatgtaaatcataagcctagcaacactaaggtggataagaaggtggagcccaagagctgcgataaaacccatacgtgccctccgtgtccagcgccggagctgctggggggtccatctgtgttcctgtttccgccaaagcctaaggatactctgatgatctcaagaaccccagaggtcacctgcgtcgtggtcgacgtttcccatgaggaccccgaagtgaaattcaactggtacgtcgatggcgtggaagtgcacaatgcaaaaaccaagccacgcgaggagcagtacaactcgacctaccgcgttgtctcggtcctgactgtcctgcaccaggactggctgaacggaaaggaatacaagtgcaaagtctcgaacaaagcactgccggccccgatcgaaaagacgatcagcaaggccaaaggccaaccgcgcgagcctcaggtgtataccctgccgccgtctcgggacgaactgactaagaaccaggtgtcactgacctgtttggtcaaaggcttttacccttccgacattgccgtcgagtgggaatcaaatggccagcctgagaataactacaagacgacgccaccagtgctggactcagacggttcgttctttctgtactcgaagctgactgtcgacaagtcgcggtggcaacaaggaaatgtgtttagctgctcagtgatgcacgaagccctgcacaatcactacacccagaagtccctctcacttagtccgggaaag

SEQ ID NO: 16058 - DNA, 1425 bp, Artificial Sequence
  Description of Artificial Sequence: Synthetic coding sequence
atggctgtgatggcgcctcgcacactcgtactcctcctgtccggtgctttggccctaactcagacctgggcacaggttcagctccagcagccaggtgccgagctcgtgaagcccggcgctagtgtcaagatgtcatgtaaggccagtggatataccttcacgagttataatatgcactgggtgaagcagacccccggaagggggctggagtggatcggcgcgatctacccaggaaacggagatacctcatacaatcaaaagttcaagggaaaagcaacgctgacggccgataaatcgtccagcaccgcttatatgcagctgagctcactcacctcagaagacagtgctgtgtattattgcgcccgctctacatactacggaggagattggtatttcaatgtgtggggggctggcaccacagtcaccgtgagcgcagcatccacaaagggcccatccgtcttccccctggcccccagctctaagtctacctctggcggaacagcggccctgggctgcctagtcaaggattattttcctgagcccgtcaccgtgagctggaatagcggtgctctaacgtctggtgtacacacattccccgccgttcttcagtccagcgggctttactctttgtcctctgtggtcactgtgccctcgtcgtctctgggtactcaaacttatatctgcaacgtgaaccacaagccaagtaacaccaaagtcgataaaaaagttgaacccaagtcttgcgacaaaacacacacctgcccaccatgccctgcgccagaactactcggtggtccctcagtattcctattccctcccaagccgaaggacactctgatgatttcccggactccggaggtcacctgcgtggtagtggacgtgagccacgaggaccccgaagtcaagttcaattggtatgttgacggcgtcgaggtacataatgcaaagaccaaaccccgggaagagcagtacaattctacctaccgcgtcgtgtcagtactgactgtgctgcaccaggattggttaaacggaaaggagtataaatgcaaggtctcgaacaaagccctgccagcacccatcgagaaaaccatctctaaagctaagggacaaccacgggagccccaggtgtacactctgccgccttccagggatgagctgacaaaaaatcaggtgtccctgacctgccttgtgaagggcttctaccctagcgacattgctgtggaatgggagtccaacggtcaacctgagaataactataaaacaactccgcccgttttggatagcgacggttcttttttcctctacagcaaactcaccgtggataagtcacgctggcagcagggtaacgtattctcttgctccgtgatgcacgaggctcttcataaccattacacgcaaaaaagcctaagtctgtccccagggaag

SEQ ID NO: 16059 - DNA, 1425 bp, Artificial Sequence
  Description of Artificial Sequence: Synthetic coding sequence
atggcagtgatggcgccacggactctcgtgctgctgctttcgggtgcactcgcactcacccagacgtgggcccaagtgcagctccaacaaccaggggcagaactcgtgaagccgggagcatccgtgaagatgtcctgtaaggcctcgggttatacgttcaccagctacaatatgcactgggtcaaacaaacccccggacggggactcgaatggataggcgcaatataccctggaaatggcgacaccagttacaaccagaagttcaagggaaaggcaactcttaccgctgataaatcgagctctacggcgtacatgcagttgtccagcctgacctcggaggattccgccgtgtactactgtgccagatcaacgtactacggaggagactggtactttaacgtctggggggccggtactaccgttactgtctcggccgcatcaaccaagggtccttccgtgtttcctcttgctccttcgtcgaagagcacctccggaggcaccgccgcgcttgggtgtcttgtgaaagattactttcccgaacccgtgaccgtctcctggaatagcggcgccttgacctcgggagtccacactttcccggcagtgctgcagtctagcggactgtattctctcagtagcgtggtgactgtgccttcgtcctcgctcggtactcaaacttatatctgtaatgtgaatcacaagcctagcaataccaaggtggataagaaggtggagcccaagtcatgcgataagacccatacgtgtccaccttgtccggccccagagcttctggggggtccttcggtctttctctttcccccaaagccaaaagacaccctcatgatttcaagaacccctgaagtcacttgcgtggtggtggatgtgagccacgaagatcccgaagtgaaattcaactggtacgtggacggggttgaggtgcataacgctaagaccaaacctcgagaggaacaatacaacagcacctacagggtggtgtcggtgctcaccgtgctccatcaagattggctgaacggtaaggagtacaagtgtaaagtgtcgaacaaggcccttcccgcacctattgaaaagactatcagtaaggcaaagggacagcctagagaaccacaggtctacactcttcctccctcacgagacgaactcaccaaaaaccaagtctccctcacttgtctggtgaaaggattctacccttccgatatcgcagtcgaatgggaatccaatggccagccagagaacaattacaagacgactccgcccgtgctggatagcgatggatccttcttcctgtactcaaaactcaccgtggacaagtccagatggcagcaggggaacgtcttttcctgctcggtgatgcacgaggctctgcacaaccattacacccaaaagtcgttgtcgctgtcgcctggcaaa

SEQ ID NO: 16060 - DNA, 1425 bp, Artificial Sequence
  Description of Artificial Sequence: Synthetic coding sequence
atggctgtgatggcacctagaaccctggtgctcttgctctccggtgcgctggcacttacgcagacgtgggcccaggtccaacttcaacagcctggagcagaactggtcaagcctggtgcatccgtcaagatgtcttgcaaggcctcagggtacacgtttactagctataacatgcactgggtgaagcaaactcccgggagaggacttgaatggataggagcaatctacccgggaaacggagacacctcctacaaccaaaagttcaaggggaaagcaaccctgactgcggataagtcctcatccactgcgtatatgcagttgtcgtccctgacctcggaggactcggctgtgtactactgtgccaggtcaacttactacgggggagattggtactttaatgtttggggagcaggtaccacggtgactgtgtccgctgcttcgaccaaaggcccctcggtgttccctcttgccccaagttccaaatcgacgagtggtggaaccgctgctctgggttgtcttgtcaaagactacttccctgaacctgtgactgtctcatggaactcgggagcacttacgtccggggtgcatacgttccctgcggtgcttcagtcgtcgggcctgtattccctctccagcgtggtgaccgtcccatccagctcccttggaactcagacctacatttgtaacgtgaatcacaaaccctcaaacacgaaggtggacaagaaagtggagccaaagtcgtgcgataagactcatacttgcccaccatgtccggcgcctgaacttctcggcggaccaagcgtgtttctctttccgcctaaacctaaggatactctcatgatttcccgcaccccagaagttacctgtgtggtggttgatgtgagccatgaagatcccgaagtcaaattcaactggtacgtggacggcgtggaggtacataacgcaaagaccaagcctagggaagagcaatacaattccacttaccgagtcgtgtcggtgttgactgtgctgcatcaagattggcttaatggaaaggagtacaagtgtaaggtttctaacaaggcacttccagcacctatagaaaagacgatcagtaaggccaaaggtcaaccgcgtgaacctcaagtgtataccctgcctccttcccgggatgaactcacgaaaaatcaagtgtcactgacgtgtttggtcaagggtttttacccatcggatattgcagttgagtgggaatcgaatggacaaccagaaaacaattacaagactacccctcccgtgctggactcggacggatcgttttttctgtactcgaagttgactgtcgataagtcaagatggcagcagggaaacgtcttttcatgctctgtgatgcatgaagcacttcacaaccattacacccagaagtcattgagcctctcccccggaaag

SEQ ID NO: 16061 - DNA, 1425 bp, Artificial Sequence
  Description of Artificial Sequence: Synthetic coding sequence
atggccgttatggctccccgaactctcgttctgctactgtctggtgcactggctctaacccagacatgggcacaagtacagctgcaacagcccggggccgaactggttaaacccggcgcctccgtgaagatgtcatgcaaagcctcgggatacacctttacaagttataatatgcactgggttaagcagactccaggtaggggcctcgagtggattggggccatttatcccgggaatggggatacgtcctataatcagaagttcaaagggaaagccaccctgacagctgacaaatccagctccaccgcttatatgcagctttcgagcttaacttctgaggactcagctgtttactactgtgcacggagcacttattacggaggcgactggtacttcaatgtgtggggcgccggaaccaccgtcaccgtgtcggctgcttcaaccaagggaccttcagtatttccgcttgctcccagtagcaaaagcactagcggggggaccgctgccctcggctgccttgtcaaggattactttcccgaacccgtgaccgtgagctggaattcaggtgctctcacttcgggcgtccacacattcccagccgtgctgcaaagctccgggttatatagtctgtcctccgtggtgacggtaccgtctagttcgttagggacgcagacttatatttgcaacgtgaaccacaagccctctaataccaaggtggacaagaaagtggaacccaaatcctgcgataaaacacatacttgcccaccgtgcccagctcccgaattgctgggtggccccagtgtcttcctgttccctcccaagcccaaggatactctcatgataagccggactcccgaagtgacgtgtgtggtagttgacgtgtcccacgaggaccccgaggtgaagttcaattggtacgttgacggggttgaggtgcataacgcaaaaaccaaacctcgggaggaacagtacaattcaacgtatagagtcgtgagtgtgctgactgtgctacaccaggactggctgaacgggaaggagtataagtgcaaagttagtaataaagccctgccggcgccaatcgagaagacaatttcaaaagcaaagggccagccccgagagcctcaggtgtataccctgccgccatctcgagatgaattgacaaaaaatcaagtttcactcacctgcttagtcaagggcttttatccaagtgacatcgcagtggaatgggagagcaatggacagccggaaaacaattataagaccacaccccccgttctggatagcgacggttcatttttcctgtacagcaagctcacggtcgataagtcccgctggcagcaggggaatgtgttctcctgcagtgtgatgcacgaggccttgcacaaccattatacacagaagtcactgtccctctctcctggtaaa

SEQ ID NO: 16062 - DNA, 1425 bp, Artificial Sequence
  Description of Artificial Sequence: Synthetic coding sequence
atggctgtgatggccccaagaaccctggtgttgctcctaagcggtgccctggcgctgacccagacctgggcccaggtgcagctgcaacagcctggggctgaactcgtgaagccaggagcgtcagtgaagatgagctgtaaggcaagcggttacaccttcacgtcatacaacatgcactgggtgaagcagacgcccgggcgcgggttagaatggataggagctatctatcccggtaatggggacaccagctacaaccagaagttcaaggggaaggcgacactcaccgccgacaagtctagttccacggcatacatgcagcttagtagtctcacaagcgaagattcagcggtgtattattgcgctaggtccacatactacgggggcgactggtacttcaatgtgtggggcgcaggtactactgttaccgtatctgctgctagcactaaggggccgagtgtttttccacttgccccctcatcaaaatcaactagtggagggacagctgccctcgggtgtctggttaaagattatttcccagagcccgtgacagtcagttggaattccggcgccctgaccagcggcgtgcataccttccctgcggtcctgcagtcctccggactatactcactcagcagcgtcgtgaccgtgccttcgtcatccttgggcacccagacttacatctgcaatgtgaaccataagccttcaaataccaaggttgacaagaaggtcgagcccaagtcctgtgataagactcatacctgcccaccttgcccggcaccggaattgcttgggggcccttccgtgtttctgttccctcccaagcccaaggacacgctaatgatttctcggacacctgaggtgacctgtgtcgtcgtggacgtcagtcatgaggatcccgaagttaaattcaactggtacgttgatggcgttgaagttcataatgccaaaactaagcctcgtgaggagcagtataatagcacatatagagtggtctccgtgctgaccgtcctgcaccaggactggctcaacggcaaggagtataaatgcaaggtcagtaacaaggcactccccgctccaatagagaagactatcagcaaagcaaaaggccagcctcgggagcctcaggtctacacactgcccccctcccgagatgaactcaccaaaaaccaagtctcactaacctgcctggtcaaaggcttctatccatcagacatcgctgtcgagtgggaatccaacggccagcccgaaaataattacaagacaacaccaccagtgctcgatagtgatggaagcttttttctctatagcaagctgactgtggacaagtcccgttggcaacaaggaaatgtgttctcatgttctgtgatgcatgaagcactgcacaaccattatacccagaaatctctgtcgctctctcccggcaag

SEQ ID NO: 16063 - DNA, 1425 bp, Artificial Sequence
  Description of Artificial Sequence: Synthetic coding sequence
atggcagtaatggcacccagaaccctcgtcctgttgctttccggagcgctggcactgactcaaacttgggcacaagtccagctgcagcagccaggcgccgagttggtgaagccaggggcatcagtgaagatgtcgtgtaaagcatcgggttacacctttacgtcgtacaacatgcactgggtcaagcagacccccggacgagggctggaatggatcggagccatatacccagggaacggtgatacctcgtacaatcagaagtttaagggcaaggctaccctgacggctgataagtccagttctaccgcatacatgcagctgtcctcactgacctctgaagatagcgccgtgtactactgcgcgcggtcaacttactatggaggtgactggtacttcaacgtttggggagccgggactactgtcactgtgagcgcagcaagcacgaagggcccatctgtgtttccactggctccaagctcgaaatcgacctctggaggaaccgccgctttgggttgtcttgtcaaggattactttcctgaacctgtcactgtgtcctggaattcgggggcacttacctcaggagtccatacttttcctgcggtgcttcaatcgtccggactttactcactttcctcggtggtcaccgtgccttcctcgtcattgggaacccaaacttacatctgtaatgtgaaccataaaccttcaaacaccaaggtggacaagaaggtcgaacctaaatcgtgcgataagactcatacttgtccaccctgcccggcacccgagttgcttggtgggccgagcgtctttctttttccacctaagccaaaggacaccctgatgatctcccgaacccccgaagttacctgcgtcgtcgtggacgtgagccatgaagatcctgaagttaagttcaactggtacgtggatggcgtcgaggtgcataatgcaaaaactaagcctagagaagagcagtataacagcacgtaccgggtggtgtcagtgcttactgtgcttcatcaagattggctgaacggaaaggaatacaaatgtaaggtcagcaacaaggcgctgccagcaccaatagaaaaaaccatcagcaaagctaaagggcagccacgcgagccacaagtttacactcttccaccatccagagacgaacttactaaaaaccaggtgtccctgacctgtctcgtgaagggattttacccttcggatatagccgtggaatgggagtcaaacggacagcccgagaataactacaagaccactcccccagttctggattccgacggatccttttttctgtactcgaagctcactgtggacaaaagccgttggcagcaaggtaatgttttctcctgtagcgtcatgcatgaagcactccacaatcattacactcaaaagtcgttgtcgctttccccaggcaag

SEQ ID NO: 16064 - DNA, 1425 bp, Artificial Sequence
  Description of Artificial Sequence: Synthetic coding sequence
atggccgtgatggcccctcgcactctggtgctcctgctcagcggcgccctggccctgacccagacctgggctcaggtccagttgcagcagccgggagcagaacttgtgaagccaggagcctcagtcaagatgagctgcaaggcatcgggatacactttcacctcatacaatatgcactgggtcaagcagaccccgggcagaggcctggagtggatcggagctatctaccccggaaatggagacactagctacaaccagaagttcaaaggaaaggcgactctcactgcggataagagctcgtcgaccgcctacatgcaactgtcgtcccttacctccgaagattccgcggtctactactgcgcccggtccacctactacggtggagattggtatttcaacgtctggggtgccggaactaccgtgactgtgagcgctgccagcactaaaggaccatctgtgtttccgttggcaccatcatcgaagtccacttcgggaggcaccgctgctctgggatgccttgtgaaagactactttcctgagcctgtaactgtgagctggaattcaggagcgctgacttcaggagtgcacaccttcccggccgtgctgcagtcgtcaggtctgtactcattgtcctccgtcgtaaccgttccctccagctcgctgggtacgcaaacttatatctgcaacgtcaatcacaagccatcaaataccaaggtggacaagaaggtggagcccaaaagctgcgataagactcacacgtgtccgccatgccctgcccctgaactgctgggagggccgtcagtgttcttgtttcctccgaaaccgaaggacaccttgatgatctcgaggactccagaggtgacgtgcgtcgtggtggacgtttcgcacgaagatccagaggtcaagttcaactggtacgtggatggggtcgaggtgcataacgcaaagaccaagccacgggaggaacaatacaactcgacttaccgcgtggtgtcagtcctgaccgtgttgcaccaggattggctcaacgggaaggaatacaagtgcaaggtgtctaacaaggccctgccagccccgattgaaaaaactatcagtaaggccaagggacaaccgcgcgagccccaagtctacaccctgccaccaagcagagacgagcttacgaaaaatcaagtgtccctgacctgcctcgtcaagggattctacccgagcgacatcgctgtggaatgggagagcaatggacaacccgaaaacaactacaagacgacgcccccagtgctcgactcggacggatcttttttcttgtattcgaagttgactgtcgacaagtccagatggcagcaaggaaacgtgttctcctgctcggtaatgcacgaggcccttcataaccattacactcaaaaatcgctgagcctctccccaggcaag

SEQ ID NO: 16065 - DNA, 1425 bp, Artificial Sequence
  Description of Artificial Sequence: Synthetic coding sequence
atggccgtgatggcgcctcggacactggtcctgctgctctcgggggcgctggcgctgacccagacttgggctcaggtgcaattgcagcagcccggggctgaactggtgaagccaggtgcatctgtgaagatgtcttgcaaggccagtgggtacacctttacgtcatacaacatgcactgggtgaagcaaacaccggggcggggactggagtggattggcgcaatctacccaggcaacggggacacatcatataatcagaaatttaaaggaaaagccaccctcactgccgacaagtcctcctctacagcgtatatgcagttgtcatcccttacaagtgaggactctgccgtatactactgcgccagaagcacctattacgggggcgactggtatttcaacgtctggggggcaggaactacggtgaccgtatcagccgctagcaccaaagggccctcagtgtttcccttagcccctagttctaagtcaacctccgggggaactgctgctctggggtgtctggtcaaagattacttcccagagcctgtgacagtctcctggaattctggcgcgcttacgtcgggggtccatacctttcccgccgtccttcaatctagtggactttacagtctcagttccgtggtgaccgtcccttctagttccctcggcacacagacatatatttgcaacgtcaatcataaaccatccaacacaaaagttgataaaaaagttgaaccgaagtcctgtgacaaaacacatacgtgtcccccttgcccagctccggaactgctcgggggaccttctgtcttcctattccctccaaaaccaaaagacacactgatgatctcccgcacaccggaggtaacctgtgtggttgtggacgtttctcacgaggatccagaagtcaaatttaattggtatgtggacggcgtagaagtgcataacgcgaagaccaagcccagagaagaacagtataactccacctaccgagtagtcagcgtacttactgtgctacaccaggattggctgaacggaaaggagtataaatgcaaggtttcgaataaagctctcccagctcctattgagaaaacaatttctaaagcaaagggccagcctagggagcctcaggtgtacaccctccccccatcccgggacgagttgacgaagaaccaagtcagcctcacctgtcttgtgaagggcttttacccgagcgatatagccgtcgagtgggaatctaatgggcagcctgaaaacaactacaagacaacccctcctgtcttggacagcgatggcagttttttcctatacagtaaactgactgtggacaagtctcggtggcagcagggcaacgtcttcagctgcagtgtgatgcatgaagcgctgcataatcattatacccagaaatcactgtccctatccccaggtaag

SEQ ID NO: 16066 - DNA, 1425 bp, Artificial Sequence
  Description of Artificial Sequence: Synthetic coding sequence
atggcagtcatggctccccgcaccctcgttctgctgttgtcaggtgccttagctcttacgcaaacctgggcccaggtccaattgcagcagccgggcgcggagcttgtgaagcccggtgcttctgttaagatgtcctgcaaagccagcggctatacctttacctcctataacatgcactgggttaagcagacccctgggcgtggcctggaatggattggagcgatctaccctggaaatggtgacacatcctataatcaaaagttcaagggcaaagcgacccttacggcggacaaatcgtcttcaacagcctacatgcagctgtctagcctaacatccgaagacagcgcggtatactattgtgcccggtcgacttactacggtggggactggtatttcaacgtctggggagctggcactaccgttactgtgagtgcggcctcaacaaaggggccttccgtgtttccactggctccctcctctaagagcaccagtggtggcacagcagctctagggtgcctggtgaaggattacttccctgagcctgtgacagtatcatggaactcaggagctttgacctcaggagtccacacctttccagccgtcctacagtcctccggactttacagcctgtcttctgtggtgactgtcccctcctcaagcctggggacccaaacatacatctgcaacgtgaaccacaaacctagcaataccaaggtggacaaaaaggtcgaaccaaagtcatgtgacaaaactcacacctgcccaccgtgccccgccccagaactgctcggaggacccagcgtgttcctgtttccacctaagccgaaagacactcttatgatttcacggacacccgaagtcacctgcgtggtggtggacgtctcacacgaggaccctgaagtgaaattcaattggtacgtcgacggagtggaggttcacaatgctaaaaccaagccgagggaggagcagtacaattccacatatcgcgtagttagcgtcctgacagtgctccatcaagattggttgaatggcaaggagtacaaatgcaaggtgagtaataaagcacttcctgcacccattgaaaaaaccatcagcaaagcaaaagggcagccgagagagccccaggtgtacaccttgccaccgagccgggacgagctgaccaagaatcaagtgagtctgacctgtctggtgaaggggttctacccctcagacattgctgtcgagtgggagtctaatgggcagccagagaataattacaagaccaccccaccagtgctggactcagatggctcgtttttcttgtattctaaactgaccgtggacaaaagtaggtggcagcagggcaacgtgttcagctgcagcgtcatgcatgaagccctacataaccattatacgcagaagtcactgagcctatcacccggcaaa

SEQ ID NO: 16067 - DNA, 1425 bp, Artificial Sequence
  Description of Artificial Sequence: Synthetic coding sequence
atggccgttatggcccctcgaactttagtcctgctattgagcggagcactcgcattgacccagacatgggcccaagtccaactccaacagcccggggcagaacttgtcaagcctggcgcatcggttaaaatgagctgtaaggcaagtggctatacatttaccagctacaacatgcactgggtcaagcagacgccaggaagaggcctggaatggattggtgctatttaccctggtaatggtgataccagctacaatcagaagtttaaagggaaggctacgctgaccgcagacaaatcatcatcaacggcttatatgcaacttagcagcttaacatccgaggattctgccgtgtactattgtgcccgatcgacctattacgggggcgactggtatttcaacgtttggggggcagggacgaccgtcacagtgagtgcagctagcacaaaggggccatccgtgttccctttggccccatctagtaaatcaacaagcggaggcactgccgccctgggttgcctggtaaaggactatttccctgaacccgtcactgtctcatggaattcaggggctctgaccagcggcgtgcacacttttcccgctgttttgcagtcttccggcctgtactctttgtctagtgttgtgaccgtgccttcaagctcactggggacgcagacatatatctgcaatgtgaaccacaagccttctaatactaaggtcgacaaaaaagtggagccaaaatcctgtgataaaactcacacgtgtcccccctgcccagcccctgaattgcttgggggacccagcgttttcttgtttcctccgaaaccgaaggatacattgatgataagcaggactccagaagtcacttgtgtggtggtcgacgtcagccacgaagacccagaggtgaagttcaattggtatgtagacggagtcgaggtgcataacgctaagactaaacctagggaagagcagtacaacagtacttaccgagttgttagcgtcctcacggtgctgcatcaggattggttaaacggaaaggagtataagtgtaaggttagtaacaaggccctgcctgcccctattgaaaagactataagtaaagccaaagggcagcccagggagccacaagtgtataccttgcctccatcaagagacgaactgaccaaaaatcaggtaagtctgacttgcctggtgaaaggtttttatcccagtgatatcgcggttgaatgggagagcaacggacagccagaaaataattataaaaccacccccccagtgttggattctgatggatccttttttctctacagcaagttgacggtggataagtcccgctggcagcagggaaatgtgtttagctgtagtgtgatgcatgaggctctgcacaaccactatacccagaagtctcttagccttagccccggcaag

SEQ ID NO: 16068 - DNA, 1425 bp, Artificial Sequence
  Description of Artificial Sequence: Synthetic coding sequence
atggcggtgatggccccacggactcttgtgttgctacttagcggcgcgctcgctcttactcaaacctgggcgcaagtgcagctgcagcagcctggagccgagttggtgaagccgggagcgagtgtaaagatgtcatgcaaagcgagcggttatacctttacctcgtataatatgcattgggtgaagcaaacccctggacggggactagagtggattggagccatctatcccggaaacggagatacgtcgtacaatcagaagttcaagggcaaggcaaccctcacggcggacaagagtagttccactgcctacatgcagctgagctcgttaaccagcgaggattcggctgtgtactattgcgcgcgtagtacgtattatggcggcgactggtacttcaacgtgtggggagcaggcactaccgtaacggtgagtgccgcatcgaccaaaggccccagcgtcttcccgctagcgccgtcgagtaagtcgacaagcggtggtaccgccgcccttggctgcctggtaaaagattacttcccggagcccgtgacggtgagctggaactccggtgcgctaacctcaggcgtacacactttccctgcggtcttgcagtcgagcgggttgtattcgctgtcgagcgttgtcactgtaccctcatcgtccctcggcacccagacgtacatttgcaacgtcaaccacaagccgagcaataccaaggtggataaaaaggtagaacctaagagctgtgataagacgcatacctgtcccccgtgccccgcgcccgaactgctggggggtcccagtgtgtttttgtttcccccgaagccgaaggacactctgatgattagccgcacgcccgaggtcacttgcgtcgtggtggacgtgtcgcatgaggatccggaggtgaaattcaactggtacgttgacggcgtcgaagtacacaacgccaagaccaagccgcgcgaagagcaatataacagtacgtatcgagtggtctcagtcctgacggtgctccatcaggattggctgaacgggaaggagtataagtgcaaggtgagcaacaaagccttgccggcgccgatagaaaaaacgatatctaaggcgaagggtcagccacgcgaaccccaggtgtacacgctccccccatcccgagacgagctgacgaagaatcaagtctctttaacgtgcctagtgaagggtttctatccttccgacattgctgtagagtgggagtcgaacggacagccggagaacaactataagaccacgcccccagtactggactctgacggctcgttcttcctgtactcgaagttgaccgtggataagagtcgctggcaacagggcaacgtcttctcatgctcggtcatgcacgaggccttgcataaccattacacgcagaaatccttatcccttagcccaggaaag

SEQ ID NO: 16069 - DNA, 1425 bp, Artificial Sequence
  Description of Artificial Sequence: Synthetic coding sequence
atggcagtcatggcgcctcgcacactcgtgctgctcctgtccggggcattggccctgacacagacttgggctcaggttcagttgcagcagcccggagccgagttggttaagccaggagcaagtgtgaagatgagctgtaaggctagtggctacactttcacttcatacaacatgcattgggttaaacaaacacctggcagggggctggagtggattggagccatctatcctggaaacggcgacacttcatacaaccaaaagtttaaaggcaaagctaccctaaccgctgacaaaagttctagcacagcgtacatgcaattgtcaagccttacctctgaagatagcgctgtgtactactgcgcccgctccacatattacggtggggactggtacttcaacgtgtggggcgcagggaccactgtgaccgttagcgctgcaagcacaaaaggcccaagcgtttttccgttagcacccagcagcaaatcaacctccggagggacagctgctctgggatgtctggtcaaggattatttccccgaacctgttacagtgagctggaactccggcgccctgactagcggcgtgcataccttcccagccgtgcttcagagctctggattgtacagcctgagctccgttgtcactgtaccgtcgagcagcctgggtactcagacgtacatatgcaacgtgaatcacaaaccaagcaataccaaggtggacaagaaggtggagccaaaatcctgtgacaaaacccacacttgccccccctgtcccgcaccagaactcctgggaggaccgagcgtgttcctgtttcctccgaaaccaaaggatactttgatgatcagcaggacccccgaagtgacatgcgtcgtagtggatgtgtcacatgaggaccctgaggtgaaatttaactggtacgtagacggagtcgaggttcacaacgccaaaacgaaaccaagggaggaacaatataacagcacataccgcgtggttagtgtcctgaccgttcttcaccaggattggctaaatggaaaagaatacaagtgcaaggtgagcaacaaggcgctacctgcccccatcgaaaagactatttccaaggccaagggccaacctagagaacctcaggtgtacacactacccccaagccgcgatgagcttaccaagaatcaggtgtcactcacctgcctggtgaaaggcttttatcctagcgatatcgcagttgagtgggagtctaacggacagccagaaaataactacaaaaccaccccacctgttctcgacagcgatgggtctttctttctgtactcaaagctaactgtggacaaatctcggtggcagcaagggaacgtcttcagctgcagtgtgatgcacgaggctctccataatcattacacacaaaaatccctgagtctgagccccggcaaa

SEQ ID NO: 16070 - DNA, 1425 bp, Artificial Sequence
  Description of Artificial Sequence: Synthetic coding sequence
atggccgtcatggccccgagaacgctggtcctcctgctttcaggggcactggcgctgacccagacttgggcgcaggtgcaactccagcaaccgggagcagaacttgtcaagccgggcgcgtccgtcaagatgagctgcaaggcatcggggtacactttcacgtcctacaacatgcactgggtgaagcagactccaggaagaggcttggaatggatcggagccatatacccaggcaacggagacacgagctacaaccaaaagtttaaaggaaaggccaccctcaccgccgacaaatcgtcgagcacggcttacatgcagctctcatcgttgacctcggaagattccgcagtgtattactgtgccaggtcaacctactatggaggggactggtacttcaacgtctggggagccggtactacggttactgtgtccgcagcttccaccaagggaccgtccgtctttccactcgccccgtcatcgaagtcaacctcgggcggaactgctgccctgggctgtctggtcaaggactacttccctgaacctgtgaccgtgtcctggaacagcggagccctgactagcggcgtgcataccttccctgcggtgctgcagagttccggcctctactctctttcatccgtcgtgactgtgccctcgtcctcactggggacccaaacttacatctgcaacgttaatcacaagcccagcaacaccaaggtagacaagaaggtggagccgaagtcctgcgacaagacccatacctgcccgccatgcccagcgcccgagctcctggggggaccatcggtattcctcttcccgccgaaaccaaaggatacccttatgatctcgcgcactcctgaggtgacttgcgtggtggtggatgtgagtcacgaagatcctgaggtcaagttcaattggtacgtggatggagtcgaagtccacaatgccaagacgaaaccacgcgaggaacagtacaatagcacttaccgcgttgtctccgtcctgaccgttcttcaccaagactggttgaatgggaaagagtataagtgcaaagtgagcaataaggcactgccggcgccgatcgagaaaactattagcaaggctaagggacagccacgagaaccccaggtgtacactctgccgccctcgcgtgatgaactcactaagaaccaggtgtctttgacgtgtctggttaagggattttacccgtccgacatcgccgtggagtgggaaagcaacggacaacctgagaacaattacaagactacccctcccgtgttggactctgatggttcgtttttcctgtacagcaaactgaccgtggacaaatctaggtggcagcaaggaaacgtgttctcttgctctgtgatgcatgaagcactgcacaaccattacacccagaagtcgctgagcctctccccgggtaaa

SEQ ID NO: 16071 - DNA, 1425 bp, Artificial Sequence; identical to SEQ ID NO: 16009
  Description of Artificial Sequence: Synthetic coding sequence

SEQ ID NO: 16072 - DNA, 1425 bp, Artificial Sequence
  Description of Artificial Sequence: Synthetic coding sequence
atggctgtgatggccccacggactctggtgctcctattgtctggggccttagcgctcacacagacctgggctcaggtgcagctacagcaacctggagccgagctggtgaagccaggggccagcgtgaaaatgtcctgtaaagcctccgggtacacctttactagctataacatgcattgggtgaagcagacccccgggcgaggactggagtggatcggcgcgatctatccgggaaacggggacacatcctacaaccagaagtttaaaggaaaggccaccctgactgctgataaatcaagctcaaccgcttacatgcagctgtcaagcctgacatccgaagattccgccgtgtattattgtgcccgctcaacatactatggaggagattggtactttaatgtgtggggggctggcaccaccgtgaccgtgtccgcagctagtaccaagggcccaagcgtgttcccactcgctcccagctctaaatcaacttctggggggactgctgctcttggatgtcttgtgaaggactattttccagagcccgtaacagtgagctggaacagcggagcactgacttcaggcgtgcacacgtttcccgctgttctgcagagctccggactttattccctaagctccgtcgtcacggtcccctcctcctctctggggacccaaacctatatctgtaacgtgaatcacaaaccaagcaacaccaaagttgataaaaaggtggaacccaaatcttgcgataaaacgcacacctgccccccatgtcctgctccagagctgctcggaggtccaagtgtgttcctctttccacccaagccaaaggacactctcatgattagcagaactccagaggtgacttgtgtagtggttgacgtttcccatgaggaccctgaggtgaagtttaactggtacgtggacggcgttgaggtgcacaatgccaaaaccaaaccacgcgaagaacagtacaattccacttaccgcgtggtctccgttctcacagtacttcaccaggactggctaaatggaaaggagtacaagtgcaaggtctccaacaaggcgctccccgcccccatagaaaagaccatctcgaaggcaaagggacaaccgcgggagccacaggtgtatacactcccccccagcagagatgagctcacaaagaatcaagtgtcgttgacctgcctggttaagggtttttatcccagtgacattgcggttgagtgggagtcaaatgggcagcccgagaacaactacaaaactacacctccggtgctcgattccgatggcagcttcttcttgtacagtaagctgaccgttgacaagtcgcgttggcaacagggaaacgtcttctcttgctcggtgatgcatgaggcactccacaaccattacactcaaaagagcctcagcctgtctcctggtaag

SEQ ID NO: 16073 - DNA, 1425 bp, Artificial Sequence
  Description of Artificial Sequence: Synthetic coding sequence
atggcggtaatggctccaagaaccctggtactattgctgagcggcgcactggccctgactcagacctgggcccaggtgcagcttcagcagcctggggccgaactggtgaagcccggcgccagtgtaaaaatgtcctgtaaggccagtggctacactttcaccagttataatatgcactgggtaaaacagactcctgggcgcggcctcgaatggattggcgccatctatcccggcaatggagacacgagttataatcagaagttcaaggggaaagccaccctcacagctgacaagtctagttcaactgcttatatgcagctttcatccttaacaagtgaggattccgcggtctactactgcgcccgaagtacgtactacgggggcgactggtattttaatgtttggggcgcagggacaacagtgaccgtgagcgccgcgagtactaagggtccctcagtctttcctctcgcaccttcatcaaaatccacgagcgggggtaccgccgccctcgggtgcttagtgaaagactacttccccgagcccgtgacagtgtcatggaacagcggcgcattgacttcaggagtgcacacattccccgcagtgctgcagtcatccggcctctactccctgtcttccgttgtgaccgtgccctcatcaagcctggggacccagacttacatttgtaatgtgaatcacaaaccctcaaacaccaaagtcgataagaaagttgaaccaaaatcttgtgacaagacccatacctgtcccccatgtcctgctccagagttgcttggcggtccttccgtgtttctcttcccccccaagccaaaggacaccctgatgattagtcgcaccccagaggtcacctgtgtcgtggtagacgtaagtcatgaagatcctgaagtgaagtttaattggtatgtagatggtgtcgaagtacacaacgcaaagaccaaacctcgggaagagcaatacaactcaacctacagggttgtgtcggtactcaccgtactccatcaggattggctcaacgggaaggaatataaatgtaaggtaagcaacaaagcccttcccgcccctatcgagaagacaatttcaaaggcaaagggccaaccccgggaaccgcaagtatataccttgcccccaagcagagacgagcttaccaaaaaccaggtgagcttgacatgcctggtcaagggcttctaccccagcgacattgctgttgaatgggaatctaatggacagcctgaaaacaattataaaacaacaccccctgtgctcgatagtgacggcagtttttttctgtattccaagctcactgttgataaaagccggtggcagcaggggaatgtgttctcttgttccgtaatgcatgaagcactccacaatcattatacacagaaatcgctgtccctgtctcccggcaag

SEQ ID NO: 16074 - DNA, 1425 bp, Artificial Sequence
  Description of Artificial Sequence: Synthetic coding sequence
atggctgtgatggcgcccaggacccttgtccttctgctgagcggagcactggcactgacgcagacttgggcacaggtgcaactgcaacaacctggtgcagaacttgtgaaaccaggggcctccgtgaagatgtcgtgtaaagcatccggctacacgtttacctcctacaatatgcattgggtcaaacagacccccggacgcggacttgaatggattggtgcaatatacccaggtaatggtgatactagctacaaccagaaattcaagggaaaggcaactcttaccgccgataagtcgtcgtcgaccgcctacatgcagttgtcgagcctgacctcggaagattccgccgtgtactactgcgcacgatcgacttactacggaggcgactggtatttcaacgtgtggggagcaggaacgacggtcaccgtgtccgccgcgtcgaccaaagggccgtcggtgtttccactggctccgtcgtcaaagtcgacgtcaggagggactgcagccctcggttgcctggtcaaggactactttcctgagcctgtcaccgtgtcgtggaattcaggagcactgacttccggcgtgcacacttttccagcagtcctgcaatcctccgggctctactccctgtcatcggtggtgactgtcccttcctcttcactcggaacgcaaacttacatttgtaacgttaaccataagccttcaaacaccaaagtggataagaaggtcgaacctaagtcgtgtgacaaaactcacacctgtccaccttgtcctgcaccagaacttctgggaggcccttcggtgtttctttttccacctaagccaaaagacacccttatgatttcccgtacgcccgaggtgacttgcgttgtcgtggacgtctcacacgaggacccagaagtgaagttcaactggtatgtggacggggtcgaggtccataacgcaaagactaagccgcgggaggagcaatacaattctacctatagggtcgtgagcgttttgactgtgctgcaccaagattggcttaatggcaaagagtacaagtgcaaagtgtcaaacaaagcactgccggcacctattgaaaagactatttcgaaggctaagggtcagcctcgtgaaccacaagtgtacaccctgccaccttcacgggatgaattgacgaagaatcaggtgtcactgacctgtctcgtcaaaggtttttacccatccgatatagctgtcgaatgggaatcaaatggccagccagagaacaactacaagaccactccccctgtccttgatagcgacggatcattcttcttgtactccaagctcactgtggataaatccagatggcaacaaggtaatgtcttttcatgttcggtgatgcatgaagcactccataaccattacactcagaaatccctgagcctttcgcctggtaaa

SEQ ID NO: 16075 - DNA, 1425 bp, Artificial Sequence
  Description of Artificial Sequence: Synthetic coding sequence
atggcggttatggctcccagaacactagtactgcttctgtcaggagccctagcactcactcagacatgggcccaggtgcagctgcagcagccaggagctgaattagtaaaacctggagcatctgtaaaaatgtcttgcaaagcctcagggtatacattcacatcatacaacatgcactgggtgaaacagacacccggacgcggactcgaatggatcggggccatctatcctgggaatggagatacaagttataatcagaagttcaaaggaaaggccacactcacagcagataagtcttcatctacagcgtacatgcagctttcctcactgacatccgaggattcagcggtgtactattgtgcacggtctacatattatgggggggattggtatttcaacgtgtggggagccgggacaacagtaacagtgagtgctgcttccacaaaaggaccatctgtgtttcccctcgcacctagttccaaatctacttctggggggactgcggccctaggatgcctggtcaaagattattttccagaacccgtcacagtctcttggaactctggggcactcacatccggggtacatacattcccagccgtgctccagtcttccggactctatagtttaagttctgtggttacagtgcctagttcttctcttgggacacagacatatatctgcaacgttaaccacaagccttctaacacgaaagtggataagaaggttgaacccaagtcttgtgataaaactcacacttgtcccccttgtcctgcccctgagttactggggggaccctccgtattcctgtttcccccaaaacctaaagacacactgatgatttctagaacacctgaggtgacatgtgtggttgtcgatgtctcgcacgaagatcccgaagtgaaatttaattggtatgtagacggagttgaagtacacaacgccaaaacaaaaccccgggaggaacagtataatagtacatatcgcgttgtgagtgttctcactgtgctccaccaggattggctcaatgggaaggaatataagtgcaaggtgtctaacaaggcgcttcccgcccccatagaaaaaactatctctaaggctaaaggacagcctagggagccccaggtctatactcttccaccttctcgcgatgaattaactaaaaatcaggtcagtctcacatgcttggtgaaaggattttatcctagtgatattgctgtggaatgggagtctaatggacagcctgaaaataattataaaactactccacccgtgctggattcagatgggtcatttttcctttattccaagttaactgttgataaaagtaggtggcagcaggggaatgttttttcttgctctgtgatgcatgaagctctccataaccattacacacaaaaatctctcagtctgagtcctggaaaa

SEQ ID NO: 16076 - DNA, 1425 bp, Artificial Sequence
  Description of Artificial Sequence: Synthetic coding sequence
atggctgtcatggcccccagaacactggtgctgctcctgtccggggccctagctctgactcagacttgggcccaagttcagctccagcagcctggcgccgagctggtcaagcctggcgcatccgttaagatgtcttgtaaagcttcaggatatacttttacatcttataacatgcattgggtgaaacagacccctggtaggggtctggaatggataggggcaatctatcctggtaacggggacacctcatataaccagaagttcaaaggcaaagccaccctaactgccgataagtcctcgtctaccgcatatatgcagcttagctccctgaccagcgaggacagcgctgtgtattattgtgcgcgcagtacatattatggcggagattggtacttcaatgtttggggtgctggaactactgtaacagtgagcgcggcttctactaaaggcccgtccgtttttccattggctcctagctccaagtctacatctggagggacggccgcattgggatgcctcgtaaaagactacttcccggaaccggtaacagtaagttggaatagcggggcactcacgagcggggtgcatactttcccagctgtgctgcagagttctgggctatatagcctttcatctgtcgttacagtcccctcaagttcgttgggaacccagacatatatctgcaacgtaaaccacaaaccatccaatactaaggtggataagaaagtggaacccaagtcctgtgacaaaacccacacatgtcctccatgtcctgcacctgaactgttgggagggccatctgtgtttctgtttcctccaaagcccaaagacactctgatgatctctaggacacctgaagtcacatgcgtggtcgtcgatgtttcgcatgaggacccagaggtgaagtttaattggtacgtggatggagtggaagtccacaacgctaagacgaagccaagggaggaacagtataattctacttatagggtagtcagtgtgctcacagtgctgcatcaggactggctgaacggcaaggagtataaatgtaaggtgagcaacaaagccttaccagctcccatcgaaaaaaccatctcgaaggcaaaagggcagccccgggagcctcaggtttacaccctgccaccttctcgcgacgaactcactaaaaatcaggtatcattgacgtgtctggtgaagggattctacccttcagatatcgctgtcgagtgggagagcaatggacagccagaaaacaattacaagactactccacctgtcttggattctgacgggagcttctttctatactccaaattaacagtggacaagtccaggtggcagcaaggcaacgtgttctcatgttctgtcatgcacgaagctctgcataaccactatacgcagaaatccctgtccttgtcccctgggaag

SEQ ID NO: 16077 - DNA, 1425 bp, Artificial Sequence
  Description of Artificial Sequence: Synthetic coding sequence
atggctgtgatggcgcctagaaccctggtcctcctcctttcaggagctctggccctcacccaaacttgggcacaggtgcagctccagcagccgggcgccgaactcgtgaagccgggagcgtccgtcaaaatgtcatgtaaggcatccggctacacttttacttcgtacaacatgcattgggtgaaacaaaccccgggaagaggcctggaatggatcggtgccatctacccggggaacggagatacctcctacaatcagaagttcaagggaaaggcgactctgactgctgacaagtcatcctcgactgcttacatgcagctgtcctcgctgaccagcgaagattcggcagtctactactgcgcccgctcgacctactacggtggggattggtacttcaacgtgtggggcgctggcactactgtgactgtgtccgcggcttccactaaggggcccagcgtgttccctctcgcgccaagctccaaatctacctcaggcggaactgcagcccttggatgcctggtgaaggattacttcccggagccagtgactgtgtcgtggaactcgggtgcgttgacgtcgggggtgcatacctttccagcggtgctccagtcctcagggctttactccctgagttcggtggttacggtgccttcgtcatcccttgggacgcagacttacatctgtaacgttaaccacaagccgtccaacacgaaggtggacaagaaagttgagccgaagtcgtgcgacaagacgcacacgtgccctccgtgtccggctccggaacttctgggcggtccgagcgtgttcctgttcccgccgaaacctaaggataccctcatgatctcgcggactccagaagtgacctgcgtggtcgtcgacgtgtcacacgaggaccctgaagtgaagtttaactggtacgtggacggcgtggaagtgcataacgccaaaacgaagccgcgcgaagagcaatacaactccacctaccgggtcgtgtccgtgctgacggtcctgcaccaggactggctgaacggaaaagagtataagtgtaaggtcagcaataaggcgctgcccgcgccgattgaaaagaccatctccaaggccaagggacaaccgcgcgagccacaggtgtacactctcccgccgtcaagagatgagctgactaagaaccaagtctcactcacttgcctggtcaaaggattctatccgtccgatatagcagtcgaatgggagtcgaatggacagcccgaaaacaattacaagactactcccccggtcctcgactccgatggcagcttcttcctgtactcgaagctcaccgtggacaagagccggtggcaacagggaaatgtgttctcctgctcggtcatgcatgaggctttgcataatcactacactcagaagagcctgtccctgtcaccgggtaag

SEQ ID NO: 16078 - DNA, 1425 bp, Artificial Sequence
  Description of Artificial Sequence: Synthetic coding sequence
atggcagtaatggcgccacggacattggtgcttcttttgagtggagctttggccctcactcaaacttgggctcaagttcaactccagcagcctggagccgaactcgtcaaaccgggtgctagtgttaagatgtcgtgtaaagcttctggatatactttcacatcgtataacatgcattgggttaagcagactccaggaaggggattagaatggataggcgctatctatccaggaaatggagatactagttacaatcagaaatttaagggaaaggctacactgaccgctgacaaatctagctccactgcatacatgcaactatcaagcctgacaagcgaggattcagctgtgtattattgtgctcgatcaacatactacggaggagactggtattttaacgtctggggagcaggtaccaccgtgacagtcagtgcagctagcacaaaaggaccatccgtgtttccacttgctccgtcatcaaaatcaactagtggagggacagctgccttgggctgcctcgtgaaagattacttcccagagccggttacagtgagttggaactcaggtgctcttacttcaggagtccatacgttccctgccgttttgcagtcctcaggattatattcactgtcgtcagttgtcacagtcccgagttcctcgcttggaacacaaacatatatttgtaacgtgaatcataagccgagtaatacgaaagtggataaaaaggttgagcctaagtcgtgcgacaaaacgcacacttgccccccatgtccagctccggaactgctcggcggtccatcagtttttctcttccccccgaaaccaaaagatacactaatgataagtaggactcctgaagttacttgtgttgttgttgatgtcagccacgaggatccagaagtgaaattcaactggtacgtcgatggggtagaggtacacaatgctaagacaaagcctcgagaagaacagtataactcaacttaccgtgttgtttcggtcctaacagtgttgcaccaagattggcttaatggaaaagaatataagtgcaaagtctctaacaaagcattgccagcaccaattgaaaagacaatctcaaaagcaaaaggacagccacgcgagccacaagtttacactcttccgccatccagggatgaacttactaagaaccaagtctcactaacctgtttggtcaaaggcttctacccttcggatatagctgttgagtgggagtcaaatggccagccagaaaataattataaaacaactccgccagttttggattcggatggtagctttttcctttattcaaagcttacagttgataaaagcagatggcaacaaggaaatgtgttcagttgtagcgtgatgcatgaagcactgcacaatcattatacacaaaagtcattgtctttatctccaggaaaa

SEQ ID NO: 16079 - DNA, 1425 bp, Artificial Sequence
  Description of Artificial Sequence: Synthetic coding sequence
atggcagtgatggcaccgcgaacgctcgtcctgctgctctcgggagcactggctttgacccaaacctgggcgcaggtccagctgcagcagccaggagcggaactggtcaagccgggcgccagcgtgaaaatgtcgtgcaaggcttctggatacaccttcactagctacaatatgcactgggtcaagcagacgccgggtcgcggcctggagtggatcggggccatctacccggggaacggagatacctcgtacaaccaaaagttcaaaggaaaggcaactctcactgcggataaatcttcatcgactgcctacatgcagctgtcatcgctgacctcagaagattccgctgtctactactgtgcacgtagcacctattacggaggcgactggtatttcaatgtctggggagcgggaactaccgttaccgtgagcgcggcctccaccaaggggccgtcggtgtttccgcttgcgccgtcgtccaagtcgacctcggggggaactgccgcactcgggtgcctggtgaaagactactttccagagccagtgaccgtgtcgtggaactcgggagctcttacttcaggtgtgcatactttcccggccgtgctgcaatcgtcgggcctgtactccttgagctccgtggtgactgtccccagctcatcactcggaacgcagacctacatttgcaacgtcaatcacaaaccgtcgaacactaaagttgacaaaaaggtcgagccaaagagctgtgacaagactcatacgtgtccgccctgcccagcaccggaattgcttggcggccccagtgtgttcctgttcccccctaagcctaaagatacgctcatgatctctcggaccccagaagtcacttgcgtcgtggtggacgtttcgcacgaagatccggaagtgaagttcaactggtacgtggacggtgtagaagtgcataacgcgaaaacgaagcctcgcgaagaacagtacaactccacttaccgggtagtatcggtcctgactgtgcttcaccaggactggctgaatggaaaagaatacaagtgcaaagtgtccaacaaggccctgccggcgccaattgagaaaaccatcagcaaggccaaggggcagccaagagagcctcaagtttatactcttcctccctcacgcgacgagttgactaagaatcaagtgtccctcacctgcttggtcaaggggttctatccgtcggatatcgccgtggagtgggaatcgaacggccagccagagaataactacaagaccaccccgccggtcctggactccgacggctccttcttcctctactcaaagctgactgtcgataagtcaagatggcagcaaggaaacgtctttagctgctcggtgatgcacgaggctctgcacaatcattacactcaaaagtccctctcacttagcccagggaaa

SEQ ID NO: 16080 - DNA, 1425 bp, Artificial Sequence
  Description of Artificial Sequence: Synthetic coding sequence
atggcggtgatggcacctcgtacccttgtgttgcttctctcaggggccctcgcactgacccaaacttgggcacaggtccagctccagcaaccaggggcagaacttgtcaagccgggagcatcagtcaagatgagctgtaaggcatccggttacacttttacttcgtacaacatgcattgggtgaagcagacccctggaaggggccttgaatggattggagctatctacccaggcaacggggacacgagctacaatcagaaattcaagggaaaagcaactcttaccgcagataaatcgtcgtcaaccgcctacatgcaactttcatccctgacttccgaagattccgcggtgtactactgtgcaagatcgacctactacggaggtgactggtacttcaacgtctggggtgcgggtactactgttaccgtctccgcagcatccaccaaaggaccatcggtgtttcctcttgcgccttcgtctaagtccacttccggcggaactgcggcactgggatgcctggtgaaggactactttcctgaacctgtgaccgtgtcgtggaactccggggcactgacctccggcgtgcataccttccctgcagtgctccaatcctcgggactgtactcgctgtcatctgtggtgacggtgcccagctcctcactgggaacccagacttacatttgcaatgtgaatcataagccgtccaataccaaagtcgacaagaaggtggagcctaagtcgtgtgataaaacccacacgtgtcccccttgtcctgcacctgaactccttgggggcccttcggtgttcctgttccctccgaagccaaaggacaccctgatgatttccagaacgcccgaggtgacttgtgtcgtggtggacgtctcgcacgaagatccggaggtcaaattcaactggtacgtggatggtgtcgaagtgcataacgccaaaacgaagcctcgcgaggaacagtacaactccacttaccgcgtcgtctctgtgctcactgtgctgcatcaagattggcttaacggcaaggagtacaagtgcaaggtgagcaataaggcactgcctgcaccaatcgaaaagaccattagcaaggcaaagggacagccccgtgaaccccaagtgtacaccctcccaccctcccgggatgagctcactaagaaccaggtgtcactgacctgtctggtcaaggggttttatccatctgatatcgccgtggaatgggaatcgaacggccaacctgaaaacaattacaaaaccacccctcccgtccttgattctgatggtagctttttcctgtactccaaacttaccgtcgacaagtcgaggtggcagcagggaaacgtgtttagctgttcagtaatgcacgaagctcttcataatcattacactcagaaatccctgtccctgagcccaggtaaa

SEQ ID NO: 16081 - DNA, 1425 bp, Artificial Sequence
  Description of Artificial Sequence: Synthetic coding sequence
atggcagtcatggccccccgcactttggtgctcctgctgtcaggagcccttgcgcttactcagacgtgggctcaggttcagctccagcaaccaggcgcagaactggtcaaacctggggcctcggtcaagatgagctgcaaggcgtcgggatatacctttacgagctacaatatgcattgggtgaaacaaacccctggaagaggccttgagtggatcggtgcgatctaccccgggaacggggacacttcgtacaaccagaagttcaaggggaaggccaccctgactgcagataagtcgtcaagtactgcatacatgcaactttccagcttgacctccgaggacagcgcagtttactattgtgctagatcgacttattacggcggagattggtactttaacgtctggggagcagggactaccgtgaccgtctcggcagcaagcactaagggaccgtcggtgtttcccctcgccccaagctctaagagcaccagcggtggaactgctgcacttggatgcttggtgaaggattacttcccggagccggtcactgtttcctggaattccggagcacttacttccggggttcacaccttccccgcagtcctgcagtcatcgggcctgtacagcttgtcctccgtggtcactgtaccgtcgtcgtccctcggtacgcagacctacatatgtaatgtcaatcataagccatccaatactaaggtcgataagaaagtggaaccaaaaagctgtgacaagacccacacttgtccaccttgtcctgcacctgaactgctcggtggacccagcgtatttctgtttccgcctaagcctaaagataccctgatgatttcccggacgccagaagtgacctgcgtggtggtggacgtcagtcatgaggaccctgaagtcaaattcaactggtacgtggatggtgttgaggtgcataacgcgaaaaccaagcctagagaagaacaatacaactcaacttacagggttgtctcggtgcttacggtccttcaccaggactggcttaacggtaaggagtacaaatgtaaggtatccaacaaggccctgccagcacccattgaaaaaaccatatccaaggccaagggacagcctcgcgaaccacaagtgtacaccctcccgccctcgcgtgatgaactgactaagaatcaagtctcactgacctgccttgttaaaggtttttacccctccgatattgcagttgagtgggagtcgaacggacagcctgaaaacaattacaagactacgccccctgttctggattcagacggctcgtttttcctttactcaaaacttactgtggataaatcacggtggcaacaaggtaacgtgttttcgtgttcagtcatgcatgaggctctccacaaccattacacccaaaagtcgctgagcctttccccaggcaag

SEQ ID NO: 16082 - DNA, 1425 bp, Artificial Sequence
  Description of Artificial Sequence: Synthetic coding sequence
atggccgttatggcaccgcgcaccctcgtgcttctgctttctggagccctcgcgctcacccaaacctgggctcaggtgcaactgcagcagcccggagcggaactggtcaaacccggtgccagcgtgaaaatgtcgtgcaaggcatctggatacactttcactagctacaacatgcattgggtgaagcagactccagggagaggcctggagtggatcggagccatttacccaggaaacggggatacgtcgtacaaccagaaattcaagggcaaggctactcttactgcggacaagagcagctcgaccgcctacatgcaactctcatcactgacctcagaggactcagccgtgtactattgtgctagatcaacctactatgggggtgactggtacttcaacgtgtggggagcaggaaccactgtgaccgtgtccgcagcatcgaccaagggcccgtcggttttcccgctggccccgtcctcgaaatcgaccagcggcggaactgcggcgcttggctgcctggtcaaggactactttccggagccggtgaccgtctcctggaacagcggagcactcacctcaggagtgcatacttttccggctgtcctgcagtcgtccgggctgtactcactgtcgtccgtcgtgacggtgccgtcgagttccctcggaactcaaacctacatctgcaatgtcaaccacaagcccagcaatactaaggtcgataagaaggtggagccaaagtcgtgtgacaagactcatacctgcccgccttgcccggccccggaactgctcggcggaccatcggtgttcctgttccccccgaaaccaaaggataccttgatgatcagccgcacccctgaagtgacctgcgtggtcgtcgatgtgtcccatgaagatcccgaagtgaagttcaactggtatgtggacggagtggaagtacacaatgccaagacgaaaccacgggaggagcaatacaacagcacctaccgcgtcgtgtccgtgctgacggttttgcaccaggactggctgaatggaaaagaatacaagtgcaaagtgtccaataaggccctgccagcgcctatcgaaaagaccatctccaaagccaagggtcagccacgggagcctcaggtctacactctcccgcctagcagggacgaactcactaagaatcaggtgtccctgacctgcctggtgaagggcttctacccatcggacattgctgtcgagtgggagtccaacgggcaacctgaaaacaattacaaaactactccgccggtcttggattcggatggtagcttctttctgtactcaaaactcactgtggacaagtcccggtggcagcagggcaacgtgttttcctgttctgtgatgcacgaagcgttgcacaaccactacacgcaaaagtcactcagcctgtcacctggaaag

SEQ ID NO: 16083 - DNA, 1425 bp, Artificial Sequence
  Description of Artificial Sequence: Synthetic coding sequence
atggcggtcatggcccccagaactttggtgctgctcctgtcgggagcattggcactgacccaaacctgggcgcaggttcagcttcaacaaccaggtgcagaactggtgaaaccaggagccagcgtgaagatgtcctgtaaggcctccgggtacaccttcacttcgtacaatatgcactgggtcaagcaaacgcccggtaggggcctggaatggattggcgcaatttaccccggaaacggtgatacgagctacaaccagaaattcaaaggtaaggcgactctgactgcagataagagctcctcgaccgcatacatgcagctctcgagcctgaccagtgaagattccgccgtgtactactgtgcacgtagcacttactacgggggtgattggtacttcaatgtgtggggagcaggaacgaccgtgactgtgagcgcagccagtactaaggggccttccgtgttccccctcgcgccatccagcaagtccacttcagggggaactgcagcactcggatgtctcgtcaaggactacttccctgaacccgtcaccgtgtcgtggaattccggagcacttacttcgggagtgcatacctttccagccgtcttgcagagctctggactgtactcactgtcaagcgtggtgacggtcccgtcatcctctctgggaacccagacctacatctgtaatgtgaatcacaaaccatcgaacacgaaggtggacaagaaggtcgaacccaagtcgtgtgataagactcacacctgccctccctgtcctgcgcctgagctccttgggggtccatcggtctttctgtttccgccgaagcctaaggatactttgatgatctcgagaacccccgaagtcacctgtgttgtggtggacgtgtcgcatgaagatccagaagtgaagtttaactggtacgtggacggagtcgaggttcacaacgccaagacgaagcctcgtgaagaacagtacaattccacttaccgtgtcgtgagcgtccttactgtgctccaccaggactggcttaacggaaaagaatacaagtgtaaagtctctaacaaggcacttcctgcccctattgagaaaactatctccaaggcaaaggggcaaccacgcgaaccccaggtgtacacccttccgccttcccgggatgaacttaccaaaaaccaagtctcactgacttgtcttgtcaaggggttctacccatcggatatcgctgtcgaatgggagtcgaacggccagcctgagaacaattacaaaactacccctcctgttctggatagcgacggctcgtttttcctgtacagcaagctgactgtggataagtcaaggtggcaacaaggcaatgtcttttcgtgcagcgtgatgcatgaagcactgcataatcattacacccagaaaagcctttcgctgtcccccggaaaa

SEQ ID NO: 16084 - DNA, 1425 bp, Artificial Sequence
  Description of Artificial Sequence: Synthetic coding sequence
atggcagtgatggccccccggacccttgttctgctgctctccggggctctcgctctgacgcagacgtgggcacaggtgcagctgcaacagccaggcgcagagctggtcaaacccggcgcgtccgtcaagatgtcgtgtaaggcgtccggttacaccttcacttcctacaacatgcattgggtcaagcaaaccccgggccgagggcttgagtggatcggtgcgatctacccggggaacggcgataccagctacaaccagaaattcaaagggaaggccaccttgacggctgacaaaagctcctccactgcgtacatgcagctttcgtccctgacttccgaggacagcgccgtgtactactgcgcacgcagcacttactacggaggagattggtatttcaacgtgtggggagccggtaccactgtgactgtttcagctgctagcacgaagggcccatcggtgttccccctggcaccgtcgtcaaagagcacttccgggggaaccgctgcccttggctgcctggtcaaagactactttccagagccagtgaccgtgtcatggaattccggtgcattgacctcaggcgtgcacaccttccccgccgtgctgcagtcctcgggactgtattcattgtcctcggtggtgaccgtgccgtcgagctccctcggcacccaaacctacatctgcaacgtcaaccacaagccgtcaaacaccaaagtggacaagaaggtcgaaccgaagagctgcgacaaaactcatacgtgtccgccatgccccgctcctgaactgttgggaggaccatcggtttttctgttcccaccaaagccgaaggacactctcatgatctcgcgaacccccgaagtcacttgcgtggtcgtggatgtctcccatgaggatccggaagtcaagttcaactggtatgtggacggtgtcgaagtgcacaatgctaagactaagccgcgcgaagagcagtacaatagcacttaccgggtcgtctccgtcctgactgtgctccaccaagactggcttaacggaaaggaatacaagtgcaaagtctcaaacaaggctctgcctgccccgatcgaaaaaaccatcagcaaggcgaagggacagcccagggagccgcaggtgtacacccttccaccctcgcgcgatgagctgaccaaaaaccaggtgagcttgacttgcctcgtgaagggtttttacccgtcggacatcgctgtggagtgggaatcgaatggacagccggagaataactacaaaactaccccgcctgtcctggatagcgacggctctttctttctctatagcaagctgactgtagataaatcgcggtggcagcaaggcaacgtctttagttgttcggtcatgcatgaggcgctgcacaaccactacactcaaaagtccctgtcgctgagcccgggaaag

SEQ ID NO: 16085 - DNA, 1425 bp, Artificial Sequence
  Description of Artificial Sequence: Synthetic coding sequence
atggcggtaatggcgccacgcactctagtcctcctcctgtcgggagctctggccctcacccagacctgggcgcaagtgcaactccaacagcccggcgctgagctagtcaagcctggagcctcagtcaagatgagttgtaaagcaagcggctacacattcaccagttataatatgcactgggtcaagcaaacacctggacgtgggcttgaatggatcggcgccatctaccccggaaatggcgacacctcatacaatcaaaagtttaagggcaaggctactttaacagccgacaagagttctagcaccgcttatatgcagctgtccagtctaactagcgaggattcggcggtttactattgtgctcgctcgacctattacggtggggattggtacttcaatgtctggggggctggaaccacagttaccgtgtcagccgcaagtacaaagggtcctagtgtcttccctctggctccatcaagcaagagcacatcggggggtactgctgcgttaggctgcttagttaaggactacttccccgagcccgtgacggtctcctggaattccggcgccttgacttcgggagttcacaccttcccagcggttcttcagagttcaggtttgtactcactgtcctcggtcgtgactgttccatcgtcttctctggggactcaaacctatatctgtaacgtcaaccataaacctagtaacacaaaagtagataagaaggttgagcctaagtcatgcgataaaactcacacttgccctccatgtcctgcaccagagttgctcggaggacctagtgtttttttgtttccgcccaaacccaaagatacccttatgatatccaggacgcctgaagtgacgtgcgtcgttgtagatgtctctcatgaggatcccgaggttaaatttaattggtacgtcgacggagtcgaggtgcacaacgccaagacgaagccacgagaggagcagtacaactccacctatcgagtagtcagtgtgctgactgtcttgcatcaggattggctcaatggaaaggaatacaagtgtaaagtctcgaacaaagctttgccagctccaattgaaaaaacgatctcaaaggctaagggacagccgagagaaccacaagtgtatacattaccgccgtctcgcgacgagttgacgaagaaccaagtgtcactaacttgtctggtgaaaggcttttatccttccgatatagcagttgagtgggagtcgaacgggcagcctgaaaacaattataagacgacaccgcccgttctcgattctgacggtagtttcttcctttactctaagctcacggtcgacaagtcgcgatggcagcagggcaacgttttctcctgctcagttatgcatgaagcccttcataatcattatactcaaaaaagcttgagtctgtcgcctggaaag

SEQ ID NO: 16086 - DNA, 1425 bp, Artificial Sequence
  Description of Artificial Sequence: Synthetic coding sequence
atggcagttatggcacctcgaaccctggtgctgctcctgagcggtgcccttgcgcttactcagacctgggcccaagtgcagcttcaacagcccggagcagaacttgtgaagcccggggcttcggtgaagatgtcctgtaaggcatcgggatacacttttacttcctacaatatgcattgggtcaagcagaccccgggacgcggtctggagtggattggtgccatatatcccggaaacggagatacctcgtacaaccagaagtttaagggtaaggcaacgttgactgcagacaagtcgtcgtcgactgcatacatgcagctttcgtcccttacctcggaagattccgctgtctactactgcgcaagaagcacctactacggcggagactggtacttcaacgtgtggggcgcaggtaccaccgtgaccgtgagcgcagcctcgaccaaaggaccctccgtttttcctcttgcacctagctcgaaatctacctcgggtggaaccgcagcacttgggtgtcttgtcaaagattacttcccagaacctgtcaccgtgtcatggaactcgggtgcactcacctcgggagtccatactttccctgccgtcctccagtcgtcagggctttactccctgagctcagtggtgactgtccctagctcgagcctgggaactcaaacgtacatatgcaacgtgaaccataagccatccaacactaaggtggacaagaaggtggaaccgaagtcctgtgataagactcatacgtgccccccgtgtcctgcacccgaactcctcgggggtccttcggtgtttctctttccccctaagccaaaggataccctgatgatttcgagaactccagaagtgacttgtgtggtcgtggatgtgagccacgaggatccagaagtgaagtttaactggtacgtcgatggcgtggaggttcataatgcaaagaccaagccacgggaagagcagtacaactcaacttacagggtggtgagcgtgctgactgtcctgcatcaggactggctgaacggaaaagaatacaagtgtaaagtctctaacaaggcactgcccgcccctattgaaaagaccatttccaaggcgaaaggacaacctcgtgaacctcaagtgtacaccctcccgccatcgcgggatgagctgacgaagaaccaagtctccctgacgtgcctggtgaagggattctacccatcagatatagccgtcgaatgggagagcaatggacaaccagaaaacaattacaagaccaccccacctgtgttggactcggacggctccttcttcctttactccaagctgacggtggacaagtcgcggtggcaacaagggaatgtctttagctgttccgtaatgcatgaagctctgcataaccactacacccagaagtccctgagcctttccccagggaaa

SEQ ID NO: 16087 - DNA, 1425 bp, Artificial Sequence
  Description of Artificial Sequence: Synthetic coding sequence
atggctgtgatggcccctcgtacgctcgtgctattgttgtccggagctctcgcactgacccagacatgggcgcaagtgcagttgcagcagccgggggccgagcttgtaaagcctggagcttcggtgaagatgagttgtaaggcttctggctatacattcacctcttataacatgcactgggttaaacaaactccggggagggggctggagtggattggcgctatttatcccggcaacggggacactagctataatcagaagttcaaggggaaggccactcttacagctgacaaaagctcctctacagcgtatatgcagctctccagtctcaccagcgaggactctgctgtgtattactgcgcaagatccacttattacggaggagactggtattttaacgtctggggagcaggtaccactgtgaccgttagcgccgcgtcaaccaagggtccgtccgtttttccactcgcccctagttccaagtccacctctggagggaccgctgccctggggtgtcttgtcaaagactattttccggaaccggtgaccgtgagctggaacagtggagcccttacttctggcgtgcacacatttcctgcagtattacagtcaagtggactgtattctctctcctccgtggtgaccgtacccagctctagcttgggtacccagacttacatctgtaatgtgaatcataagccatctaataccaaggtggataaaaaggttgagcccaaatcctgcgacaaaacccacacctgccctccctgtcccgcgcccgagttattaggtggcccgagcgtctttctgttcccccctaagcctaaggatactctgatgatatctcgaacaccagaggtgacgtgtgtagtcgtggacgtgtcccatgaagatccggaggtgaaatttaattggtacgttgatggtgtggaggtccacaatgccaagaccaaaccaagggaggagcagtacaattctacttacagggtggtctcggtgctgaccgttttgcaccaggactggctgaacgggaaggaatacaagtgtaaagtcagcaacaaggcattgcctgctcctattgaaaagactatctcaaaagccaagggtcagcctcgagagccccaggtctacactctcccaccctcccgggacgagttgacaaagaaccaggtgtccctcacttgtttggtcaagggcttttacccatctgatattgccgtggagtgggaatctaacggtcagcctgaaaataactacaaaaccaccccaccggtcctggattccgacggctcctttttcttgtactccaagctgaccgtggacaagagtcgatggcagcaggggaatgtcttctcctgttccgtgatgcacgaagccctccacaaccactacacccaaaagtctctctccttgtcgccaggtaag

SEQ ID NO: 16088 - protein, 4 aa, Homo sapiens
  MOD_RES (2)..(3): Any amino acid
RXXR

SEQ ID NO: 16089 - protein, 4 aa, Homo sapiens
  MOD_RES (2)..(2): Any amino acid
  MOD_RES (3)..(3): Lys or Arg
RXXR

SEQ ID NO: 16090 - protein, 6 aa, Homo sapiens
  MOD_RES (1)..(1): Lys or Arg
  MOD_RES (2)..(5): Any amino acid
  MOD_RES (6)..(6): Lys or Arg
XXXXXX

SEQ ID NO: 16091 - protein, 8 aa, Homo sapiens
  MOD_RES (1)..(1): Lys or Arg
  MOD_RES (2)..(7): Any amino acid
  MOD_RES (8)..(8): Lys or Arg
XXXXXXXX

SEQ ID NO: 16092 - protein, 6 aa, Homo sapiens
LVPRGS

SEQ ID NO: 16093 - protein, 4 aa, Homo sapiens
LVPR

SEQ ID NO: 16094 - protein, 4 aa, Homo sapiens
  MOD_RES (1)..(1): Ala, Phe, Gly, Ile, Leu, Thr, Val or Met
  MOD_RES (2)..(2): Ala, Phe, Gly, Ile, Leu, Thr, Val or Trp
XXPR

SEQ ID NO: 16095 - protein, 4 aa, Homo sapiens
IEGR

SEQ ID NO: 16096 - protein, 4 aa, Homo sapiens
IDGR

SEQ ID NO: 16097 - protein, 4 aa, Homo sapiens
AEGR

SEQ ID NO: 16098 - protein, 4 aa, Homo sapiens
  MOD_RES (1)..(1): Ala, Phe, Gly, Ile, Leu, Thr, Val or Met
  MOD_RES (2)..(2): Asp or Glu
XXGR

SEQ ID NO: 16099 - DNA, 615 bp, Homo sapiens
atggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctga

SEQ ID NO: 16100 - DNA, 800 bp, Artificial Sequence
  Description of Artificial Sequence: Synthetic transcript sequence
taatacgactcactatagggaaataagagagaaaagaagagtaagaagaaatataagagccaccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgaagcgctgccttctgcggggcttgccttctggccatgcccttcttctctcccttgcacctgtacctcttggtctttgaataaagcctgagtaggaaggcggccgctcgagcatgcatctaga

SEQ ID NO: 16101 - DNA, 800 bp, Artificial Sequence
  Description of Artificial Sequence: Synthetic transcript sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgaagcgctgccttctgcggggcttgccttctggccatgcccttcttctctcccttgcacctgtacctcttggtctttgaataaagcctgagtaggaaggcggccgctcgagcatgcatctaga

SEQ ID NO: 16102 - RNA, 758 nt, Artificial Sequence
  Description of Artificial Sequence: Synthetic transcript sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugaagcgcugccuucugcggggcuugccuucuggccaugcccuucuucucucccuugcaccuguaccucuuggucuuugaauaaagccugaguaggaag

SEQ ID NO: 16103 - RNA, 854 nt, Artificial Sequence
  Description of Artificial Sequence: Synthetic transcript sequence
gggaaauaagagagaaaagaagaguaagaagaaauauaagagccaccaugguauccaagggggaggaggacaacauggcgaucaucaaggaguucaugcgauucaaggugcacauggaagguucggucaacggacacgaauuugaaaucgaaggagagggugaaggaaggcccuaugaagggacacagaccgcgaaacucaaggucacgaaagggggaccacuuccuuucgccugggacauucuuucgccccaguuuauguacggguccaaagcauaugugaagcaucccgccgauauuccugacuaucugaaacucagcuuucccgagggauucaagugggagcgggucaugaacuuugaggacggggguguagucaccguaacccaagacucaagccuccaagacggcgaguucaucuacaaggucaaacugcgggggacuaacuuuccgucggaugggccggugaugcagaagaaaacgaugggaugggaagcgucaucggagaggauguacccagaagauggugcauugaagggggagaucaagcagagacugaaguugaaagaugggggacauuaugaugccgaggugaaaacgacauacaaagcgaaaaagccggugcagcuucccggagcguauaaugugaauaucaaguuggauauuacuucacacaaugaggacuacacaauugucgaacaguacgaacgcgcugaggguagacacucgacgggaggcauggacgaguuguacaaaugauaagcugccuucugcggggcuugccuucuggccaugcccuucuucucucccuugcaccuguaccucuuggucuuugaauaaagccugaguaggaag

SEQ ID NO: 16104 - DNA, 896 bp, Artificial Sequence
  Description of Artificial Sequence: Synthetic transcript sequence
taatacgactcactatagggaaataagagagaaaagaagagtaagaagaaatataagagccaccatggtatccaagggggaggaggacaacatggcgatcatcaaggagttcatgcgattcaaggtgcacatggaaggttcggtcaacggacacgaatttgaaatcgaaggagagggtgaaggaaggccctatgaagggacacagaccgcgaaactcaaggtcacgaaagggggaccacttcctttcgcctgggacattctttcgccccagtttatgtacgggtccaaagcatatgtgaagcatcccgccgatattcctgactatctgaaactcagctttcccgagggattcaagtgggagcgggtcatgaactttgaggacgggggtgtagtcaccgtaacccaagactcaagcctccaagacggcgagttcatctacaaggtcaaactgcgggggactaactttccgtcggatgggccggtgatgcagaagaaaacgatgggatgggaagcgtcatcggagaggatgtacccagaagatggtgcattgaagggggagatcaagcagagactgaagttgaaagatgggggacattatgatgccgaggtgaaaacgacatacaaagcgaaaaagccggtgcagcttcccggagcgtataatgtgaatatcaagttggatattacttcacacaatgaggactacacaattgtcgaacagtacgaacgcgctgagggtagacactcgacgggaggcatggacgagttgtacaaatgataagctgccttctgcggggcttgccttctggccatgcccttcttctctcccttgcacctgtacctcttggtctttgaataaagcctgagtaggaaggcggccgctcgagcatgcatctaga

SEQ ID NO: 16105 - RNA, 725 nt, Artificial Sequence
  Description of Artificial Sequence: Synthetic transcript sequence
gggaaauaagagagaaaagaagaguaagaagaaauauaagagccaccaugggagugcacgagugucccgcgugguugugguugcugcugucgcucuugagccucccacugggacugccugugcugggggcaccacccagauugaucugcgacucacggguacuugagagguaccuucuugaagccaaagaagccgaaaacaucacaaccggaugcgccgagcacugcucccucaaugagaacauuacuguaccggauacaaaggucaauuucuaugcauggaagagaauggaaguaggacagcaggccgucgaaguguggcaggggcucgcgcuuuugucggaggcgguguugcggggucaggcccuccucgucaacucaucacagccgugggagccccuccaacuucaugucgauaaagcggugucggggcuccgcagcuugacgacguugcuucgggcucugggcgcacaaaaggaggcuauuucgccgccugacgcggccuccgcggcaccccuccgaacgaucaccgcggacacguuuaggaagcuuuuuagaguguacagcaauuuccuccgcggaaagcugaaauuguauacuggugaagcguguaggacaggggaucgcugauaagcugccuucugcggggcuugccuucuggccaugcccuucuucucucccuugcaccuguaccucuuggucuuugaauaaagccugaguaggaag

SEQ ID NO: 16106 - RNA, 1536 nt, Artificial Sequence
  Description of Artificial Sequence: Synthetic transcript sequence
gggaaauaagagagaaaagaagaguaagaagaaauauaagagccaccaaugcagcgcgucaacaugauuauggccgaaucgccgggacucaucacaaucugccucuuggguuaucucuugucggcagaauguaccguguucuuggaucacgaaaacgcgaacaaaauucuuaaucgcccgaagcgguauaacuccgggaaacuugaggaguuugugcagggcaaucuugaacgagagugcauggaggagaaaugcuccuuugaggaggcgagggaaguguuugaaaacacagagcgaacaacggaguuuuggaagcaauacguagauggggaccagugugagucgaauccgugccucaaugggggaucauguaaagaugacaucaauagcuaugaaugcuggugcccguuuggguuugaagggaagaacugugagcuggaugugacgugcaacaucaaaaacggacgcugugagcaguuuuguaagaacucggcugacaauaagguaguaugcucgugcacagagggauaccggcuggcggagaaccaaaaaucgugcgagcccgcagucccguucccuugugggagggugagcgugucacagacuagcaaguugacgagagcggagacuguauuccccgacguggacuacgucaacagcaccgaagccgaaacaauccucgauaacaucacgcagagcacucaguccuucaaugacuuuacgagggucguagguggugaggacgcgaaacccggucaguuccccuggcaggugguauugaacggaaaagucgaugccuuuuguggagguuccauugucaacgagaaguggauugucacagcggcacacugcguagaaacaggagugaaaaucacgguaguggcgggagagcauaacauugaagagacagagcacacggaacaaaagcgaaaugucaucagaaucauuccacaccauaacuauaacgcggcaaucaauaaguacaaucacgacaucgcacuuuuggagcuugacgaaccuuuggugcuuaauucguacgucaccccuauuuguauugccgacaaagaguauacaaacaucuucuugaaauucggcuccggguacguaucgggcuggggcagaguguuccauaaggguagauccgcacugguguugcaauaccucagggugccccucguggaucgagccacuugucugcgguccaccaaauucacaaucuacaacaauauguucugugcgggauuccaugaaggugggagagauagcugccagggagacucaggggguccccacgugacggaagucgaggggacgucauuucugacgggaauuaucucauggggagaggaaugugcgaugaaggggaaauauggcaucuacacuaaagugucacgguaugucaauuggaucaaggaaaagacgaaacucacgugaucagccagcgcugccuucugcggggcuugccuucuggccaugcccuucuucucucccuugcaccuguaccucuuggucuuugaauaaagccugaguaggaag

SEQ ID NO: 16107 - DNA, 767 bp, Artificial Sequence
  Description of Artificial Sequence: Synthetic transcript sequence
taatacgactcactatagggaaataagagagaaaagaagagtaagaagaaatataagagccaccatgggagtgcacgagtgtcccgcgtggttgtggttgctgctgtcgctcttgagcctcccactgggactgcctgtgctgggggcaccacccagattgatctgcgactcacgggtacttgagaggtaccttcttgaagccaaagaagccgaaaacatcacaaccggatgcgccgagcactgctccctcaatgagaacattactgtaccggatacaaaggtcaatttctatgcatggaagagaatggaagtaggacagcaggccgtcgaagtgtggcaggggctcgcgcttttgtcggaggcggtgttgcggggtcaggccctcctcgtcaactcatcacagccgtgggagcccctccaacttcatgtcgataaagcggtgtcggggctccgcagcttgacgacgttgcttcgggctctgggcgcacaaaaggaggctatttcgccgcctgacgcggcctccgcggcacccctccgaacgatcaccgcggacacgtttaggaagctttttagagtgtacagcaatttcctccgcggaaagctgaaattgtatactggtgaagcgtgtaggacaggggatcgctgataagctgccttctgcggggcttgccttctggccatgcccttcttctctcccttgcacctgtacctcttggtctttgaataaagcctgagtaggaaggcggccgctcgagcatgcatctaga

SEQ ID NO: 16108 - DNA, 750 bp, Artificial Sequence
  Description of Artificial Sequence: Synthetic transcript sequence
taatacgactcactatagggaaataagagagaaaagaagagtaagaagaaatataagagccaccatgggagtgcacgagtgtcccgcgtggttgtggttgctgctgtcgctcttgagcctcccactgggactgcctgtgctgggggcaccacccagattgatctgcgactcacgggtacttgagaggtaccttcttgaagccaaagaagccgaaaacatcacaaccggatgcgccgagcactgctccctcaatgagaacattactgtaccggatacaaaggtcaatttctatgcatggaagagaatggaagtaggacagcaggccgtcgaagtgtggcaggggctcgcgcttttgtcggaggcggtgttgcggggtcaggccctcctcgtcaactcatcacagccgtgggagcccctccaacttcatgtcgataaagcggtgtcggggctccgcagcttgacgacgttgcttcgggctctgggcgcacaaaaggaggctatttcgccgcctgacgcggcctccgcggcacccctccgaacgatcaccgcggacacgtttaggaagctttttagagtgtacagcaatttcctccgcggaaagctgaaattgtatactggtgaagcgtgtaggacaggggatcgctgataagctgccttctgcggggcttgccttctggccatgcccttcttctctcccttgcacctgtacctcttggtctttgaataaagcctgagtaggaaggcggccgc

SEQ ID NO: 16109 - DNA, 1578 bp, Artificial Sequence
  Description of Artificial Sequence: Synthetic transcript sequence
taatacgactcactatagggaaataagagagaaaagaagagtaagaagaaatataagagccaccaatgcagcgcgtcaacatgattatggccgaatcgccgggactcatcacaatctgcctcttgggttatctcttgtcggcagaatgtaccgtgttcttggatcacgaaaacgcgaacaaaattcttaatcgcccgaagcggtataactccgggaaacttgaggagtttgtgcagggcaatcttgaacgagagtgcatggaggagaaatgctcctttgaggaggcgagggaagtgtttgaaaacacagagcgaacaacggagttttggaagcaatacgtagatggggaccagtgtgagtcgaatccgtgcctcaatgggggatcatgtaaagatgacatcaatagctatgaatgctggtgcccgtttgggtttgaagggaagaactgtgagctggatgtgacgtgcaacatcaaaaacggacgctgtgagcagttttgtaagaactcggctgacaataaggtagtatgctcgtgcacagagggataccggctggcggagaaccaaaaatcgtgcgagcccgcagtcccgttcccttgtgggagggtgagcgtgtcacagactagcaagttgacgagagcggagactgtattccccgacgtggactacgtcaacagcaccgaagccgaaacaatcctcgataacatcacgcagagcactcagtccttcaatgactttacgagggtcgtaggtggtgaggacgcgaaacccggtcagttcccctggcaggtggtattgaacggaaaagtcgatgccttttgtggaggttccattgtcaacgagaagtggattgtcacagcggcacactgcgtagaaacaggagtgaaaatcacggtagtggcgggagagcataacattgaagagacagagcacacggaacaaaagcgaaatgtcatcagaatcattccacaccataactataacgcggcaatcaataagtacaatcacgacatcgcacttttggagcttgacgaacctttggtgcttaattcgtacgtcacccctatttgtattgccgacaaagagtatacaaacatcttcttgaaattcggctccgggtacgtatcgggctggggcagagtgttccataagggtagatccgcactggtgttgcaatacctcagggtgcccctcgtggatcgagccacttgtctgcggtccaccaaattcacaatctacaacaatatgttctgtgcgggattccatgaaggtgggagagatagctgccagggagactcagggggtccccacgtgacggaagtcgaggggacgtcatttctgacgggaattatctcatggggagaggaatgtgcgatgaaggggaaatatggcatctacactaaagtgtcacggtatgtcaattggatcaaggaaaagacgaaactcacgtgatcagccagcgctgccttctgcggggcttgccttctggccatgcccttcttctctcccttgcacctgtacctcttggtctttgaataaagcctgagtaggaaggcggccgctcgagcatgcatctaga

SEQ ID NO: 16110 - RNA, 851 nt, Artificial Sequence
  Description of Artificial Sequence: Synthetic transcript sequence
gggaaauaagagagaaaagaagaguaagaagaaauauaagagccaccauggugagcaagggcgaggaggauaacauggccaucaucaaggaguucaugcgcuucaaggugcacauggagggcuccgugaacggccacgaguucgagaucgagggcgagggcgagggccgccccuacgagggcacccagaccgccaagcugaaggugaccaaggguggcccccugcccuucgccugggacauccuguccccucaguucauguacggcuccaaggccuacgugaagcaccccgccgacauccccgacuacuugaagcuguccuuccccgagggcuucaagugggagcgcgugaugaacuucgaggacggcggcguggugaccgugacccaggacuccucccugcaggacggcgaguucaucuacaaggugaagcugcgcggcaccaacuuccccuccgacggccccguaaugcagaagaagaccaugggcugggaggccuccuccgagcggauguaccccgaggacggcgcccugaagggcgagaucaagcagaggcugaagcugaaggacggcggccacuacgacgcugaggucaagaccaccuacaaggccaagaagcccgugcagcugcccggcgccuacaacgucaacaucaaguuggacaucaccucccacaacgaggacuacaccaucguggaacaguacgaacgcgccgagggccgccacuccaccggcggcauggacgagcuguacaagugagcugccuucugcggggcuugccuucuggccaugcccuucuucucucccuugcaccuguaccucuuggucuuugaauaaagccugaguaggaag

SEQ ID NO: 16111 - DNA, 1838 bp, Artificial Sequence
  Description of Artificial Sequence: Synthetic transcript sequence
taatacgactcactatagggaaataagagagaaaagaagagtaagaagaaatataagagccaccatggaagatgcgaagaacatcaagaagggacctgccccgttttaccctttggaggacggtacagcaggagaacagctccacaaggcgatgaaacgctacgccctggtccccggaacgattgcgtttaccgatgcacatattgaggtagacatcacatacgcagaatacttcgaaatgtcggtgaggctggcggaagcgatgaagagatatggtcttaacactaatcaccgcatcgtggtgtgttcggagaactcattgcagtttttcatgccggtccttggagcacttttcatcggggtcgcagtcgcgccagcgaacgacatctacaatgagcgggaactcttgaatagcatgggaatctcccagccgacggtcgtgtttgtctccaaaaaggggctgcagaaaatcctcaacgtgcagaagaagctccccattattcaaaagatcatcattatggatagcaagacagattaccaagggttccagtcgatgtatacctttgtgacatcgcatttgccgccagggtttaacgagtatgacttcgtccccgagtcatttgacagagataaaaccatcgcgctgattatgaattcctcgggtagcaccggtttgccaaagggggtggcgttgccccaccgcactgcttgtgtgcggttctcgcacgctagggatcctatctttggtaatcagatcattcccgacacagcaatcctgtccgtggtaccttttcatcacggttttggcatgttcacgactctcggctatttgatttgcggtttcagggtcgtacttatgtatcggttcgaggaagaactgtttttgagatccttgcaagattacaagatccagtcggccctccttgtgccaacgcttttctcattctttgcgaaatcgacacttattgataagtatgacctttccaatctgcatgagattgcctcagggggagcgccgcttagcaaggaagtcggggaggcagtggccaagcgcttccaccttcccggaattcggcagggatacgggctcacggagacaacatccgcgatccttatcacgcccgagggtgacgataagccgggagccgtcggaaaagtggtccccttctttgaagccaaggtcgtagacctcgacacgggaaaaaccctcggagtgaaccagaggggcgagctctgcgtgagagggccgatgatcatgtcaggttacgtgaataaccctgaagcgacgaatgcgctgatcgacaaggatgggtggttgcattcgggagacattgcctattgggatgaggatgagcacttctttatcgtagatcgacttaagagcttgatcaaatacaaaggctatcaggtagcgcctgccgagctcgagtcaatcctgctccagcaccccaacattttcgacgccggagtggccgggttgcccgatgacgacgcgggtgagctgccagcggccgtggtagtcctcgaacatgggaaaacaatgaccgaaaaggagatcgtggactacgtagcatcacaagtgacgactgcgaagaaactgaggggaggggtagtctttgtggacgaggtcccgaaaggcttgactgggaagcttgacgctcgcaaaatccgggaaatcctgattaaggcaaagaaaggcgggaaaatcgctgtctgataagctgccttctgcggggcttgccttctggccatgcccttcttctctcccttgcacctgtacctcttggtctttgaataaagcctgagtaggaaggcggccgctcgagcatgcatctaga

SEQ ID NO: 16112 - RNA, 1796 nt, Artificial Sequence
  Description of Artificial Sequence: Synthetic transcript sequence
gggaaauaagagagaaaagaagaguaagaagaaauauaagagccaccauggaagaugcgaagaacaucaagaagggaccugccccguuuuacccuuuggaggacgguacagcaggagaacagcuccacaaggcgaugaaacgcuacgcccugguccccggaacgauugcguuuaccgaugcacauauugagguagacaucacauacgcagaauacuucgaaaugucggugaggcuggcggaagcgaugaagagauauggucuuaacacuaaucaccgcaucgugguguguucggagaacucauugcaguuuuucaugccgguccuuggagcacuuuucaucggggucgcagucgcgccagcgaacgacaucuacaaugagcgggaacucuugaauagcaugggaaucucccagccgacggucguguuugucuccaaaaaggggcugcagaaaauccucaacgugcagaagaagcuccccauuauucaaaagaucaucauuauggauagcaagacagauuaccaaggguuccagucgauguauaccuuugugacaucgcauuugccgccaggguuuaacgaguaugacuucguccccgagucauuugacagagauaaaaccaucgcgcugauuaugaauuccucggguagcaccgguuugccaaaggggguggcguugccccaccgcacugcuugugugcgguucucgcacgcuagggauccuaucuuugguaaucagaucauucccgacacagcaauccuguccgugguaccuuuucaucacgguuuuggcauguucacgacucucggcuauuugauuugcgguuucagggucguacuuauguaucgguucgaggaagaacuguuuuugagauccuugcaagauuacaagauccagucggcccuccuugugccaacgcuuuucucauucuuugcgaaaucgacacuuauugauaaguaugaccuuuccaaucugcaugagauugccucagggggagcgccgcuuagcaaggaagucggggaggcaguggccaagcgcuuccaccuucccggaauucggcagggauacgggcucacggagacaacauccgcgauccuuaucacgcccgagggugacgauaagccgggagccgucggaaaagugguccccuucuuugaagccaaggucguagaccucgacacgggaaaaacccucggagugaaccagaggggcgagcucugcgugagagggccgaugaucaugucagguuacgugaauaacccugaagcgacgaaugcgcugaucgacaaggaugggugguugcauucgggagacauugccuauugggaugaggaugagcacuucuuuaucguagaucgacuuaagagcuugaucaaauacaaaggcuaucagguagcgccugccgagcucgagucaauccugcuccagcaccccaacauuuucgacgccggaguggccggguugcccgaugacgacgcgggugagcugccagcggccgugguaguccucgaacaugggaaaacaaugaccgaaaaggagaucguggacuacguagcaucacaagugacgacugcgaagaaacugaggggagggguagucuuuguggacgaggucccgaaaggcuugacugggaagcuugacgcucgcaaaauccgggaaauccugauuaaggcaaagaaaggcgggaaaaucgcugucugauaagcugccuucugcggggcuugccuucuggccaugcccuucuucucucccuugcaccuguaccucuuggucuuugaauaaagccugaguaggaag

SEQ ID NO: 16113 - DNA, 905 bp, Artificial Sequence
  Description of Artificial Sequence: Synthetic transcript sequence
taatacgactcactatagggaaataagagagaaaagaagagtaagaagaaatataagagccaccatggtgtccaagggtgaggaattgtttaccggggtggtgcctattctcgtcgaacttgacggggatgtgaatggacacaagttttcggtatccggagaaggagagggtgacgccacatacggaaagcttacactcaaattcatctgtacgacggggaaactgcccgtaccctggcctacgctcgtaaccacgctgacttatggagtgcagtgctttagcagataccccgaccatatgaagcagcacgacttcttcaagtcggcgatgcccgaggggtacgtgcaagagaggaccattttcttcaaagacgatggcaattacaaaacacgcgcagaagtcaagtttgagggcgatactctggtcaatcggatcgaattgaagggaatcgatttcaaagaagatggaaacatccttggccataagctcgagtacaactataactcgcataatgtctatatcatggctgacaagcagaaaaacggtatcaaagtcaactttaagatccgacacaatattgaggacggttcggtgcagcttgcggaccactatcaacagaatacgccgattggggatggtccggtccttttgccggataaccattatctctcaacccagtcagccctgagcaaagatccaaacgagaagagggaccacatggtcttgctcgaattcgtgacagcggcagggatcactctgggaatggacgagttgtacaagtgataagctgccttctgcggggcttgccttctggccatgcccttcttctctcccttgcacctgtacctcttggtctttgaataaagcctgagtaggaaggcggccgctcgagcatgcatctaga

SEQ ID NO: 16114 - RNA, 863 nt, Artificial Sequence
  Description of Artificial Sequence: Synthetic transcript sequence
gggaaauaagagagaaaagaagaguaagaagaaauauaagagccaccaugguguccaagggugaggaauuguuuaccgggguggugccuauucucgucgaacuugacggggaugugaauggacacaaguuuucgguauccggagaaggagagggugacgccacauacggaaagcuuacacucaaauucaucuguacgacggggaaacugcccguacccuggccuacgcucguaaccacgcugacuuauggagugcagugcuuuagcagauaccccgaccauaugaagcagcacgacuucuucaagucggcgaugcccgagggguacgugcaagagaggaccauuuucuucaaagacgauggcaauuacaaaacacgcgcagaagucaaguuugagggcgauacucuggucaaucggaucgaauugaagggaaucgauuucaaagaagauggaaacauccuuggccauaagcucgaguacaacuauaacucgcauaaugucuauaucauggcugacaagcagaaaaacgguaucaaagucaacuuuaagauccgacacaauauugaggacgguucggugcagcuugcggaccacuaucaacagaauacgccgauuggggaugguccgguccuuuugccggauaaccauuaucucucaacccagucagcccugagcaaagauccaaacgagaagagggaccacauggucuugcucgaauucgugacagcggcagggaucacucugggaauggacgaguuguacaagugauaagcugccuucugcggggcuugccuucuggccaugcccuucuucucucccuugcaccuguaccucuuggucuuugaauaaagccugaguaggaag

SEQ ID NO: 16115 - RNA, 716 nt, Artificial Sequence
  Description of Artificial Sequence: Synthetic transcript sequence
gggaaauaagagagaaaagaagaguaagaagaaauauaagagccaccaugaacuuucucuugucaugggugcacuggagccuugcgcugcugcuguaucuucaucacgcuaaguggagccaggccgcacccauggcggaggguggcggacagaaucaccacgaaguagucaaauucauggacguguaccagaggucguauugccauccgauugaaacucuuguggauaucuuucaagaauaccccgaugaaaucgaguacauuuucaaaccgucgugugucccucucaugaggugcgggggaugcugcaaugaugaaggguuggaguguguccccacggaggagucgaauaucacaaugcaaaucaugcgcaucaaaccacaucagggucagcauauuggagagauguccuuucuccagcacaacaaaugugaguguagaccgaagaaggaccgagcccgacaggaaaacccaugcggaccgugcuccgagcggcgcaaacacuuguucguacaagacccccagacaugcaagugcucauguaagaauaccgauucgcgguguaaggcgagacagcuggaauugaacgagcgcacguguaggugcgacaagccuagacggugagcugccuucugcggggcuugccuucuggccaugcccuucuucucucccuugcaccuguaccucuuggucuuugaauaaagccugaguaggaag

SEQ ID NO: 16116 - RNA, 1316 nt, Artificial Sequence
  Description of Artificial Sequence: Synthetic transcript sequence
gggaaauaagagagaaaagaagaguaagaagaaauauaagagccaccaugcccccaucgggauugagauuguugccccuucugcuuccgcugcuuugguugcucguccugaccccuggcaggcccgcagcgggguugucgacguguaagacgauugacauggagcucgugaaacgcaagagaauugaagcaaucaggggucaaauucugagcaaacucagacucgcauccccaccgucccagggugaggucccaccgggaccucugcccgaggcgguccuggccuuguacaacucgacacgcgaccgagucgcaggggagucagcggaacccgagcccgaacccgaggccgacuacuacgccaaagaggucacucgggucuugaugguggaaacucacaacgaaaucuacgacaaguuuaagcagucgacccauucgaucuacauguucuucaauaccagcgagcuuagagaagcgguccccgagccgguacuuuuguccagagcggagcugcgguugcucaggcucaagcugaaaguggaacagcacguagagcuuuaucagaaguacagcaacaauucauggcgguaucucucgaaccggcuguuggcgccgucggauucacccgaauggcucagcuuugaugucacggggguggugcgccagugguuguccaggggcggagagaucgaaggauuucggcucucagcccacuguucgugugauagcagggacaacacgcuccaaguagauaucaacggauucacuacuggucgcagaggggaucuugcgacaauccacgguaugaaucgcccuuuucuccugcugauggccacaccccuugaacgggcgcaacaucuucagucaucccgccauaggagagcacuggacacgaacuacuguuuuucgucgacagagaagaauugcugcgugcggcagcuuuacaucgacuuccgaaaagaucucggguggaaauggauucaugaaccgaagggguaucacgccaacuucugccuggguccguguccuuauaucuggucguuggauacacaguauucaaagguguuggcucuuuacaaucagcacaacccgggagccucggcugcgccuuguugcguaccccaggcauuggagccauugccgauuguguauuaugugggaagaaagccgaaaguggagcaguugucgaauaugaucguacggagcugcaaaugcuccugauaagcugccuucugcggggcuugccuucuggccaugcccuucuucucucccuugcaccuguaccucuuggucuuugaauaaagccugaguaggaag

SEQ ID NO: 16117 - RNA, 806 nt, Artificial Sequence
  Description of Artificial Sequence: Synthetic transcript sequence
gggaaauaagagagaaaagaagaguaagaagaaauauaagagccaccauggguguaaggcacccgcccugcucccacagacuccuggcggugugugccuugguaucgcuugcgaccgccgcacugcuugucaauccggggguagucgugcgcaucagccagaagggacuggauuacgccucgcagcaggguaccgcggcacuucagaaagagcuuaagcggaucaagauuccagacuauucagauagcuuuaagaucaagcauuugggaaaaggucacuauucguuuuacucgauggacauuagagaauuccagcucccuucgucccaaauuuccauggucccgaauguggggcugaaauucagcauuucgaacgcgaacaucaagaucucagggaaauggaaggcacagaagcgauuucucaaaaugucaggaaacuuugaucucuccaucgaggggaugucaaucucggcggacuugaaacucggcuccaauccuacaucgggaaagcccacuauuacggccucgucguguucgagccauaucaacucggugcacguccauaucucaaaguccaaaguaggauggcuuauccagcucuuccacaaaaagauugagucggcuuugcgcaacaagaugaauagccaagugugcgagaaagucacaaauuccgugucaucagaauugcagcccuacuuccaaacgcuguaaugagcugccuucugcggggcuugccuucuggccaugcccuucuucucucccuugcaccuguaccucuuggucuuugaauaaagccugaguaggaag

SEQ ID NO: 16118 - RNA, 1573 nt, Artificial Sequence
  Description of Artificial Sequence: Synthetic transcript sequence
gggaaauaagagagaaaagaagaguaagaagaaauauaagagccaccaugguauccaagggggaggaggacaacauggcgaucaucaaggaguucaugcgauucaaggugcacauggaagguucggucaacggacacgaauuugaaaucgaaggagagggugaaggaaggcccuaugaagggacacagaccgcgaaacucaaggucacgaaagggggaccacuuccuuucgccugggacauucuuucgccccaguuuauguacggguccaaagcauaugugaagcaucccgccgauauuccugacuaucugaaacucagcuuucccgagggauucaagugggagcgggucaugaacuuugaggacggggguguagucaccguaacccaagacucaagccuccaagacggcgaguucaucuacaaggucaaacugcgggggacuaacuuuccgucggaugggccggugaugcagaagaaaacgaugggaugggaagcgucaucggagaggauguacccagaagauggugcauugaagggggagaucaagcagagacugaaguugaaagaugggggacauuaugaugccgaggugaaaacgacauacaaagcgaaaaagccggugcagcuucccggagcguauaaugugaauaucaaguuggauauuacuucacacaaugaggacuacacaauugucgaacaguacgaacgcgcugaggguagacacucgacgggaggcauggacgaguuguacaaaggaagcggagcuacuaacuucagccugcugaagcaggcuggagacguggaggagaacccuggaccuaugguguccaagggugaggaauuguuuaccgggguggugccuauucucgucgaacuugacggggaugugaauggacacaaguuuucgguauccggagaaggagagggugacgccacauacggaaagcuuacacucaaauucaucuguacgacggggaaacugcccguacccuggccuacgcucguaaccacgcugacuuauggagugcagugcuuuagcagauaccccgaccauaugaagcagcacgacuucuucaagucggcgaugcccgagggguacgugcaagagaggaccauuuucuucaaagacgauggcaauuacaaaacacgcgcagaagucaaguuugagggcgauacucuggucaaucggaucgaauugaagggaaucgauuucaaagaagauggaaacauccuuggccauaagcucgaguacaacuauaacucgcauaaugucuauaucauggcugacaagcagaaaaacgguaucaaagucaacuuuaagauccgacacaauauugaggacgguucggugcagcuugcggaccacuaucaacagaauacgccgauuggggaugguccgguccuuuugccggauaaccauuaucucucaacccagucagcccugagcaaagauccaaacgagaagagggaccacauggucuugcucgaauucgugacagcggcagggaucacucugggaauggacgaguuguacaagugauaauggucuuugaauaaagccugaguaggaag

SEQ ID NO: 16119 - RNA, 1568 nt, Artificial Sequence
  Description of Artificial Sequence: Synthetic transcript sequence
gggaaauaagagagaaaagaagaguaagaagaaauauaagagccaccauggccgugauggcgccgcggacccugguccuccugcugucgggcgcccucgcccugacgcagaccugggccgaggugcagcuggucgagagcggcgggggccucgugcagccgggcgggucgcugcggcugagcugcgccgcgagcggguucaacaucaaggacaccuacauccacugggugcgccaggcccccggcaagggccucgagugggucgcccggaucuaccccacgaacggguacacccgcuacgccgacagcgugaagggccgguucaccaucagcgcggacaccucgaagaacacggccuaccugcagaugaacagccugcgcgccgaggacaccgccguguacuacugcagccgguggggcggcgacggguucuacgccauggacuacugggggcagggcacccucgucaccgugagcagcgcgucgacgaaggggcccagcguguucccgcuggcccccagcagcaagagcaccagcggcgggaccgccgcccugggcugccucgucaaggacuacuuccccgagcccgugaccgugucguggaacagcggcgcgcugacgagcgggguccacaccuucccggccgugcugcagagcagcggccucuacucgcugagcagcguggucaccgugcccagcagcagccuggggacccagacguacaucugcaacgugaaccacaagcccucgaacaccaaggucgacaagaagguggagcccaagagcugcgacaagacccacaccugcccgcccugccccgcccccgagcuccugggcgggcccagcguguuccuguucccgcccaagcccaaggacacgcucaugaucagccgcacccccgaggucaccugcgugguggucgacgugagccacgaggaccccgaggugaaguucaacugguacgucgacggcguggaggugcacaacgccaagaccaagccgcgggaggagcaguacaacucgacguaccgcgucgugagcgugcugaccguccugcaccaggacuggcucaacggcaaggaguacaagugcaaggugagcaacaaggcccugcccgcgcccaucgagaagaccaucagcaaggccaaggggcagccccgggagccgcagguguacacccugccccccagccgcgacgagcucacgaagaaccaggucagccugaccugccuggugaagggcuucuaccccucggacaucgccguggagugggagagcaacgggcagccggagaacaacuacaagaccaccccgcccguccucgacagcgacggcagcuucuuccuguacagcaagcugacgguggacaagucgcgguggcagcagggcaacguguucagcugcagcgucaugcacgaggcccuccacaaccacuacacccagaagagccugagccugagccccgggugauaauaggcugccuucugcggggcuugccuucuggccaugcccuucuucucucccuugcaccuguaccucuuggucuuugaauaaagccugaguaggaag

SEQ ID NO: 16120 - RNA, 863 nt, Artificial Sequence
  Description of Artificial Sequence: Synthetic transcript sequence
gggaaauaagagagaaaagaagaguaagaagaaauauaagagccaccauggccgugauggcgccgcggacccugguccuccugcugucgggcgcccucgcccugacgcagaccugggccgacauccagaugacccagagcccgucgagccugagcgccagcgugggcgaccgggucacgaucaccugccgcgcgagccaggacgugaacaccgccguggccugguaccagcagaagcccgggaaggcccccaagcuccugaucuacucggcgagcuuccuguacagcggcguccccagccgguucagcgggucgcgcagcggcaccgacuucacgcucaccaucagcagccugcagccggaggacuucgccaccuacuacugccagcagcacuacaccacgccccccaccuucgggcagggcaccaagguggagaucaagcggaccguggccgcccccagcgucuucaucuucccgcccagcgacgagcagcugaagucgggcacggccagcguggugugccuccugaacaacuucuacccccgcgaggcgaagguccaguggaagguggacaacgcccugcagagcgggaacagccaggagagcgugaccgagcaggacucgaaggacagcaccuacagccucagcagcacccugacgcugagcaaggccgacuacgagaagcacaaggucuacgccugcgaggugacccaccaggggcucucgagccccgugaccaagagcuucaaccggggcgagugcugauaauaggcugccuucugcggggcuugccuucuggccaugcccuucuucucucccuugcaccuguaccucuuggucuuugaauaaagccugaguaggaag
